United States Patent 7,365,185 (GENOMIC PLANT SEQUENCES AND USES THEREOF) - sequence listing, part 101

SEQ ID NO: 89138 - DNA, 3691 bp, Oryza sativa
ttattttttttactaaactttgataaatatataaagaatcctgctaaaacttagcaatattactaatttagtaaggtttattttgactatagtctgtatagtccataagggagtaggtggctctaggtggagagtgatacaaacgccaacggtgaaggaaaggtcaattaatgcttatcgaagcctaattaagcgtcacggcagagcggtcaatgcttatggaatcctggatggcgtgcgtggtaatttttatacatatatgagtatatatacctggagcttcgtagaacttttctcttcggcaagaagtggtgataacctcgtataaaaaataaatgggtcaaacaaatgatttatgtgtatagaaatgggaaggataagattaattacagggtcaaatggattgttacatcaacggctacctttacttaatctattttagtttttcctaatcttcaagatgtggggcctattcactttgatgtcatcgtcttcaaccataccattttttttataaagttaccaatattttggctaagcttagtttgttgtcaaattttagtaaatcaaaatttggttttggcaaccttaccaaaatttggcaatgtcaaaacttgataaggttaaaaatggtagcaaagtgaacaagcccgtgacttccactagtatttttacaaatctcactactacaaaaacaaccattagtgtcggccacaaaggtaccggttagctaaaaaagacacctataagacacttcccgccaatatagtgaaaaactggcacctataacggttaattggtgtcggtttttgttgggagggacattggtggcacaaaaaatcctcccaccaactatcctaaaatacaacaggtggcggccgtgcgaaaaaaccggcacatatatcaatggtgccggttatttaaccaaactgacacctatagtttgcatcatataggccagcgaggagaatagacgccggttcggctaaaaaatcggcacctgtaatattataggtgttggttacaataatataggtgtcggttctgggtgtacaaccggcacctatagtgccatataggtgttggtttttggtgtagaaccggcacccataatattataggtgctgattttaaatttgaatttgaattatatcctattcaaatttgaatttaaaatttaaatattttttatatatagtatttctgtgcatctaaagtttatacacctaaagtttttagacccaaactttataagtcaaaagtttacatacccgattcaaatttgaatttgaattcaaatattagtttatagatctaaagtttataagtcaaaagtttacatacccgtttcaaatttaaatttgaattcaaatattagtttatagaccgaaaatttataagtctaaagcagggccggtcctgactttttagggccccggtgcgaaactaaatatagaggcccttatcatataattagtatatacatatactttatatataaattattgtataaatattaaaattttattaaaaaatatttatatagaaaacattatagtacatgttacctcaaatatttcttcaaacatttgtgccttcgtcggtttgtccaattatcggaacaattaaattaacctaacataggaccatacatcaatacacagcaaaaaccaacacatgagattacatgttaacaaataaaatcacaatgttacaaaaatttcaatttttcacttggcgatggcgatgtattggtgttacactcaccttaatagaatgattgttgattgatcactgatcagacaaatacagtattcagattcactaacccccgtcggcggtcggcccatccttctcgagtcctcgtcaagacatccagtgctctaggggctagggcagccggcggcaagcatcaagccatcaagcaagcaagcagcggctgccgccgtgcccgtgcagcgcctggccggtagccacctacacctgacacaaggcctgactcctgagcacctcgtgtcctcgtcgatcgtcggcagtcggctcgtcctcgactcctcgtgcggattgcggaacgagcggtgcacggtgggcgtgaggagaagagaggagacgacgtggaaggcaggcggcgccaatctcgcgagtcgcgtattcggcgtctgttcgccttcgccctaacgccacatcgtcgcgccgcgcgcgccggaggggggggggtggggttggcgcggggccctgcgatttgggggccagagcgaccgcaccgctcgcctccctaggaccggctctggtcaaaagtttatatacacgttttaaatttaaatttgaattcaaatattttttatatatagtatttttatacataatttttttcaactttttttaaatttttttatagtttactgtagtaggaagagaatgagggaaggaggaagggggagatccgtacgtatagggggtaggggcgtgcgggtgatcgcgtatagggggtaggggcgtgcgggtgatcgctcccgcattagccacaccctatgcgggcgagaccgcgggagttgagacccatcatcacgttcttaaaaaaaaaatcacacacacacatagagagagacccatattttatcacccatcctagctagctagctagctaacgatttgttttggttcagaattgctcgaacttttactagggacgtacccaagtgttgtaatgggattaaagaaaagaaaaatgggccaataattttacaagttcaggatcacttttgaacgcatgattatcaaatcatgggaataggaaaaatataaaaatagaatatcatatttattggattcctaggggatttgaaaacacaggaacactttaaaactaatgtttgatagtcacacagaaaaaatagaattcaagacattgaaagaagaaaacataatgtaagacctcatgctaattctctttcgaaattcctatacaataatcattccgtaggaatttctcgaaattactatgttatagccttttctgtacattcaatgtactctacggatagaggaatacataaagttgaacataataaaataagaaattgaaagattcgttgaaattgttcgtttggaaatttcccgaaaagctaatttcgaagtaatcgatagaaatcaatcatttcttttagaggtcttgtactattatctcccatagatataccttagatttctatggaacataatggttttacggtttcagttatctttggacttattgacttgttgttagagaaatttatcggtaacgttccctgtgtatcaatttttttttaaaaaaataaaacgagtgaaatggggaacaacatttcgcaattgactcttctacactcaacccaacttgcagcctcagttgattaattaacacctcagcctaaccaaacccatttgaatctccttccctaatcgagcagctgcaatgatgacggcatctgaggtttggcaacccgagaacggaagctgctggcacatgttcagaaacgcttggagacaaagatcgctcttccttaaaaattgccaaagaaaacagaaatgaatcataggaaagaaacatcgcgataaaataaacatatggaacggccggccaacaaaggtgagaaaaaatagaagattaattgctgtaattaattaagcaactaggcaaaaagggggatcc

SEQ ID NO: 89139 - DNA, 1276 bp, Oryza sativa
gtttcttcaaggccctgaactgatcgtgcaacagttaggaagataagagatgccatagataacgaggcagaggtcacagttcagctcataaattatacaaaaagtggtaggctactcgtcacttgtctgcatgtttttgttctcaacttataaatataatagctagttgataccccgcgctttgttgcgggatatgtatatgaatacatgctatatattatagaaaatggtagacgtatatatttaaataaggtgaaaatgatgtggagataatgatttgacattgcttgcatattgagttctaaaaatataacaaaattgtaaatgatatggcatgtttgcatgatatttaaaatactctagataataattgctattgggtgatgatgcggtacacttgtatgtggtttaaaatactctagatgataattacttgtgagtgataatgtggcacacttgcatgttgtattttaagagttagtggacatcaattttataataagataggatatgtcttttcacagtaaagttaccttcccttcattacttcattacttggacaggtaaaaagttttggaacctctttcacttgcaaccaatgcgtgatcaaaaggtactatagtgacagacatgggaaaagtttctgctgagttattcaacatatttgtctacaattcttttgtatgtaatttgacatgagtccaatttgcctgtggatcagggtgatgttcagtactttattggggttcaattggatggaactgagcatgttcaggatgatgctgcaaaagagggagtcgtgctggtttgtatcttgaaaaatcatatttgtgcaactgacaaaagcaacacaaatagatatgggcagtcccattgtcatgttatgttttgtagtctgatgcttctggagttttattaagaacgaaggctatgttcatttgcaagagttggaaacacagctgttgcgcacgggaaacggagcgatccattagcacattattaattaagtattagccaatttcttttcaaaaatggatcaatatgatttttttaaagcaacattcgtatagaaactttttgcaaaaaacgcactgtttaacaatttgaataacgtgggcatggaatacaagagagatgggttgggaacatagagaaaaaaactcagcctaactggaattgcaaaaatgctctatacccgaagtcaaaactagtgctacagaacctgtgatacatctcacatattataaaatctaatctacgtgactagcattctctt

SEQ ID NO: 89140 - DNA, 2506 bp, Oryza sativa
ccgcagataatatcgatgaggctgcaaaggaactcccggatgctaatttggtcagattaaagcatcactctttgattcatcatatatgtgcttgcagttctaacagtaacccatgctcacattcagagaccggaagatctatgggctaaccactcaaaagtagtcctgccaaatccacatatgaaggatactgcatcatggagagccatccaaaaggtatgatttgactatagttcactgaattcgctacgcaaacatcactttaaggttattgcatatagcgggctcatcttttcgcttatgcttatcagccaaaatttgaattttcaaccttaaattcgaagccgattttgaggttttttcatcgaagtttatttttcagcttttgcttttagatcactaagaacacgtatataaaagcttcatttacaaattacttttcatttgcaaatatgtcgtttggcttattccgtagataagccaaacaatggggttgtaagtgtcattatctggacaaacttggaagagttatatatcattatctagacaaacatgggagagtgatttacatgtcaacctctatgttttaaaagtgtcattttaatctcatcactattctgttgtagaatacaacagcctttatagaacactagttatttgcctactatattatatgccatcacagccaggagatttatactgatgtataatacaatagcctttacagaatattaataactaatatctcttgtaggttctcgagagtggtgaaagtattggtttaaaacattttaggccagtaaaaccattaggatctggtgacactggaaggtaatcatttcatggtttggttaaattggataaacattgaattgttgccttttattgctaatacatttgactcattttacaattgttgtttcaacaatgtgtattatgattggaattgaagtgtacacttggtagagttgttgaatacaggagaatactttgccatgaaagctatggataaaagcatcatgcttaaccgcaataaggtttgatgcttgtttcaccttttaaaatgtatacattttttgtgaataaaagacattgtttatacttctagttatgtctattgcattatatctctgagtacattataatgtctctaggttcacagagctactgctgaacgccaaatccttgatctattagatcacccattccttccaacattatatgcatcatttcaggtttgctctatcaataatctagctaagatgtcctatttatgtataatcatttccatttcactctataatgtggaagctatccctattatctagtcttaataccccaacatagctatagaaatctttttgcagtacatcagttttatgtggtattttcttatgaattttccttttcaatatatggcagacaaaaacgcatatatgcctcattactgactactgcccgggtggtgagctctttgtgcttctagataatcaacctctgaaggttctacatgaagatgcagtcaggtcatcatttaaactattgttttcgcttagttctgatgggatgatgtgtgtggctttgttttgaacacacgttggcagcatatgtgctaatcattgtggcaaagacatgctactttgatctgttgtgattttgtttgattcaattattgtatgagaagacaataagcatttgtataatactatttcattgttcacaggttctatgctgccgaagtggttgttgcactagaatacctacattgccaaggtacatatacatcattgttgataacttgcatgcattaaaaattctcttatttcaatgatcatcaatatatctagggatgcctatcaactttacataaaaagaacatggccttaatactcataatttatccactttgactgcatgccatacataaatattgaaccataacagcacttcttcaatacagttgaatcctcacaagaaatccatgcatttacttggtgggtaatagatgtcttgtctctttttgacaattcatgatatttagttggaaaatagttactccctccatttcaaattactagtcgtgtagatttgtcctaaatcaaatatgtttatctttggctatttttttagaaatctatgtagtttaacatgtgaattactccctctgtccctaaatatttaacgccgttgacttttttaagcatgtttaactgtttgtcttattcaaaaaaatttaaataattattaattcttttcctatcatttgattcattgttaactacttttatgtatacatatagttttacatatttcacaaaaaaatttgaataaaacgaatggtcaaacatgtttaaaaaagtcaacggtgtcaaatatttagggacggagggagtatatagtatgaaagtatttgtcatggtggatctaaaaaatatcaatcttattatgtcaaatattaaaatgtttgacttaggacaaacctaaaatgacgagtaatttaaaacag

SEQ ID NO: 89141 - DNA, 1688 bp, Oryza sativa
tctttctcttaggaatcctcagcatcgactggatccatgtagattccaaaatgtgaaacttagattgtatatagaatgcactgtgtgtgttgaaaatgggctcattattgtgatgttttcagatatattacatatgccaaagaagaagaggccatcaggtgtattcaagctgtacacaattttgttttggaagggaaagtgttaaggtcaccctctatgctttgtagccttattgcagcagttttttttacataacgcagttagcctaatcgttaatggtttgttgcagagcgtgctttggtactacaaagtattgccatgcatggctgcggaacatggtatactcgttgcttcatcctggcagctttatttaccattactctacctactgccatccttctgagggcttttatcttctcttttttagacctgtggaaatccagattgtctctatttacatgatgtaggaagccaggaagatagtttcactaaagatgagataatctcagcatatacaaggtaagctgagctcgttgaacatatgtgtggaaagttccactgttccttattatggcactgtgccagtcctagccatatgtactttttcccctgccaagcctactgctactgttactatataatgctcttctgttctgagaatttgtagtctatcaacttttccctatactatgcatgaattattatgctttgctaaatgctaagattttcagtagttctgattggtgctttcgactcatcatctctcgttcctacaggagtagggttccccaaatggcgtctaatgtttctcaaagacgcgcagggactgtattacctcctccagcagaagatttctcatatagtgcagtggttgcagctaaacatccaatcaagaatggaataactgtatgttttttatactgaaaaatccattgggacactggacatgttcatttctgtttgatttcatgctgctacattaactggtcttattttgtacagaatactgcaaatcaatccaggctttcgcctccaaacagtagttctgggagatccacacttccaccagctgcttcatggtatgatgctgcttagggtctcatgatatgttttaaaatgtgaatttgttgctaaaatttttttggtatgagcagggggcatcgcgatttgaataccaggacaacagcaactggggtggcatcgtcacaatctcttactaaatcaaaagcagatcctcaaagtaattcattctcgagttcttcgactgtttcaagtacaaaactaccttcttcatggaatgatgacacaagcacagttccgaaaatgacggaaggacgagatagtttgtctaaaaccttgaagccatataagcctggtattgcaaaggaaacccaagctgtaacatcactggagtcatcgcttgacatagacttctctaccataccttcagcttggaacgatgatgatgtcacatcagatggcatgtcaaaaggaagtgacgagaagcaggttgtaaatgacaatggaaagtttgaatgttcagtttcttcaaagccagctgaatcagggcatcttacatcgaagtcaacgacatcaccaaagaaagacatcgcagtaaacagtaccaggcaaagtcctctaaattgtgtatcaagtccatcggtttctaaatcagaagtaaaggatgg

SEQ ID NO: 89142 - DNA, 1426 bp, Oryza sativa
tcttattagggattgattgattacaccgtgttactacagattgttattcccacaaacaaacaatctcatgtactactaataatattatctttcatgtctcctgccgctgaattgctcccgaaggatgaccatgagcgacgatggagaccgcacctgcccgctctgtgctgaggacatggacatcactgaccagcagctcaagccctgcaaatgcggctatgaggtttcttcccttccctccccaccactctactctccacaccccccttccattcacctcccttttgcatctcactgcagatttgtgtctggtgctggcaccacatcattgatatggctgagaaagaggacactgagggccgctgccccgcatgccgcactcgctatgacaaagataggattgtcaagatggctgccacttgtgacaggtccctccatctcaaaccgtcttttttcctttcacctcactaactgcactgacatgcgaagatggccgcacaagagcttagggtcttcagttcaacaaaacgaaacatcacccagttgtcgtgaattgtggtttgcaaagcgccataagcaacttcttttacctgtctatcgcatcggaaattttgtacttatgcttcttttaatggaaacaggacggtagtggagaaaaatgtggacaagaaacagaagacccaaaaggtcaagtcaaaggccgcggtaactgtggaagctaagaaacatcttgctagcgtcagggttatccagagaaacctcgtgtacataattggactacctgcaaatttatgcaacgaaagcgtgagtaccatattgtgcacagacagattcttttcaactgagtaatgtgtatattttgtttctcaccttggcaacacaattcattttttatttcagatacttgagcgcagggaatactttggtcagtatggcaaggttctgaaagtttcagtttctcggccgactggggctccttcccagcaggcaccaacaaacaacagtatcagcgtgtatgtttatgtgaatctcatgccacatgtttatgatgtttctctcatggataaacatgacctattatttcaagtgattagatatatcttaccgtatgtacaagtggtgttttcaagttatgctctcctgtactttccaagcctagagcatttaagcataggtgatttattgttgagaaattatatgcttaaatatagatgaaaatgatggctaattcaaatatgatatgtccatgttcttgcaattaatttcagatttatattacctacttaacagtatgatttgactaaggatcatgaatttccatatccatttgtgaatcagtgaatgccacacctagcagcctagtagccaaagcaaaagatgtagatttctagtgttgaataatcagataaatgcaaacgtgactgct

SEQ ID NO: 89143 - DNA, 1613 bp, Oryza sativa
attcctgcagcccaacatcctagaatgaaaaaccatcagcctggagcagttggtgcagtgagaattgataacataggcagttttgacaaggctgtaagtgtaaataaggatgagagcagcataattgctgatattttgtctttggagtttgatccatgggatgagtcgtattcaacggctaacaattttgctaagatgcttagtgcatctgaaaagaacgatgtgctttttgatgcacgttcatggaaaacaaaaaccagcaatagtgagtctagattttcatttgctagacaagataatcaaggaagcctcctagattcatctatgagaaattataaaagtgagcagaatttcagtttgccatcccagaattctcatggaaacatttatcagagtggcattgcatttcaatctcctgaggaaggtttctcaaagagcaactctcttactatgttggatatgctagctaccggtgagtagtatgaagttatattacgctgcttgtttattaaattcttaatgaacagtgagatgcagtactgcagttaatgtttttattttaatatttattttatatatttgaggtaatattaatgtgtcacaaaacaaatagatatattcgctaggatacagaagggatccaatgtttgtgcacccattcccctcttttaattcaatgttggcaatcttgtaacatatgtgattgggttgtggagctattaagtataaaatgcactgtgtttttatgttgaagcattttagtaactgatgttttcaccatggtacttctatgtacttacaaaaaaaatgctttttcaggcacatcaaagcctaaagtatccgcgcctcctggattttcagcaccagcaagagttcctactgggttttcttctggattttcatcccatgaggggttgaatccacctccaggattttcatctcataatgggcctaatccccctcctggattttcttctcagggtgggtctaatcagatctatggttcggcatactcaggttctctctctctctgcttctcctaaaacaatttcagtttctaataagtttgcaatgttttgcagaaactcgcccatttgatgatcttttgggtataaatactagccattatcaaccacagttagctagacaaacaagtgatatagaatttgttgatcctgctatattggctgtgggtaaagggcggatgcctggaataagtgattcagggttggagatgaaaacttcccatacttttccttcgcagttgcaaacatcaaatgatccaaggtttcaattacttatgcagcagaacatgccttcccatcaaaatgttggatttgcagaacatgttcaagatgcattcaaccctatgaatgataattatcttgcatcccgacttatacctcagaaccatggttctctatcctcttacacacagatgtcactccaacaacctagaagctcacatcttacaaatggtcattgggatggctggggtgatttgagacaagggaataatgtttccatgcctgacatgtcaaggatgttatatccaactgaagcaaacaacttccacatgctgggttcaaatgatctgtataacagagcttttg

SEQ ID NO: 89144 - DNA, 1091 bp, Oryza sativa
acaagtgaataaatgagttaagtggaaaggttagtatctaatgccatgagaagatagtcaagaacatgttattattttcatgactggtcagatatcaatttagatgaggaaagggttattgtgtaatggttcaaagatgcaaacatggattctaacgcaagacatcaacataccgagggtcatcttcaaggcgctctgaaggaagcaggagcatgaaattgcgaaaatggctgtaggagattgattcttctgaatctgcatttaggtaccgcagcatggcagcagcattatcttcattggccggaaggcctgcaccttttaaagatgtgagaatttgatttttgtgaagtgtcccagacttgctcaaacacagggtggtgtatgcccgcaatattgttggctccttctgctccatcaaggatagaaattgtttccacccaattgattttgaaaacaagttacttctggtgcgccgtaaaaaatcccgagcatacctccttggcaatcgcctctttctcattgcaatctcaaggtcttccagggtgacttgaccatcaccatctctgtctaactcctcaaagaatcgctttcctgcagaagcaacaaaaaagagcttaggatatcaacatgcaagagttacctccatctatttccaatagaacaacaaagtaacatcatcagacataatatttcagtgatatcaatgtcataccaacagcatcaagccaatatctggagctctagttatctgtacatgattgtacaccattggggaattgtgttatgcatattctgaatctgaagagtctgaagtagtgcgtatgaacgcacaaaagaaataagatactacaatcatgttgtgctggaagtaataaggttgaggactggtaatatttaagtaacacatactgcatgcattttctcggtaaaaccagaagaatactgagttagagaaaacaccatatcctatatctgcgtacttgaacaaaaccatgtgaatctttgtaagaaactaaattcagcatttatcctacggttgttagaattagtgacttgtcttattgacataacaatgctatcatgttattaga

SEQ ID NO: 89145 - DNA, 667 bp, Oryza sativa
tttctacctccgtgatgcatcccattgattcaatgaaggtacacaaacttgttactttttaacccttttagtgtaaacaacttaaccgatagcactgattcaacagtgtgttcacttgatggcatttgttagaagaggatgtcttaatgacagagcaaataaaatccaacatactaaattttagataattatgacaaacaccatctgcttctagcaggttccatgggaatatcatgggatgcaatcaaatagaaatttatacaaagcatactactggcaggagctttttatttgtactatttctttttccagtttttcctctatgaatgatcgcccttcactcaaggcattacctacaatgaacttgccttactttttttagaaagtcgataatgaatttacttgctagattttatgctaatggattttttttttgcttgagaaattcaacagttttatgatatttctgattcaagctctttattttctaaactgtatcagacacgtgtccaagcatcttctctttcttttcctgatctcatatcaacacttccacaaattgggctccgaggactttatcggggttctatccccgcaattcttggtcagttttcaaggttagtgtcgattcagagttttagaggcaaatttgaatgtaggctgcata

SEQ ID NO: 89146 - DNA, 1201 bp, Oryza sativa
tttctgtgttcagctcactgtctgagaaactgctctcagagtcatcttcatcctcttctgttgaagctccaatttttgagagaaaactgagggcattgcgagcgcacgtctctgaggccgcaatcccttagatttgggggattttttccttttgcttgaacgatcattcctagacttcctgcttttatgtggccttgacacttgaggcacatcacgctcgtcaaaatttcttttcttaactcgacgaccagatgaagtaaccacacccccctgtcgaagatacaatgaaaaggtaaacaagtcaaaaatcagaaggtggcataaaagaggaaggaatgatcacgattgttgcctcttacatctgattttttcttttttcttctcgatctgcggagagcgctatcagtaaggttatccccatcaatttctccacttgagtacgaagcaccagatgaatcaccattcaaagcctcatgttccccttcactagaatgctcatccaggccatcgtactcagaatcagtatcatctgaaataacctcattttctggttcaagctcaatgaagtctgttatctctggaagtggttcccacctatctggatcaataactgggatgatttgatattcaccagtggttgcattgtaagtgggaccgacagcaaaattcacggagggaggtcgccactcaatacccagggtacctaaccgtcgtttctggtacatactctggaagggctctggatagggtatcatacctgcaatcaacaaatcataagtacaagtatacaagtggctagaagcctctacttatactaggctagaaggatggcatacaatgtacataccagagtcacacagaaggtcttgcatatttctcctataaggtgcaagctgtgtttcctggattaatgaaggaaaaagcataaagaaaaccaacataggtcatgatgcactttgtgaaccaataaaaggcagcttgacacaggttaagaataaccagagttcagtagcttctggagttgtttgtttagtaatgtttcgatatttccttagccttgcaaaagttcactagattgaaccctttgtggggttactattgaatagatttttttttaatgcactacatctactatgaaaagaaacattaattaactacatgacaataatgttgtggataccatgtttactcaaagagagaa

SEQ ID NO: 89147 - DNA, 3207 bp, Oryza sativa
tcctgcagcccgaacaaaataacatactcaaactaatgccaaagagaaaaactcaatccccacggctaatccaatggttcatctcatcacaaggacggggcagtttacatgattgcacccaaacattggtttacaccaggtattccctacaataactcgaaagttgggtaacaatatttgtacctgatcatatttcgcatccttctgcgactctccctgccctgtaccaataatgaatatttgtccaatttcatcggagagaatcagtgatgtcccatccctgaatggtccagcataatattaagaacataaaaaaataaataatttagattaatcaacaatacaagtaattgatcaaagttctcttttccattttaaatggtcctgatgtttctaagttaatatatcacatactagcataataaataactaaattcaacagctctagtaagtctagtggagtattaatattgacagggtgatagtcgccttaatcttttttaaaaaaaaaacgttggagtgcagaacatctagaaggaaaaataataccaatataatgtttatattctctttgagttgtgtccaaaatgagtataagctactccttccatcctaaactatagcagcatctagcattcaaaatcccaaaatattgcaacttctccacctacattctcttttcaaccaatcacaacctgctcccatttaattcctccacctactttctcttctcaaaccaatcacaaccttctcccatttaattctacctatttccttaataaacatgtccaacctcaaaagttcttatattttggaagagataaatgtccagataacataggtacatcgtcaaaccaatagtctatgtatcaaactaaccaggcatttaaaaacaaatgtttacaagtgcaaataattgactgatccaaactaattgttctgcccattatggcattatcagttaattttaagtcggagataccaaatcatctttacagttataatcaggatctgcgctagattatgaaacatgccctttctcaagatctaaaacagcaaaaccacaagactaaatggaacagtaagaaatttaggatcaatactagttatatttagaaagaaaaagggaatgaacaaccccaattgcatataataacaccttagcccaagtttactgtacaggtttaccagccaagtggtgggtttagttccacatggatagccccatttcatactttagttagagttgcacataaaccttgaagaaccaatcgcaccaaccaggttaaccattttaggcaaagcagggacagaagatgaacatgtcgcaatgtcagtatagtgctacagatggatgtaccttgggttacaagtgagcacttcagtggaagataattttgacttttaaccagatcaaaaaagatgaatacgatggctaaagtatcacagtattcaacaaagagatttgaggaacacaatgagattgaacaacaaaatcaacaaaaatatttctacgcaaactcaagattcctaaatagtgagatgaatagatgacagtgctacttaatagatttgagaaaaataaaaggatgatgctgtgaagaaattctacagtgacacttacggtgagaacttcccatcaactaacttgaaatgcccagtttcatatatctgtacaggcttcccttcccaaatctggatagagaaaaacagatgttcagcctggaagattgtgataagaatagaaaaaatctggcaagaaacttacatcccatatgattgtctttccatcatacccagcactcatagctatacgggggttgaatggatgcacatcaagaacaaatgtctgttgagaatgagggtggtcaaatttcataagagaacataactctaggcaagggtcacagcttttgtgaaaaattgaagttgaaagaaaaaaaacacaaataaaaatgaaacagaatgcagatcatggcattgcaacagaacagaactgcaacaaaacagagcagacagatcactgattcattcaaacagtttaatacatagattcactcatggaattcatgcaaattttagtgggaccacaccagaaatcttgtttccattcaaagagagctcattacccagaaaaataaaataaaaaggataagtgacaacacaggtccaacaagcttcaatcatggcaagagaaaaatggttatatatgtgagaatacaacagattaaactgaactgtagctgctgggtaaaaatactgccaataatcgaacgatgaaatggctatgaaataaattgggttaaaaataactcgaaacacgctaaggtaaaagatgatattaccaacgcttaatactaaactgctcaatggaatttgcaacatgaagcaacactcagtgatttcattattcaagaactatgagaaaaatgattaagtattgaatcgcagagaaacaagaattggcaggttgcattctcatactgtcctgttcttaaaaaaaaaaatctttgtaaaagatttacatctccaaagctaccatatccatgtttcttgtttcagtaatgttttgtatgcctttcagtccatgctcttgccaggatgctagcacacttacaaaaaaagtatgaatagttacaattgtactccacgaacatgtgaatagcatgctaagttgctaactcaaagagttacaattataagtgatgaaaataacatgaatgaaagctctatgactgttaatttgcaataatgtcaataatttaaaaaacataatgcatgtcatatgcttactgattctttatgcccaatcaatgaatgtaccaagctcccatcagaagcattccaaacacaaattctgcaatctgcgggacataatacatatttaagggaaatgaatacagatgataacaaaaatagaaaaggagactatgcaaaaaaatggaaagaacagtttatcctaagtctttagatggatgccccaaactgcaaaacatggagtgaggcaaccatggaggcttctacatgctaggtactctaaaccaattatcaatttcatcatatcggtccctgaggttaacaactttgagctaataataaaaataataaagagaattatgctactaagcgtctctctatttttcaaatgagcaatagctactgcaatcacaaaagcataataacctctaagtttagggctgcaggaat

SEQ ID NO: 89148 - DNA, 2154 bp, Oryza sativa
aacaccagcatagtttcattaaatcaataattgaataaattttcataatatattagtcttgggttaaaattactacttttttctacaaaattagtcaaacttagagtagtttgactttgaccaaagtcaaaacgtcttataacctgaaacggagggagtagtaaacaacttacagatatatctctgcagtttccttttagtgtgtacataagtagtttggtgtctcagacaagcttcaggtttggctaaggctacattcgtttctctggcttgggaactcattccctccgcacggaaaacggagcggtccattagcacgtgattaattaagtattagctaattttttttcaaaaatggatcaatatgattttttaagcaattttcatatagaaacttttttgcaaaaaaaaagtaaagtttagcagtttgaaaagcgtgcacgtggaatacgagggagaggggttgggaacaaagagcaacgaacacagcctaaagcagattgaacaccgaattgtataccatagactgatgacaagtttatcctttcagtttatgcttttatgaaaatactatagaataaagtattcagaaagatacgagcactcacgacaacagctggaaagcagcaccgggccttggactaaatgcaatggcggttacaacccctgtatgccccttcagcactgagataggcaggccatcaggtatacgccactacattagtgagtagtaaacagagtcattaacaggaaaggaagaaagatattatcacagttattgagaaagcatacaatgaacttacaactctaataatgaaatcattggatgaagatgctaccacagcattattggaactcactgcgaggtcagtaatatcacccttaattcgaaaaaaaagggcagtaagttttctgatgaaaggttgtaaatgttattatgttacaataagcaaaacttacttcatgacctcggcagctagccagacaaaatgctgtttccattgcccaaattttaacaaggcgatcatcagaaccagtaataacataacgtcccgttcgatcaaaagtagctgcagaaacagaaacaatctcagtctgaaaaaacaatagagcagataaaagagagaaaatgtaaaaaacaacaaggtatgatggtctagaacaaattaacaaaaggacaaggcagtagctacatttgttgaagatatagggataagtcctttagtaatgttgcataatttagcaaattgtaaagttaatatcagtaaccattttgctgaatagaccgtggcagtatggcgcatatggtcactgtagatactcaaaacaacaaccatggaatgatgtatccacggaaaaatattcaaataacttattcaagcattatgtgttaagaaaaaagaaagaccaacagaccacaatacacagcattttgatgtccccttaatctctttataatctgcatcttttcaacaagggtcgatggcttcgcaatggcatagcatgacgcgcgtacagacggagctcggcgatgtttagtgaaaccgccaatctctctcagacttaaaccgcgaacttgatcggcttgtatgtgtggccaacggagataacgcaacagcttgggattttccttttcttgcctgcttgtatcagctgaaggatccaagatttctcataagcagttcagcacatagcaattataacagcgaaaatgtacataacataaatcaaactagcgaaactaggaacacaaggttgggtagaaatgaaattataaacagctcatcgggactagaagaacatagtgtacatacatgcaagaagggagaaggaacttgatccaagaagcgttgggacatcagcagcatttggagaaacccctccaaccaagccatgtgggtggcaagaactaaaaatcagctgctttaaaagctttaccaagtggtctttaccaatgtgggggtatctacaaaatgagcagcataaacaaaagtatgtgaaatgctcagtgtcatgtgatcattgagaaaataaagcagataataactggtctgccacggcaagggacagttgtatgtgtttgttcatctgttatgctcaaattatatcctaacacattaacaaactagcagcagtttaagaaacataaagctt

SEQ ID NO: 89149 - DNA, 765 bp, Oryza sativa
tgacgtttcagaaatagtatgattcatcagctctagaatctagactagcacaccagggaagagtgatgaagtatgaactccacaggataagacaaatggatacaataccagatatttttcaattgttcccaattttactctaagaaactgagaagcatctccagttcactacaggcataatattatttttatgtgctccgagcagaatgaacctctagtttcttgcgtcataaaaatccttaattaacaataattaatataatagcacaaaactggtctggaaattttcactttgaattccagacctcaacatcctgatgatctttcagaaccaacattggaatgaacggataaatagttacctctcaactaactttaggtatcccaaagggagtgatatgccatcatcattttcttcaccgctatgaaaaccacctcgtgaataccaagcatgatatcttctaggtagcagctgatgttcaaggagctcattgcagagttctccaacagtccgcttaaatggaccatgtgataaaaaatgcatgatgagaaagtaaacttccctcatatcaacatcaacatcagcctcaggtggaacatctgttgctaccactggattgacagaattaaccttctcaagttcctgacttggaaaatccaggggcaccatactaatggaggccgcattaccagaaggttggtgttttctaagagccatgtatacagcaccaactgaagtgggaaataataacaaataagcatata

SEQ ID NO: 89150 - DNA, 2191 bp, Oryza sativa
attcttctattgattgatgcatttgttgctgatatgtgcgtggatgaatcttgtgttcatcaataaaagtgaaaattttgatttctaatggtaaatcgtcctttgctagaaaccaccactatttatttcaccaaaccactctgtttgtactcctatttcactaccttttaagataatatttgtaagtcctataaaactgcatgttatataagtcctcaaaaaccatattcgtacatatcttgaaaattatgttataatagaagttggtggtggaaattgtatttttagaccatgatgatgtccaaaacatatattttgtgcatagagagtttctttttatggtgacaagtctgataatgagcattaaccatagatttagcttttcttttacatatgcttgcctttagttttttttattcatatatgctcataaaatcatagggtggatgactagtattctctccatcccaaaatatagctacttaaacattaaaattttgttaaaatatatagtagtactttctccacctacccctcatctcaactaatcacaaacatctcttatttacaccccgtacttcctaatctcaaccaatcaaaaccatcccccatttaatttcacttattcgaatgtagccatattttgggatagagggagtacttgtttatttgaatagttttggttgcattatatgttagtccaatgactgattttggttgcattatattggcattttatgtatatatggtctatttagcaaattttcccatcatcttaggagttctttttctctacacacctaggtttcctgtccagttttccattgaggtgattaggataaggcttgagaacaattactacagaactctggaagctattcgacatgatgcgactgtgatgcttgcaaatgcccagtcttatttctcaaagagcactgatatgaccaaaaaaattcggaggctatctgattggatcgaacaaaccttttcatcattgtagagtggtgcttgatggttagtgcccagttaacaggcttctttttgtgcaagcagaatttgcctcgcagccacagtatgattctacaggtgttactgcggaaaattttgttagaggaatactaaagtagttttcaagatgctcaacagcttaacactatttaatgcattgttttgcttgcacaagttgatcttaactaacgcttctgatcattagatcttcgtgaagaaaaatcaattaccgattcgacaaaaggaacatcaagggccttgttagagataaagctggtagtgtaaaatgcactaccgtgttattcgttgtgtatagaccccgtaaatcatcaataaaaatgataaaatgtttatcgtctttattatgcactccaatttcaggtgttacattggatgatattcttcgtcgctttatacaaaatctcgtttctcccacgggagaatagcggagggaacagtcttttgcgcacaaaaacaaatccgggtttcaagaaagctgttttttttaaccgctcatccacgagtctcgattctgttgggtcaaacaaacaatcgaaaaaactggaaaccaaacttgcatctacagttaaaagcgattatccctttatcagtgttacctttcagatagccgaaatactatggcacttacaaagcgatgattgtacaggagtaatatttggatcagaactaatctggaattgagcactcacgagcgtcaaccccaaaaaacagaaacaccgaggacaaaaactccaggaaaacatggtcaaccgtgagaaacgaggaaatttcctgagagacaggggtagtcatcgtctacgtgggccttgcggctctgaacgtggggtgcagcaaccggccgagctcctcgtcgccggcgtctagcggctcgccggtctcgttcctgacgcgccgcacggccgtggtattcagcgactcgtgcgcgaacccgtacagcttcagtatttggtcgtccgcgaagttgaacgcgcgctccatgccgcgccggcaccgctccgccgggtagctgtcggcgtacctccggcacggcttgcacccgacgaagtgcgtgacgaacggtcaccggccgtcgtcgcgccccgcccgccgcagctcctcgtacttgtccacgatgccctcccagaacccgttgaggtcgtaggagctctcgatgaacaccttg

SEQ ID NO: 89151 - DNA, 1041 bp, Oryza sativa
cgcgcggtccatccgtcgcagcgtagcactaaccaactcctctcttctctctcctgtcacaagactgtgcctcaccgctcgaacgttcggatggggaccgtggtagattccacccgaatttatgtcccgcgggagcgccggttttccccccgggatcgcgtctcgcacgcaccggtttcgctgctggtggggcgcctggtttttgcgttccgcgtgcgcgcgcgctggctcgcccatgggttggcgggtggcgagtccgcgacaggtgggccccaccttgtctgcaacaggataaggacgaaaggccggtgccacgtggcgctaacgtgtctgaatgctacaacggattttccgtttggattttgatgggcttcggtgatttattatgggctggaacaccgaagattcatcgcgctgggccggcacgaaattaacgggctaacatgcttgtatcagatgcacaagtcagcccattgaatccaatggttgggtggagtaattagtggagctaatcatgttcgtgcgccccgattaaacgccacgacccgcaaactgcaaacgagctcgccacacagcgtccacgaccatggctgccgccgtggtagtgcaccgcacgtaagccatgcacccacgccgcaacaaaaatacagctccagcctacgacgccacgaacagataaagcactagctgagacatctaccggctcgagctccggttccccggccggcatcctgcgagcgaccatgtcgacggtggcgacgcctcgcggcaggtcgtcccagcgccggacacggtgcaagtgcgccggtggcggcggaggcgaccgcgccgcggcgtgctgcttcaacccgctgaggtccctcttccggtgccccggccgcggccgaggccgacgcagccgcagccgcagccgacacacgacgccgtcgaaggtccgtgacgcgtctgtcgcaggcggcgtcgagcagcagagcgaggagccgtccttcttcgtctacgccatgccgaaccagggcggtggcgacggcgtcaccgccgacc

SEQ ID NO: 89152 - DNA, 539 bp, Oryza sativa
ctttcatagttctgatatagttggcaattaatgtctgcaaaatcaggtactaaacttactaatgtgtatcgaatgcaaattatgcctgaattgctaagttggatagacagaaaatcatatgtagttgatctcttttgggaaggggggtgatttcattttatccataaaatttgtactacgatctcaatattgaaatgtgttttgcttatgcaggtgagttcaaaggcgatatactctggcatagtgaaccatggagtgacacacatgtgcgccgcgccggtcgtcttcaacaacctcatcacgctccggcgagcgagaccttcctgccgctcccgcgcgtggtcaacatcatggtggccggagccgccccgacgccgtcgctgctcgcggcgctgtcgatccgcggcttccgcgtgacccacacgtacgggctgtcggagacgtacggcccgtcgacggtgtgcgcgtggaagccggagtgggacaggctgccgctggaggagcggtcgcggctgcactgccggcagggcgtgaggtac

SEQ ID NO: 89153 - DNA, 10702 bp, Oryza sativa
catactatttttcacttcttctaagttacatggatttgataaagtacctttaggggaaaaaggtgcacatgtgcatgtaaatagatagtcatgtgaacctgtctgtatgtaaatttatgtagtactcatcaactataactgtacatgaaaccccgatatgcaggatgctcttattgctataaaaggtggtcgcatacctcctcccagcagtctgccatcatttgaggagattaaagatactctggggtttaacagctactatgaagaagaaaaacgatacgttgtgacaccagcccaatcatcatcgtacaggagcggtgaggacgattacttttagattacttttattctatgtcggatctatgttgaatgttttttttcctaaccttgaactcctaaattataggttactatgataatacaagtgaagcaagcagtccaggagatgccaaatcaagaactgaaacaccgcaagagcctgttattgacatattgcctcagctatatgatcttggttctactggaggcagaggcccttcagcagggatgtggtctcggacacttcggttaaggattacaggaagagatggagttcagaaaatcgatgctagaatacctgtaagaaccccctccacatctacttggtagttgcattgaagcatttaatttacatcgaactgacctatatcattgatgttggttatacgcattttgttattattactgcaatagcctcttggtccttgtgttcccgtatattttctataatctagtttttgccaaactgattgaaaggttgcttttgtttatccccattatctacaacaggctggattcttagaaggcatgacaaaagttattccaggtctgtacttcttttcttaagagcagcatgcaccataagtaccacctccatcttcatgtgatcattccctgggttttgcaggtttggctggagctaatatcatggaaaggcttcgaaatgcacctattgattcagaaaacccccagaacggtcagatactgcttgattttgaggatgctatgggagataggatccaggtgtttattgagtgagcatgcctgttttccatttgctggcgcactgcaaaatccaaatgcatggaccttcaaagcggcaccagacttcttgttgttgtgaaaaccagtgaactagtaaaatccaacattgatcatatgacctgaagtcatgaactaatggtttcctagtccctcgatgctacacccaaataatcaatctagatgtgtgcgtagctgcacattgcaataccatgcagagtatttgcccgggattagtctggtagcctttgcttgcccccaaaatcctgaagtcaaatttcgaataaaaagcattctcaggaggtttgaaatgtttgcatgcttctatctgctgatatttacatttttgaagcagtgaacagctcatgcgttgtgatgtacccaggttttattctctacaatccggtatgcgacagttcacaatatgacactagcagtgcaaggattactacaagtctacaacttcacaacactatactatacagtgtccaatggttacacctttgccctttggttaccctacgctagcttctgctgccatgctatatcgaagagacccagcaatgcttcctccctgctctccgccgtgcgggccatggcgaaggtctcctcttcttccctctcgctgcctcctctctcctggtcctcatccttcacgatctccgtgctgtccttcatggcatctgtgatctctgcagctggcgtctccacccgctgtacatcctccacgccgcattcttggccacctgatgcgtcgccgcgtttcgccggagtcgccgcctctccttcgccgtcgacgggagccttgtcgccatgcacggtgttgccaccgccgccgccgtcgtccgccgtgacgacctccaagctctcgagttccttccgagccacgtcgtcggaatgcctccgcgcctcttcctccattgctgatcggtgcaacgacgcggcttccttctcgtcgcaccagatgtccctaaagacggcgccgccgacgccgtcgtcatcgtcctcgtgggctcggtagcggcggcaacgcttggggagaacgaacagccccgcggcgccggcgaggagggcctcgagggcgtcgatcgcgccgtcgagcctggcgggcagggactcgacgaggaggacgaggtcgtcggcgcccctgccgaggacgcgctcggcggccgggaagagcaccgcggcgacgtcctggacgacgaggagctgcctgtccgcgaaggcgagcgccgagaggcacctcagccgcagcgggctcagcaccggggccgccgcgcgggaggcgcccctggccacgcaccccaccgggcaccgcatcgcctccacgcgccggtacgccccgcgcgccatggccaggatggactcgccgcagctgcgcagcagccgcgccctcggcgtctgcatcggcggtatcctcttggtcgtgccttccaaatcctgcaaatcataggcatagcacgcggtattagcagcaatcttaaagtttggagtagattaaccggacgagagaaaccaaagcgtaaaaatcggtgcttatttatctcaccataacgacatgcatctccgacacggcctgattttccatctcacagacgacgacgtcgacgacctgaaaccagcagaaatcagttcagagatgcatactggtcgtcaggatttggagcagggcgcgagaaattacggagctgagggaggcgagagaccgtggcggtgacctcgccgtggtcacccatggtgggttgtctgcagggtggggagtgggactactagcagtggctaggcttcatatttgtggttgtcgtcgtggctatatcctccttctgcaaggcctcgtgctgcagtccagctaagttagcagccgcaccaccgctcgggcttgtgacgagggcgccgcgccgtgtggcggaaggcacgcgcgcggcagtgacaaactgacaacgacgagggcggcgcggcctggcgggaatcgcgaccggtcagtcggtcgcggtttcatggcctcctctcactgacaggggggagccaaggcctccgccgctgagctaggttgtgttcttcctcttattttctcaacccacatctctcgttttccgtgcgcatgctttgatttataaaaactttctatataaaagttattttaaaaaatcaaattaattcattttttttaaaaaaagttaatacttaattaatcatgcaataatatgaacctcttctcctgaacacagcattaatatattaagaaataaaccaaaacagtatattaagaaataaaaaataatttataagcaaaagttttatatatttgtttgtaacgacttaaaagctaacgctaaaatgaaattatattaaaaaaaatttaaaaacaagttcaaaaatttaaattttatcttttgctttagtttattgggccaaccgacggggcttttacagtcctactcaaatctgaacagctcgagacagatgcaatgcaatgccagaatagattaaagtggactagttaagttatgctctcttcttcgtttttcttttagaactagttatgtcattttcgaatacttgttagtaatactaggtactcgtcttcaagctttaaccgttcggttatttgcagaaatataaatcaatacttaaaagtatgtcaagtgtgtttgcttaattaaatatagccatgaaaatcttacattatgatttaattgttaaaaactatcgatagttaaagttaaaattatttttgtctgaagctagagtgaccatttttactactacctgcgttcccaagcacactacagaaatttcaattccacgagaggacgggcctgttcactttgatgcgaaaaaaaaaacattaccaaaatttggcattatcaaaagcaggatttcttatatagttaccaaaatttggcagcaaactaaatgtagccacttttttagtaactttatcaaaatttggtaagattgaaaatagcatcaaagtgaacaggcccgacgacggtggtggtagtgacgacgagaggtgcagcggaagaaattgttggtatggccagtgatctcccaccatcgtcctggatgagatgctttgtaattgactgcaccgtgcttttgtcattgacatatgggtctagagattatcgagctcacatgttagtgataaagacatggtacagttaccgcagatcttaatcccatcgcccttatacgacacccttagacgacaggtcgacagcgacgagtttcccagccaccagatgacgacgatgagcgtgtccgacgataccgtctctccccggcaccacaacctcccctgctctccggggcgtcaactccaacgtactcaggaacccctccatcaccctcatgaacgtcgtcacgttcacggccaccgattgccctcactgcctccactctctccaggaagagcctaggcaaccatggccatgcccctcccctgcgcgccgccgtcgcccaagaggcagagcatcagctgcaacagattaaacgaaatttgctcacggtcgatactgtgatgatggttaacttttgaaacggggacaaggaagcaggcccttcccggtcacaacgtgacaacaggtgaaccaagcaaaaaatatagcattgacagggcgaaattaacagcaatcgttaacatccaaccatttctctcaccaatcattaacagcaaaaattgtgatcaagcataagaggtatgtgacggatggtccggataatactcaaacttggaaacaagtacctggccttaatggcaaggataccaggccgagaagtataacgcctaacatccaacccgggaactcgaaccactcaagtcaaaccatacgagggaaaaagtgccatgttgccgataacctcatgcaagatcacacacaactgcaagctaaaaagatagctacgactgtaaattaggagataatggcgtcgcccagtgacagcgcagcaagttgactggtcggggtgttcgcattgtgctgctgggccacattgcggaggacatccatcgcctcagcaaccttggacttcagagcctctggagactcgagcagatgcaggacctccgtctgatccatctccagaagcattccggtgaccttggccgcatggttctgttccagaagctcaaccagtggatacaggctttcaccaagtatctagagagacaaacaaatatcagaaaagctgaggtgtacatgtttagcaagcagaatcaacaatgcatttcgatgaacgatacatgtttaaccaagccaaaacacaggatttctaatgctgattgggagctgggacttcgcagactcagactgtgaaacagtaaccggtaaccagtgggttggttggtacagacaattcacatttgaatcaagttttcaattttcctactagctctcttcgatcttttattttgttctcaacttcacatgagatatactggtaaatttactggtatggagacttgagcagatgcagatgcagaacatagattatggtaacaaaacgaataataaattaagcacacaactagtagagggatataatttggacataccgttctttgctgttctggattagcatttgcaagggcagaagtcagcgttccaattggagcaggtgacaaaccagcatctcgtactgggaagcctcccatatcatacgattgaatcataccaccagcaacccccggcattggtggaacatcaggcatgttatgcgcaggtgggtaacggtacacacgtcctcttggaagcatctgttaaaagaaccatggtaagacgtgtgtcgtcactgttcattcaattggtccacatgacaaggataagtggacaacccatccaatgatccaaaattcgagaggaaaggataaatggtagaattcatacatgaaaaagtggatatgggggttttctaagtactacaaaacgaatagctcgctgtttgaataaatatatccaccgacaaacttcccctcccctaccactgcttgggagctcagcacggtttcatgttctatttcactacccactgggggttctttttacctttccctcatggcactacttcgctatcagtcaccgtaaatcataaaaaacttggcacaacagtagaaggtacaatgttataaggatgtatattagcaaacctgttgctgaaatggctgagcagattgctgtccctgggcagaaccagcaccagaacgccggatacctggacgtggaccctgttgaccttgttggacaactggaacaaagtaatttggcatatgggcacccccaggcctcatgcctggaacaagctgttgctggaaaccaaatccaggctacatggaagaaaattggtaagaaattgatctactaaattgtccagaaaatacaacacattagatggaaaatttgaatcatttctatgagataatgatcagacagtagaatttcaaagtagatgccaaatgaacaagatatatgcaaaatgagtgcttgcagcagagacataacgcctagtacaatggtgttgatgaatgactaacctattgtgtcccaaaaacttgcatggcattgattaccatactcaaactcctgatatatgcccagcatcaacaaaaccaatattgaaaactaaatgcataaaagtattgtaggaattgatcaatgatatcacttcactcatgaagttgatgtaccaattgcaatgaccaaccaaccattagatatataataatgcagaatttcaacaacttgactgcagagggcagtgctagtctgttttataaacaaacaaaaacacattgattctctcttacagttaaagctagacggggaaaatgaatgcattgatatcgagcagtacctgtgggggcatgatagcaggtggagcttgtccgtagaagagttgctgcccaagaggagccataggagggtacatgggaagacgtggagccatggaaggtgtcatcggtacagggcgcacctgagaaaattgtgcctaaataacatggaacatgctaccgtcagcatttctttttcattatgaaatgatcagaaacaactcaacaagaagaatgagttattataaagcatttattaagaaactttgtcaaaacacagcagtaagaactatggtacagccgtacaacttaaatatatgttgtggactgcaggcaattgaagatacatttctgaggattcaactacagatctatggagcatgcattgtgagtcatccctgcatatcagtatttccctcaactattatacagaataatgagttctgaactgatgcttaaaagttcttcgccaaacccaatgacctacttcctccgtttcacaatgtaagtcattctaatatttcccacattcatattgatgttaatgaatgtagacatatatatctatctagattcattaacatcaatatgaatgtgggaaatgctagaatgacttacattgtgaaacggagggagtaaatatcaataatcataacttaattgcctagattatcaataaccataaacaattactgttgctcttgtaaacattgagttcatgatggtgcaaaacagaacagtaattcatgtggcatatcttattttcatatccataaatagtactaggaatagcagtttgggcatgcatgttgtcatgaattgaattattcaattacaaacactcagctgcttaaaggactacactatacctgcaacatcgccttcctgtcttctttacgttgtgcaaatgcgacatacaatggctttccagatatcattttgccattcatttcagttaactgtataaaaggaactatgtaagccacagtgatatacaatagctaatccaatattcaggaagtaaacttacagcttgagatgcttcctcacgagttgaaaatgcaacaaatccagaccctttgctaacaccatttgcatcacgcattatctgtcaaacaaatccagttagttataatcatatatcagtaagaaacaaaagtgaaggaaaaaaggtggatgacatgaatcaccttgcatgaagtaattttgccatagttagagaacaattcacaaagctggtcatccccaatgctatcatccaaattcttcatgtataagttcagtccttgatatttgtcagcagcatctttcatgctttgctcaaatcttctcttcaattcaatctctctttctgacttcttctgagctcttccaacataccattctttgtcattaattttctttccattaagttcctcaacagcacgagcagcatcatctgggctcttaaaattgatgaaaccaaagcaccttgatttaccatccatgccaaccatgataacagcacttgtgatgttcccataggcaccaaaaattttgactagatcctcctttgtggtggactcagacaaatttttcacaaaaacattgttaaactttgtcttgtcaacagaattctctctctcttgcttgcggagaaaaggtccaacataaacaggcttatcattgatcagcatcccatttagactttttattgcagattgggcagcctctcccttgtcatactgaacaaaaccaaagcctttggattggcccatttcatctgtggcaaccttacaggagagaatgttaccaaatgcagaaaaggtatcatggagagttttgtggtctattgctttgtcaaggttctgaaaaaggcagttgaattgtttgcattagagataaccaataaaagatgattgttttagcgtgacaatacacactaacaaatgagtaaatgacctagtaccttgatgaaaatgttagcagatccacttctgcgactgcttgggtcacggtttgagtacattacccgaatgggtttgccattcagaggagcaaagttgagcagctccagtgctcttgcagctgtcaaatggaacagcttatcagttcagaagcccaatttacattaaaatcattaagggaattagaccagtagcataactgcaaaagacaatgataacaacatggtggaggacatatttaagccagaacaattgcattattgaaaagcattccaaatttgtccattaaatgccatgtgcaacattcacataaaggatgcagagcacctagtgcaactctctaagatggatattctgattgcccaaatttaagtctctattgaggacagttctacattcctatggaaaccatccaacagataatgactaattaacaatagttcaataacagccagcagccatctatataggacatcacaacagatatatgctataaattcccagaaatcagcatgccataaattatttcagtgttcggcacactcatgctcctatagcctaaaaaaaatccacaaatcagaccatcaattcaatgtaagacattatgtcttatctacagacaggtccaatgcatacacaagtacgtcatggtgtataaggtagccacatagtgtggtgggtgtccaaggttggctagacgtaatgttggtgggatttttttggactgatgcgtgattgcatgctacttatttaccaacaaaagtggtagagcaattacagttgagatagatacagccaagtgaaaatcacttaaatgatcagtatcaatctacccagaaaatttcctcctcctcgatcatggagaaagagtagttcgttgaccacaacctcatttctgatccatacatgttatagtggatattgtaatttaaaaggtggcaacccaatgagttgcattaccttttacttcttatgttcaaaaggataatcaactacaatcatgttgataaacttgaagagccacaagtagggaaaggatcaatccaagcaacaacacgaggacaccaacttgaattaaccccacaaaaccacaccatgccgatgatttttccccgattaaccagtgttcacctactagtgaggcggtcaactagactgggacatgttgcgggcgacgagattattcgctggctaggcagccatcccagcgaacgcagctaatatcccactttcattaaggacaaactacagagttcaaccatcgcatcgatgatttagcgggctattaagctaccattatggagaatcaataaaatttcctttctaggaatagctagcgcgcgccataatccgcaatattcagacacattaaatgcaaacagcaatgcaccatagtaaaggcctcatgtgagtcaactacgtaaacatcgaccgattgcttcactatatacctagaatcctagatatcacacacaaaactcaacacccacccatgttcaccagttaacagatagcaccggatcaaagattgggtccctgacacatggttccacaattcaacaatatagaatccccaatcaatccgtgcagccgaaatgtgaaaatagcgatcaatccgtgcagtccgcgcagcagaaatggaatagggccatagggggggcgatgaggagaggagatcgcgatataccatccacggggttgttgaagttgacgtaggcgtagccgagcgagcggcgcgagctgatgtccctgcagacgcgcaccgacatcacctgccccgcctggctgaagagctcgtacagctgcgagtccgtgaccgacgcctccaggtcgcccacgtaca

SEQ ID NO: 89154 - DNA, 1464 bp, Oryza sativa
tcctgcagcccttaatttcattgtgttcttttttttatgagtcttaaactttaatgacaaaagagcatgtctttggaccaaagtagggatggcaatttgcccaaggatttgggtatccgtgaatacctggcctaatgaggatgggcgtaggtgtaacttttgtccaagacccgaagacgtggtaggcaacaactgggtttcattgctagtatttggacattttgtggacttttggatgaccaacagcagaattgatgcttttgattataatgtggtggtgatggtaagtgttattcatcctgaataactaatttactttaaaatctctcgcactccatctgaaaaaaaatggaagtactgtttcacctatcctatcctgttttacatgccttccagctgaaatacttaaatacttttaaatatagaagtgaaatatggggaacctatatatttcttagacccaaatgcaagaaaaatataaatttcagtagtgaatgcttaaattatgcatcctattacctcacagaaatcaaattgtcacctaaaattgtatgaagctaaaattcctaatttcaaaaggtcagcatggatggctcttaaccatgtaaacagtcaaggttgtggaagcaagcaatgtgatctgttcagcagcagttgttttacgcttagcataaatattttcactgttttacatagttgggaacttcgaacttgggataagccagtaaatatgcattagaagattcacagccgtctcatttcaagttctgggacacatgaagactatccttgtgctaagacatgaattttcaagttgcgcttgggatggtcatagctgtagtaggaatgatctggtatgggcacgcatcttcaagacttggacgcaaagagcgccaatcttctttttttttttgaaataacaccgggggaaagagattccccacctgaattatattgagtaaaaaggaaggttatatcacatagagattacataattagagagaacgaatagaggaagagagaagatttttccaatcggtaactaccgatctgtcttccctgcgaagacgctcagcccacagagtagcatcttcaatacatttgacaactaacctagtctgagaattgggaagaccccggaacacaacatcatgtctatgattccaaagcccctaaaaacaaagcaggaagaaaattctgaagtgtttggcaggcaaatgacaggggacggcaaggtcagcaagatcatgtacatccgaaacgacagatatgcgtaaggctcgccaaaagtcttgggcaaattgacaatgaaggaagagatgactcgccgtctcaatacctcggttgcagacaatacacccagctgtctgaataatgttcttcttaagtaagttagctttggtaggaagacgatccttagcaataagccaagcgaagaattgaatgcggggggggggggggggg

SEQ ID NO: 89155 - DNA, 9104 bp, Oryza sativa
ttctggcgagcggcggagccagcggccagtgtatgaacctgtgggagcaacaccgtttctgaccggtttactatactaggaatttgtttggtgtcacccgaagtacgactatattaaggtctgtttataaaacccttatcaaattttggcatgtcaaaattttaatatagctgtcaaaattttgttaattaaatatagccactttttttttataactttaccaaaacttaataagattaaaaatagcatcaaagtaaacagtctcttaatctgaagttgttgcgggggagggatcctctctttactctcttttagtacgtgcttgacctaatcctaaacaaaagaaacgggcccgatcaggtcaggtctacctcaacctcaaccggacaattgccgtgtggttgcccaaaatgggtggtctatcgcgtgacgtgccgaattacatcgtgttttgtattcggtgcaggtgtcgatttcgcgtggagagacccacaaagagctgacgaagagaaacgaaaacttgcagcaaccattgttttgttggggagaagaaaaaacccaaccaaacaaacgcattgatgacgtccacccaaaaaccacaaaaaaacgtacggctctagctacagtagcgtaatgctcgcacattgaaacagtaataatcccttgctgttgctgaagactgtgtacatcgtacatccagcatgcgtctacgctactgctcagctgtaccgacgcggatggcagttgcatccccattatttgccgggaccggtgcgcaccgggtcggaatccacgtcggtcagcgcctcagcgggcgcggcggcaacaaacagcgcgaacgctccacgacgcccgcctttgctggagaagagggaaattcggagcagtttgttgccggtgagcctgcagaattcgcgcgcgcgtacactatttctgcagcttgcggctgaattttaacagggacatcgcatcgtgatcaccacgatatccacatccactgttccgttctatagcatcgttccgtgcaactacttgaggttgatgttttcagaatcttcagacaagcaccacaagcctgcatcagcctttcggtccatttttacagactacacaagttaaagaagttgcccggaaacattagcttcggtccagaaattcagtccatgcaatggtgtagtctttatcttgctttacagctcaggcatacacacaggtgtatgtacgcagaagcgtagtaatcagtggagtcaaatctagctaggaagatttcgctttgcagttaactacgctctctttctgctaagtggtgcagctttgctgaaaagacgagcttcccatacgtagtggggcgcactactgcagaacaacaagaagaagagaaatggcgcaggacgatgtgaaatgatgaagtgattatcataatcatgtaagacaaggatgttgcttgttaaatactcgtggcctgctctgaaaagaggaggattctggataagaaaaggagcagccattggttgctttcagcacaatactcagcttatcctgtcaaagaacaaccaacactcgagtaatcattcaccattaactttcagtgaatcctacctacaagctttctgaatcgcctttagcggctctgcactcattagctaaaattgcaaaattactggaataaagaccaaagcagttcatgttcatgttcatcctgcctcatgagtcatgaataaagttacttcgttctacttttattgtcagatttccatttgatgagtaatgagccttcagatgcaaaattgccgagctggagccctggaaggtggcgcgtctgtatcaaggagccaattttgtctcttttttggagtgggatacatcaagaactactttttatacaacttcttttgtgcaattgattgatcgatcaacagtaatacagaggagatagtaagatacagtggtttctgtaagtctattataatctcatccccatttcgtcttgtctgttgggacatgggactgtatcacagtacagtcatgacaatcgcaccgccgtgaactaactgcctttcgacatgctaattatcagttcgcaactgtattattgtaattattgctgcagtctgccgaaacatttcactcaaagaatcgagattccgaaggaacccggttcttttctttcttcagccgaggtggtcaggtgggtgtgttagctatacctggtttccaactggaaccatccacacgaaaaacggagcggtccattagcgcgtgattaattaaatactctattagctatttttttctcaaaaatggattaatttgattttataaagcaacttttgtatataaaatttttgcaaaaaaacgcaccgtttagcggtttgaaaagcgtgcgcgcggaaaacaaaggagatgggttaggaaaaggggcatccgaacacaagtatagccaactactagctctaattcatctatagccaatctaatagcttattcacataatagtacctataagcatatactacaccattaatatatggtcccacctctcatatacacacaacgtattggagtccacgcggtagctggttacaaatctgtattccgctttccttctatattttcttctctcctccacatgtgcttacagctaacttgtagtctgctattgtactcgctctaagggtgtgatgatgtcacggaaactgaggattcgttgggtttaaccgtttagagcaagtataatagtgagctataagcttactgtaaacttatgtggaggagagaggtaacaaaaaatcaaggggtggctctcatgtaagagctagcttaacacaatatctaagacaaatacattaaatgtataagtgagagatagcgagaggagaagaaaattatagccaaacttatagctaattttattatatatgttggcttaaaatgagttaatagtagaagttgagttatactattgtccttgctcttaagcgtcgacggaaggttgatcgattggtgggaatttgggtggtcaatcaccgcatcccatgagatcgttctccaactgatcgaatcgcaaggagttaccggtacttctcgcatagctatttgctgctacgcagtctgcaaagtaacagcaaaatcttcacgggaacaatgaccgaggataaaaggaagtgggctttctgggatggaaacaaaggtttcattccaggatagtacggtataactctggatttcaggattggttttataattctgacttccagtgttgaccttttttcttcagaacgattggtttccatttagatgaacaaggcttcacgtacgattcatccagtgttaggaagggcctgcgaattcggcatgttttctacagttaagatgggctgccaaagtccaacaaccttaaggctcactgggatcagctaattacagtaattgctctaactgtttaattaaacctaacatgtttgaacagtgatattcatgaaacttatttagtagtaaaaaaatatagtacttcatccactcaaaatataacaacttttaatctttaaaatttgtatcaagtataactacatattcatccacattctatttttaactgatcacaacaccattcaaatttccacatacctcatctttctaatcaatcacaacattcttctatttaattctaccaacttacttagcaatcgtgtataattttaaaacttcttatgttttttggacgaagataatactccccgttataaaatctgagctaatataccacgggatcccgtctaaatgggatgataccgatcaagtatcagattgatctgatacccgtaggtaccagtcaccaacctatacctcgttagtattagctaatgcctgctgggaccacgtacctggtcgatacccgatggtactaggcgtggtacctatcagtactagacctggtacctattgagtatcagaccagagcttagaggggaagagaataagggatgaagatggttatatgtgttggttctctcacctggagatgatgacgccaagctcgatcaatgccaaatccaatagccgaggatcttggggtttcaaatttgtcgaacatgagcaacaagaaggacacttcctcccctatcctcccttgcacttggcggcaatggtggtcggtggtggtcttactcgacaacaatggcatcgacactgcctcatcctctatcaacggtgatggaggcggaagctccatgtcttccatcaatgcaatgatggcgcttcccatctccttcggctacgacttcctttgtcctcgcagcgtaagtccacctaattttattgtggtcctacggcacaccctagccgatatgggactgttttagtgcttacctgcatcttgccctccgacttgttgctccgcgttgatccttcttccccgccgtgtcggtccaagtcttctccgctgggcataggtgccggagaggggatctcgccccggatggtagggattgggtgacggtatcttgtattttctaacatgggttatttttctttagtgacaattttgttctttcccctactctaacaccacaaaatcttccccttgagttgtgattcttactatgaacatactacgtccaaaccgagataaatatacacgtctaacagaatatctaaaccgagagaaatcagaaattagaaagagaattcacatcaacattgacacgggtggttttcgcgctgcaccaatcacgaagcacccaagcacgaatctcggagcgccgatgcctcaacgcatctgagaaaccgttccaagctcgccgccgacgacccggccggaccctcccacgccgccgccatcgcgcgcgcgatctcccccgccttcctcctcatcgcctcgcccttctccgtctcccccatcaccgcccccacggcctcggccacctccccactctccaccgccgagctctccaggttcccgcgcgccacctccacgcacaccccccactccaccaccaccatcgcgttgaagaactgctcggcccccaccggccacccgagcagcggcacgccgtggcggaggctctcgaggatggagttccacccgcagtgggtcaggaacgcgcccgtggacgggtgcgccaggatccgcgcctgcggcgcccacccgcgcaccaccagccccctgcctgcgcgcgccatccggtcctcgaatccggcggggagccacccgggatcgaatccgtccttggggtcgaaccccaccggcggccggacggcccagacgaacggccgcccgctcgcctccagccccagcgccagctccgccatctgacggatgctgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggcgtccaggggtccgccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccgcccatgaagaactctgcggctctaccggtaattcttcgttgttctgaaggatatgctgagagacactggatgtacagaatggcatttgtatgagtcagttttatttatctccctagaaatatgacataaagaatgaatgcaaactcccaaaaaattcctacataagtaaacagagagagggagcaaaagggcattgccctgactagaacatatataaatacatcataagttatccttctttgaagaatgatcagaagcaggcgaggatgaagagctcatcctggccctatctctagactcacttaacataactacaacattccgcatcggtggtctgtcatatggagacatactagtacatagcaatgcaattttcaagacctcaatcatatgatcgacagacgttttgtcttccaaattcagattcttatcaagaatccctggacccaaagaattgtccctgatgtaattctttacccatgttaccagatcacctcccagttctaatggttgtacaggggcacgtccggttagcagctccagcagtacgacgccgtaactgtatatgtcacttttttcagtaaccttcatggtgtatgcatattctgatcaaaggagaactaggttagtactttgtaggaaacaatcacatgtactttctgctagtataaagcaatcaagtggtatagtagcctaggattttacaagcaatttcaagtaaaagagataagagctataacaggaataagtatgcaaagtaacagtagaagactcaccaggtgctatatatccatatgaaccagcaattgcagacattgattttgagtatggcatgtctatcacctttgccaatccaaagtcaccaacatgagcttcaaagttctcatcaagtaaaatgttatttgattttatatcacggtggatgatgcgaggtttgcaatcgtgatgcaagtaagatagcccttcagctgatcctagggctatcatgaagcgtgtctcccaatcaagtgaagacgaagattgcccatgaagtaactccccaaggcttcctcttggcatgtattcatacaacagaaggttggaaccctggtgatagatgaacccatataacttcacaatattacgatgccttatctttcctagagtaaggatctctgcacgaaaactattgtctgtgttgcttccctctctgttagaagccagcttctttacagcaattgtctgtccagctttcaagatggctctgtacactgttccacatgcacctcttccaataacacaactctcgtcaaaattatttgtggcagaaaccaattcctgaaatgtatatgcatccttggtagaaacctgcatgttagacccagcagaaaatatttgcttgtcttgcaaaggagctactgtttctagtggttttctcatatgatacacaattataacgataagaataagtgaaattcctccaataacagcagcaacaattgctatgaccttgcccaaaggggggctgcctgaattggatgactgggaagaagatattgactcagacccacatttgccaagttgtccgccacatagtcctttgtttccaagaaagctggttgacgccatgttatcaaaaagtggtatagtggggagagcgccggtgagattattgtaggagacattgaactcaagcaaactagacagatttgcaaaggtatctgggatttcacctgtcagcttgttattattgagaaacaaattttccaataatgcaagattaccaagctctgatggtatgttgccagagagattgttataactcaaattcatggcgatctgcaaacttgagagtagtccaagctccttcggtattccaccagagaattgattgccaccaatctgtagagctgtcaaatgtgaaagtttaccaagaataggtggtatctctccagagagcctattgtcagcaaatgatagcagctccagctgaggcaggctgccaacttcatttggcaatgaaccttcgaagctattttggctgagatctaggcgttgcaacatagtgcaattgaaaatttctaatggtatgcttccgcctagtctattggatgatatattgaagacgacgagctttgacagattacctatttcttgaggcaactctgatgtgaaatagttatttgttaggtcaagcctttggagagacttgcaattgcctatctgaggaggaataggaccattgaacttgtttcgacccagctcaattgttgtcaaattcaccagattgcagagatcagttggg

SEQ ID NO: 89156 - DNA, 1605 bp, Oryza sativa
tccatgcagcaacaatcccctagcatgagccaacgaggctccttgcggcaatgcctcagtcatccttgcccttacacccctaggcatgcctacaccgaatctaggggtcaccactggagacccctgtcgctaccgccgtcctaactcgctgcacagttttttcaatagcttattctagtggaggcgaggcaaagaaggaggtgggtgtctcgatgatggctagggtttgccccacctagaccactcaatgcaatggacgacgcagaggttttctagctaataaagtatcgatggcctttaatatcggttttattttaactagtaatatcttttaaataatcaaattatttagcatctctagattaacttgtaatagaaagtactttactaatatactacattcaaatccattcgctttgacatcgcttaaaaattataataattactgttcatatactacttttgattaaaatcaataagtactccaaacggcttagtaagtccaactagaaaagcatgccctttgcccgtcttttgtacctgcctaaacgaagaaataaatgggaaagctctttatacctaactagcagacatttaatgatccgaatttatcaaatcagccaattgggatatgaatacgatgaacatgtactgtagtacaacttacaagcttgatcttagtttgaaaaaaataaagttttactcatatctctctctctcttaaaacagaggaatttccaattacaaacctatgtcactctttataagttacggatacaatacatgtactcagtactcatatttacattcgatgcgatttcgccaaaccgaaaatttccaaagcaaataagtaagaaacttatatttgcatttcctttggtgaaaccaaatttacagccgctttcgtgctgtgcttttccagatcttctgtaaatgctgtaatttccattccacgtcagcagccaaagccagagtagatagaatccatcaccagtgaccgctgatgacgtcatcattgaccaagtcaacctaccaactactcccacctcctcctcctcctcactggctcactccttccttccgttgaccgccgttgactcctcctcctcctccggcggcggcggccgccgccgctggtccaccggcaaccggccgtcacctccctctccggcgacggcgccgtcgccgtcgcggaacctcgcgtagatgtcccccttgtagaatctccacgtcctccagaccagcacgagcgagacgagcgcgccgaacacggtggcagccgtgatgatgaggaaggacttcttgaagcagtcgacgccgaggcacaccttgtcgcggccggcgccggcggcgaggccggcgccgggctgcctgcccgcctccgcgtcgtagagcctcccggcgacgaggacgttgaggatgtaggagccgacggggctcgccatgccgccgaagttgtagagcgtggagtagtacttgaggccgaacacctcggagatgatggcgaacacgagcggccactgcgcgccaaagcagaagccgatgatgacggaggcggcgtagagcgcgcgcgggacgccgagcgcgatgaggaggtggccggcg

SEQ ID NO: 89157 - DNA, 9979 bp, Oryza sativa
tcacacaccttcttcaatcattctcacctaatttcttaatatccgtgccaacctctacggaggaagtactaccattttcctggatgatgctgtggtagttagagtattgactaatgactactctgcatgacttgaatcataagcgtctttgcagtattattgcagcatctggctttaagactatatggtctccaggtctctgttatcctagttataaaattattgctgatctttttgtcttattcttctcttaaactggttggactgccaccaaacaaagcttttactggtacaggagtagcctttgctgacttaagagttcaggaattgtcatgcctgtctctgctgcatttccacattgtatcctttttattaaattaattaattttcagtaaaattggtgagtgtgagcctgacattgacgtagtgctatgcatcagtagttcgtcatatttgtgatttatgattgtgaataaggagatacagaggatatttgtgattttttttaaataacaattatgacaattaatatgccgaattttcacttggaaacttttgcagaggaacagaatatatcatctgaaaaattgatatagtccaatctaagaatgactaattgggtgaggccaaatggagcaacgtatgttagtactccctccggttccataattttgatgttttaaataaggtttggttaaacaattagagctttatttaaaatattcagtttaaaaatattacaacccgatgtatagattagtcttttaaaatatattttgataaaatcaaatagttacttatttttttgtatatattataacagaaaatcgtagtcaaatatatgttttagaaaatcattgtcatatccaaaacgtcactttgtagtttgtactactcatccatctgttgactctgccatgccatttggttgaatttctacctgacagagaataaggcatgctttagaatataggatttccacataaatttgtagaaatttcataggaatcaaactataggaatcggtaaaaaaaattcccatgctacaaagggggcctaagttgaaggttgctaatatccttgagagctataaagagtttttccatcttcacctcaactgtctagctagtgtcttaaattcttagctaaatactagtactacactgcacaggtggagcaaacggcatacttttaccatttgaagtgctagcagagcatccaaattcaatatttgtaagtcacggcaacctcaaatattgtttgcctgaagaatacatataggccctgtttagttccaaagttttttttttcccaaacttccaacttttcatcacatcaaacctttcacacacacataacttttcagtcacatcgtctccaatttcaaccaaatttcaaactttgggccgaactaaacacagccataataagacgcttatgctaaataccgacgagtccttgtcatcgtcgtcatcgtcttcaccgtttgttttttactcaaatacgtaatgatcttcttgatttgttcgtgtgatagagagaacgcaacatgtctaattgacaatgctgcaagagatcttttcaactatgaattatctgaattttccaaaagaaaaatgtacatgtacacaatcatttgcatgaaaaaagaatatccactcatccatagcaagtccaagccgtatgtgtaagtgtcaaaaacaaattgtatcaatagaccttatcatcttgtctaatctgagtggtttctttagggtctttgagtcgtgtattcagtctcaaaataaattaaagctattgtgcatgtttgacacaaagggtatcttagattctcataaaaacaaatttgccaagaagaaaaattctgatttgttcgattttctctgcagcctatgcttagtacagccatttcttagtcaaggaggttaacttgaccagaaccagaaggtcccgtttgttggctcatgtaaatatataattatttgttttaaaaaataagtatactattaaagataaaactaaggttggacagtgcatatcccaggttcccaatagttcagtattagctgctcttatccaacaaatccttaagctggacacaacataaaggttctagaatgcttgcaagataagataactgtactttcattgaccactaaaatgtttgaacactagatatgacggccaaatctgaaattccccaggttacgtgtgtactagcttgattcagactaagaaggtgactgccactaatcataaaaacttttcatgtctaagtctgatagtattcccttttctctattttcatattgttcgtatcagaggatgatgcctagtattccttccgtcctaaaataaattaatttttacatgttcatatttgtgtataaaaattggtttactttgggatggaagagtgcatactacaagtatgcaacccaccgatcttacatgaaaaaaagaaagtatgcaggtgcaataaccacgatttgttattttacgacaatacagttagataaaagtagcttccaagtttaatagaatattctgtttcacttccatatacggattcctatttgatctgtttgcgcaaaattagcataatagagtgccttttgaaaatccacccaaatacaaaccaacctttgcaagaactcacctgcagatgcaagtaaagggcatttagggttgttcagattataaccaaaataaaccttatcagattttagtactttagtaatattaccaaaattttgacataatttcttatatatttaccaaagtttggtaaaaataaataaatagatacatatatttaacaactaaaaaatggtatggtttaaaataatatcgatctgaacatgcccttaaatattactgcaagtcatgcgacaaccagtttccagtcaacctcatccatgaattgtattggtataaatctgtaggtgagttctatgcttgtaagtgatgctgcctgacatgagcatctctccggcctatcctgaccagaaaaaaaaaatctccaatcaaccgaccagagagaaaattacacgtacaagcaacagtccaacaagaacaacacgaatctcacggcactcaggcatggaagagatgctgcaatcatcagaactttttgtacagtaaagccacgcatgatcttctgttctagcttctagagacagcatccatttcatggcatgccatggacattacctggacaagacaaacaaaagatataacgcactttgatcttcagtggaagatacagacaagtacaaagatgacagccacttggcaacttaactactactattcaagaagcaagaatatgctgcaccatcggatcgtctcgagatttgtactaaaagaagaaagaaggaagagctactctcctccttgattgaacatttgaaccttccaccacaatacatgtcttagttcttcactcaaaccttccaaagaagagacaaaatggagtggcagttccatgatggaaaggaacagtacaatgtgtcctaactcatcaagaacttctcgagtctaaaattgattgatacttagtatttcagaattgcactgtacatataaacatttcctttggttctttctggagaggagtgatccaagaattgacaagggaaaaacttaacttagaagtgaaatatgttgaccccctcttgtggcagacaatcttaaacatgattatgcatgtgatatttcacatcctggcacacaaatccccccttgcgttatatgaggggtgagagaggttcggttgtctgttgtgtggagattcctcatcatgggtccaaccaaacgaccacgcgttcagatttgcagttgaggcatgtcataacctttattttgtcctcgatacggaattattattctgtcctccatgaggaaaaagaggggaaagagagatagataagtggggcccacatgtcagtagtaatgatcaagccacatcagcatccatgttgatgttggtgtgccacatcagattttagacctctagtggttaataagttcaagtgttctaaaaatgtattgtcaatgtttatatagacctctagggatggcaacgggacggggcgggggcgggttaggctggaacggccccgaccccgacccccgaactctccacccggccccggccccgagtggacatgcgggtgtaaaccagcccccggccccagcccctgcggggccccgcaatccgatcggggcccgcagtgagtagcaactccatcaaatgagcacaaaatgtataagacaatcgtcaatttagcaaatgaaaaatatggtacataatagacacaccatcaaaaataacatgaatacttgaatagcatcataaaaagttcagcaaaaacacatattgaactattcacatggctatgctatgctgttgctgccagccaagcaaacacacgacacacacacatgagttcaagcaatcaagccttcaaggttcaacacatcacatccaagcaagcaaaagtctcctgtccggttgtgaggttgtcccctcgccggccccacacttgtcccctcgcgcagtcgcgctcgcgactcgccacaggcagccggacgccgcgcttgtgcgccgcaccctcaccggccgccgccgcccttgccgctcgaccgcgcagccagaaaggagagccagagggacagccggagagatggaggggagaggaggggagaggggcagagggcgatcggcgacggcaagatccagaagttcactgtgcggcgtgcgccctggcgccgcctctgccgatgcagactggagcggtggagcggctggaggggagatgccgagatgagatggggagctagaggctaaggtttgtttttatccctcagtattttgttgggtcacccgcgggtgaacttttccccccggcctctaaccgcaaaaatacggggccccggccccgcctcacccgtgggtcagaaactgtacccgcccccgtagtacggggcgggtccccgcacgggggaaattgccatccctaacctctaatagtgtgttctctctctagaggtacccgtgcataaattcaagccggaccgctatacattttactcgaaacaaaatcagaactaaaaaaacatcctgcaattaacaactgccagcggcttaattaaagctgagttcacatgtacttgtactcacatcccaacccacatatacagaagtagaacacactgataaattcagttattgactaccaaagagaagggggtaaataagcacgtggataaatcccactgcaaggtacaatagacttaaaaatgccactgaaagtctcattggaagtcgatggcattttcataactaccatcagaccaccaattacagtggcattttactgatttacctagataaatactgacgtggtcagatcggcgaacaagtaaaatggtacaacatgaattaggcttggaaaaaaccctttcattatgaaataaaacaacacccaaatgcttgattgcttgaaagataattcaccaggggttctggtcctcaggaactggaggagactccttcatgacactccatggcttggctggctgatgctgccccattggaaagttccagaaggaatcggagcgctcgtagaacatatagaacaggatggctgacactaggaaaagagataagagtatgagccagacttgccattctgcagaagaataacacaaaaagatttcgttagtatggtaaattataccacaggagagccaagaagcattttatgagacatgtacctttccagtcagcagggacattcagctttgtcagctctgctccccattgatgcgatgtggagattacggccctgcggtatcagcaggcatcatgttataacataaacaaagagatgctccggaaattggagaaggacaggtcatttagttttaagagaaacatttcttgcatgaataaatgaaatgcataagggccatccctaccaaacccagcaggaggaagatgttatcttgcaatcttttccaggctaaactaaagcaaatttagtaaaagatgaacattcagactcacatcccacttaagacattatgcagtgcagcctgcaggcatacacagacaattacaatctatgaagcattgatttataacttataagcatggcatttgatagtctgaccatggttgttaaggcggtaaggcgacctgaggcgacccacccacgccttacgctatagcggtaatgcgctaaggcgtggcgacgccttaatctacgtgattagcagcgatcagaagagggagagagaaaattagcctagcaggccagcccacaaaagcccaataaccttcataccagcccatggtcaaggaaacaaccctaatacccacaccaggtgcgtctctcctctcacagcgccgcctccgatgtcgcttcttcctcacgcctgtgcatcgcttcttcctcgcgccagttcttcttcctcgtgctagctctgctcttctatatgtgctcctttctcccctgatctttttcctcgtgctagctctgctcctctatatgtgctcctttctcccctcattcagaacgaatccagctatgcttctcttcccttggatagatctggcgctgctcccttagtcaaaatgaatctggcacaggagagagaggaagagagtggaaaccagagctgaggagtaagatggcaatgacatggagcagagaacagtgaaaaggggtagttgctgctgccttcacctctctctttctctctctctgggttatggcgttaagcccttaaggcggagggacgccttaacccctcggcacgccctagtgctatagcgacgccatagcgacgccttaacaaccatgagtctgacattatggcgcctacatgccagtgaacactaagctactaccttactagaaatcagtacaacagcagtgtacaacaaactagaaatccataagattcaagatgtgataaacatgccatctttacagagttccagtacctttcagtaggacaaaattcaattgaggaaaccggagaaccaagatggaccttcttgctccagtgagaaacatccatcttctttacatccacagcacagaaatcaccatcatggctccccctgaaagaagaaatacagaattcattcacatgtcggtgcactaaatacatcaaaagcaattcagtttagaatatgttagctagtattggggcactgcatatttattaggaaaaaaacattactccagctgatactgtcactattacaatttataatgttaatgtttttcgtccatttttttcagagctacgcaacatccttgtcaactagagtaattctttgttattatttatgtgacagttgtttcaagttgttgatatattacatgtcaatgtgagaatgtaacaaaaaaatgcaagcaagtttttgagctcttcaaaaaggacaaaatagtgaagttactaggagaaagtagcttatgttagtcttgaaatttggcattgtaaatgttcctagaaatgcaatggagttatatacttgttcagtatgataagatcaacagtatttatatgtacttacaaagccagatacttcccatccatgctaactgaaagtgtggagataggttttcccagaagtctcttgtatccaattcgactccagtcacttatgttccagacaacagttacaactttgttacctgttccaatgacaaagcacatatatagaaaaatcatctgatatgcataaatctatttctggaccacaatagaaagtataccttttgcaacggtgcaaaacaggaatggtttcatgccatccctagaaaagcggcaacattcaatcttctcatcctgcatagaaaaccagaacaccaaatggttaaggctttcagtatctcaacaagagaacatgacttgcacaaatttatcgcatcataccgcagatcgagtcaaattgaccaatggtaccccctcatctatcttccatattcttgcagaaccatcagtggatgtggaaactaaaaattctgaatctaagctacaagaggaaaagcagcagtattgcaaaagtcaattcacaataaagcacagggacgaaaaccaaaggttcaaagaatcgcttcggtctaaaaaagagtcttccaagaccaaaatgcttcattaaggtttggaccaacactactgctacgttatcaaagttcttggttactctctcaagataacggctacatgattgcgccatttacaacaacacttgttcaacagatgagaatatcctgggattcttttgcaaataataaaggaaaataattatgcttgcacttgccctaacctgatatccatgtcccggaaggacttatgagccttgggttcatctaagagcacattcatgctcggccaatgaaatattctgagatgcccatcctatagtggtaaaaataaaataaagcattgtaagaaccatagaaagatactttgtacaagttcagctagagagcagcattattatcaaactaaatacactgggcaataacaccagaccataaaaaactgaaccatctggaattctggatggaataatctgacagaatggtacaacagtggatattgtgcctaaaatcacatggcttctataatacacatatagtacttcttaacgatgtataaatgcagcatatggaaacacataatcaccaaatagaagcaaactagaaaatagagagagagagagagagagagagagagaactgatcagtaaaactccaatatcaacatatagcaatccgatacctcaccaccaatggcaaatttagatccatcagtgctaaaagcaagacacttctgcggtccaacggattcaagtggtggagcgtctcttgaaataagtcgaacagtgaactcttcaaaaatcagcttgaatagccttcagttcaaacatgtggtttaattataaagttctagtcttagtgaaagagaacagaaaaaagagaaagcaggttgtaacagtgcaaacagaaggctttgataaaatgataacacaatcagaactaaaaagtacaaaatggcatggaattatatatatatactgtgcatttataatttgattaacaagtcaacatgtgtgctattctaatgatcatttcattgaggtagttaaccctactaaagatcaacttcggtggccctttttattttaggttgcaacatccaagccaacccttctatagaaaacctgaagtgtaaagcctaattgaacgttactggaacagcaaatgatcaaatgaacacagaaagtcaattccgcactacaatctaaacataattagccacattgataacacagacctctacaatctgaagtctaaacagacggattcacactgctttctaaatcacctaatccagccaggcagccagcagcaaccaaaccagctcccgcatcacaattaaccaaattaccaccctcaaatcagctgaatcgaactaataatccgaaatctccgacactacacaggcattagctcaataatctaccggtagaacaccgaactcctaactaatcatatcacccctcccctccccgcctgagaaattcccgcaaatgatagaacagtcaacgagaagagaagcagtggaggcacgcacctgcaccccttggccgtggcgcagacgagctcgtcgccgctggggtgcaccgtgatgccacgcggcgcgtcgcccggctcctccccgagctccgccctcgcctgcagcacaaacaaacaaaccacacaaccacgaccccggaagtcaagccggcgaaccaaacctcgaattccttgggagctcggaggaggaggaggaggaggaggaggagaggggggagctcccgtacgtaccaggggttcggagagggagcactccttggagtcgaacccgagcacctccacggccggcggcgaccccggccggccgtacgccg

SEQ ID NO: 89158 - DNA, 2344 bp, Oryza sativa
aaaaaaatggattctaaatttttaacacaactgaaaatgttcagggcccaaaacatcggcataatatatgaatgacgattgacattactttagtatgaataaaagagaaataaagaaaataagaggaacttgattcaaagaggttgagtacagtagagtctgacctgtcaccacagcactatgacggcctccacaggcaattgctttcacgcaagttgctgctctatcatttgttccttccaaagttctgctacccatcacaattcctgtacggtccttgctgtagaacgccgattgaacacaaggtatgggatgtggggaggaaactgtccggatcctagagcctaaacctagttgtccttccccaccatagccccaaccccagacctgaccaaaatctgaagctttggagaaaatatttcgctgatcagcatgcttacctaacctagttgagtgtgaagagaatacagcagtaaacgcccaatataagttacctgacagcactaatgtatgacggccacctgcagctacttccactatcttcactcctgtattaaatgtcacaacacaaggtggtgctgaaagattttcatcactagatgattcactttcagccccgtgtttcgatgaagataacctccgtcgctttgtgctatcctcagaacttcggctttcagcaggaccagatgctgccttggtgcttgtcctagacacctttgacctggggctcactgtaatcgagtttcctatattacctctgtaaacaacggatgtagaaaagcttatattttttatgtagaactgtaaagaaataagtagtaagcaccaccaccttggtcagtggcaaccccactttgccttttatcacaatccatagccccagttgcagaatggtctgcaatgacccttccagttggaacgcattctttccaaccccatgtgtagacatcacctttacctgcttgagtggaattcaatcagtgtaatgcaaagttatgtgcagttttcactaaaatgcatggatcaatacacaacctgttattgcaacacaatgtgcccatccagcgtcagcccttacaattgcaatatcactaggaagaggaaatgcctccggagtttcctgagaggaacaagatgtttacttcagtaacagtttataagtttatcaagaacacgttggaaacaaacaattagcccaaaggtacagagatacctcatgcttcccagcagtcacgtaactttgtcccatatcatcggtagagccccaagtgaagagttttccttgctctgcatcaggcagatacaagctgtgtcagtgtcaagctcagttgacgtacggagtaaaacgctaatagcacacaatccgaccaagcaaaaatgcaatcttctaatggttgacagaactacctaaaaacatagaataatccttggagtaatggagttgttatggaaaattagtctaactaaaagcaattccacaaaaatacactagctgacaatatcacataacacattcccacaacacaatacggggcaaaacagtgttctgatattctctgtcgctcgaccaaaaaaaaaagtcgaaatcactagctgcttgcactatcaatcacaacttagtcagacagcatattccaccctgatcaaccaccaatcaggaaaatagtcatacagcacattccaccctcatcaaccacctatccagaaaaaaaaatcggcaataactgaacacccggcactaagctgctcaccaatcaattcacagacaatcactcagattcttaagaccttttttatccaattttatactcgcgttttcatggaacccaccatatacacaaaaatccgcacaactaactactaaaccactgcacgctaatcatccccgataataaaaacctcacacaaaccacaccagcaccctactagatctcccacgaccctcttggtgccacagatcgaacgaactcgaacgcaacgataacatcaagcaatggaagcacaggaacgagagagaaaggcaacatcaccggagacggccatcgcgaagccgcacccgccgccggccacatccctccacgcatcaccggccgccgcggccgcgtccggcatcctcacgggcaccggccccagcagcggcgaccgctgctgcgacaccccgggcaggtacccccacatcagcaccacccgctccttcctcctccccgcgcctcccccatcctcctccatctcctccccctcccctccccctcctcctcctccattcatctcctcctcccaacccaaaccccccctctctccctcgatctcactctcgctctcgattctcctctcgatctctctc

SEQ ID NO: 89159 - DNA, 3018 bp, Oryza sativa
ccgtgcgtagtgaaccagccggaagtccccagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggtgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacggaggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcatgttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcaaccctttttcaccctaaacttagatggatctggaatataaaaaacttgggcactcagcgttgtgtaagatcctgagatcccgaacccatatatctcctcactccagtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggggggtcatcatgtaatgcaccaagaggtatgggaggctcgtcaccttcaacttgtggtctgcgagattgctcatctggttgattcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatgg

SEQ ID NO: 89160 - DNA, 894 bp, Oryza sativa
cgccccgaccacctgcatgatggccaggatcttggcgcgctctggatcacagcagagggggagggccccttgggggatgagggatgcctccacggagctgagattcagcacccgttggaccaccatcctgaagtcctcagggtcccagtcccatttgcgcccctggtgggtcctcatgtagtccttgggcccggtgtactcccaggcgccccgggcgcgccgctggagcggcgcgatccggcgatgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccagtcgctcttccagtcgtcccactttttgcggaggacgtagggagcgtagtggttcagcagctgcccccgcggctggaagtagcagccaccgactaccgtcggcggcgacaccggctgtacggtaaagaaccaccggaacagccggagagatgggcgcaccccgataaacatctcgcacaggtgtgcgaagatggccaacgtcattatcgcattgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcatgatgcgggaaggcggcagcacgctaccatcgagcgg

SEQ ID NO: 89161 - DNA, 1039 bp, Oryza sativa
aaggcagaacatgttcacattccagggttacttaatcctctagaaatacctgatatggcatgggctcatatttccatggactttattgagggactaccaaaatctcaggggaaggatgttatcttggtggtggttgacaggttaacaaaatatacacatttcttagcattgtctcatccttatactgtggagcaggtggtacagatatttatggataacatacataaactgcatggaatgcctatcgccatagttactgatagagatcgggtatttaccagtacatttttccaggagatttttaaaatacataaggttaagctcagatttagcactgcacatcaccctcagacagatgggcaaacagagagggtaaatcaatgccttgaatcttatttgcgcagcatgacctttcaggaaccacagaaatggttttcttggcttgcattggcagaatggtggtataacactacatatcatacatccatccaaatgactccatttcaagctctgtatgggtatccccctccacaaattagtgagttttctattccctgcaatatttctgaagaagccagagtaactttagaagataaagcaatgatcctgcagaagttgaagggcagtatgggagaggcccagagaaggatgaagttttatgctgacaaggggagaactgaaagaaccttagaagtgggggatatggtgtatttgaaactacaaccatacagacaagtggctatgggaatcaggggctcattgaagctcaggtccaaattttatggaccattcaaggtcattgagaagatgggttcagtagcttacaagttgcagttgccggagggagctgggattcatcctgtttttcatgtaagccagctgaagaaacatttggggcctagagctataccaatgcccaatttacctgcagtaggacctgatggccaaatcaagactgaaccagctgctatcttacaaagaagaatggttcccaggcataatgaacctgtgatacagtggctgattctttgggagaatt

SEQ ID NO: 89162 - DNA, 8424 bp, Oryza sativa
ggcatccctcatcccccaaggggccctccccctgtgctgtgatccagagcgcgccaagatcctggccatcatgcaggtggtcggggcgtcgggggagcgggccccccgaggccacgatggcgcgggcgggagcagcaggggggaacactctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggatcgtgccatgccgggggaacctcatctcgcccccgaggtggtcgtttagccgacctccccgcaggttcatccccgcgcccaccgcggccgtattcattctcccatctcccaaggcgagttttcactcacccgtttctttttgtcttctggtttttcttctgcctcagcgagatcccgtcgcctcccccccccccccccgccattccaagtccggccggtctgaggccgaggagacggcgaccgcagaggcccggaggcgggaagctgaccggcgagaagccgcggaccgcctccgggaagccgaggaggctgcccaggaggccgtccgggctcgccaggctgaggaggccgctcgggaggaggccagactccgtcgggctggggagtccatccgggaggcagaggcggcgcgcgcacgcgaggcggcctgccaaacccccgacccgactccgcccgaggcgacgatgacttccgaggccacccacgacgaggccgcgggcgcgccgctcgggcccgacccctcgggcgacgcttgggtcgagccagcttcgggggacgcccccgagtccggcacgtcgatcggagggccgagccgcgcggcacccacaccgagggggctctcccctctgccttccgctgccccactgagcgcggagcccctcctgcaggccttggccgccgcgaacatcacggtgctggactggttaagtgcctagatggaggccctgcaggcggagcgggcggagctcgacgcggcgtgggcgcgcgtcgaggaggggcggcgctcggtggaggccatggtggaggtgggccgcatggcacaccgtcggcacgcctcacaactcgaggcccgtcgtagggacctggtggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagcccttgacgccgccgctgcccaggaacggcaggcggcggagaacgaggcggcgtcccggcagcgcgaagaggcccttgaggctcgcgccacggtgctggaggagcgcgcccgcgccttggacgcgaaggagagagacctggcggaccgcgaggccgccgtcgccacccgggaggcaacactggcggcgcacgaggccgcctgcgccgaagaggagtctgcactccgcctccgcgaggacgcgctcaccgagcgggggcgagctctcgaggaggccgaggccacggcgcagcggctggcggacagtctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgtgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcggtacgcgaagtacgccgtcaaccaggggggcctcgcccagcgcctctcagagatggctggggccctcgagcggttccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtctgggacgccgccgaccacatcgttcacagcttcgagggtacggcccctcggctcgcgttcgcgctcgactccgacgaggagggcggtgacgacggtgcggacgacagcgacgacgaggccgacgacccgggcgcgtcggagtgagcccccaggcccccgccaatcttaataacttttccttcttcttccgaggccttcggacccccttcttgtatagactgatttaatctgcaatcaagtaaagaggaaatttctgcgtcagctctgtttgttgtgtgtatgagatgaggatggtctgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttaaggatgacccgattgtgggcctttgccgattcctacccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccccgaccaaccctgcacgcccgggggggtgcggggttggcccgagcccgagacatgacacccgaccccactaggggtagaagcgacgaaggtgttcgatgttccacgggttaggcagctctgtgccgtcgctcgtggccagccgaacggagcccggcagggggacgccgatcactcgatacggaccctcccacattggtgagagcttgctcagtccagaacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatattgaaggtcttggttttgaggcccttgaggatttccgcgttggtgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatattgagcccctagacagcaaacggccacgaaagaggtatggtctgcagggcctgggccgactgatgggtttgcctggcgtggaactggcacaccctgcaccgtcggaccaggtcgaccgcatcgttgagagccgtcggccaatagaaaccctggcgaaaggccttgccaaccaaggtgcgtgaggcggagtgggctccgcactcgccttcatggacatcggtgagaagctcgacgccttgttctcgaggaatgcacttcaggaggactccgttagccgcgcgccgatagagggtcccttccaccagcacgtagcgcttggagatgcgccggacgcgttcactcccttcgtggtcctcgggtagagtcttatctgcgaggtacgcctggatctcagtgatccaagcaatcaatctaggggagctgggagcactcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctctatacgccgcacctggcgcacgtaagcgtccatctgcgggtcagagcaccggtactccttacagagttggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgtaagatttggccgagggggtaagatgtaaccaccgtgacccgatgcacctggaaataatggcgcaacttcctcgaagccatcagaatagcgtaaagcatcttctgggcctgagggtatcgggtcttggcgtcccggagggcctcgctaacgaagtagacgggccgttgcacctttcggcgggccgatcctcttcgccaggggccgcatctccagggcgctcttcgtccgagaggctacgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggccttgggccgccgttcggctcgggggcctctcctccctgctctctcccgggtcgagtcgacgcagggtggggatgcgcagagtgagggttgtcctcgtcgcgctccacgaccaacgccgcgctgaccacctgcggggttgccgccaggtagagtagcaacagctcatctggctacggggcgaccaggactgggggagaactgaggtacgccttcaactgagtgaaggcccgctcagcctcctccgtccaggtaaatgttccggagcgtttgaggagcttaaataggggtagtgccttctctcccagcctcgatatgaaccgacttagggcagccatgcagccggtgacgcactgcacatccctaagcttgctgggggggcgcatccgctctatagctcgtatcttctcggggttggcctcgatgcctcgggcagagaccaagaacccgagaagcttgcctgcaggcacgccgaacacgcacttatcggggttcagctttatgcgggcggagcggagactttcgaaagtttccgctagatccgagagtaaggtctcttggttgcgcgtcttcataaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacggccaggttcgccagcctctccggatggattgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccaccggtctccaggcgaagacgtcggcgtttgcccgcaggaaggagacgagcgcgtcttcctatttgtcgtccagaagaccaccgattcgtgtggtcttggacgggccgtggcccagggcaacctccttgaccgagacctcgtcgcacgtgaccatccgctgccttggggcggccgggacggaggtggcgagcctcttgtcaccacccgcgggcttggacgccgcggcgaggtggtccgcgcgctgctccatacaagcaagcgcgactttgaggtcgccatggacggtaatggggccagcggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaacctccgaaggtgaccgggaggtcgatatgacccagcggccaggtgtgccccggcgtcacaccgatgatcggctgggacggccggagcaccatccccgtggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcagtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcaccggttgccggcgggagccgccggggtcttgccctcacggcgctcctgcctcttctcctcctcccacttcctcgtccgttcagccaaacttttgaccgcgcggcagtccgcgaggtcgtggagggaggtgttgtgcacggtacaccacttgccggttgggcgctccctgctgggagcgccggcctccttctttttgtcgctcgcaggcctcccctttcggggggcccgcgaagcgccctcgacggcgagaacatgaccctcatcgtcggaacgggccgaccccttcttcctcctcctgtcctgccgccctgaccgagcggcggacccgggggcggccggagctgccactccagaaccggaggagttccaggtccaggcctcctccttgcgagccacacggtccgcgagctcaaaaagttgcgcggtggtctggggctccttggaggcgatcttctcgaccatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggttcgacagccggtaccgccaaccggggacacggggggccggcccccgtgcccggaccgaagtggcgctccggacgaggaagcgccctccgttgcgtgggcgg

SEQ ID NO: 89163 - DNA, 640 bp, Oryza sativa
ctaaccagtatttatccatatttatgaatttaactagtagtatttaatagagacatcaatacgatgttggtatattagaaacaaaaaaatactacttttaaaaaacgatattcgatcaattggctttagtttcgggcccattgacaatttgcagatcgacagagagtacgtacgtacacagagcctggctttccattgtgtaacccgtaaagggcgccactactcattcgatattgccacactgactgactgactttagcatctgctactactactactccatggacacacagcacactacctgacctgtcaccacggcgccgagcacaagagagaacacacaatgatgatcacacacactcgatcgatctcactgctactagtagtagtagtagtacgcgtgcaatgcgaggcgggcatgggaatttttttacatgatggagcaggcgttgacgtcgtcgtcgttgaagaggttgctgacggggtcggcgccgcggtggggctccgggaggtggccgtgcttgtcgccgttgtagccgtggcggtagtagttgtagctggggcggaaggactcctcgtcgtggaagtagtccttggccgacgtgaagtagagcggcaggtctgggtttggccagaactc

SEQ ID NO: 89164 - DNA, 704 bp, Oryza sativa
ttcctgcagcccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtgaagagggtacggccgtacacgtacacgatctctgctactttatgcttcaattctgctactacgtactgacacaaatggaaatcgtcgacgaagagtgtgaccggagaagtaaacaaaggcggcgatggcggcgcgcaacggcggcggtggcggcggaggtggaggcgcttggagcatctagcgccttcgtatttcgtatatagctcatcatctctcttaaattagtcagtgcagtgtgagggggaacagtttaagaa

SEQ ID NO: 89165 - DNA, 4357 bp, Oryza sativa
cgcgggggagaggagagagagggagggagctgggccgagccggcccaagaagggaagggggggaaagaagacttttagggatttttctttttataaaacgattttaactttgtttatttcttctcaattattatttgtgctctgaaaattccactaaaatttatttacgcattttaggcttttaggaaatatacaaaaatcctccaagccttatttgacttttagctttgcacattttaattgttggaggctttcacatggattttacttattctatgcacaatttcgaggatgtattttagagtcgatttgggacgcgacaaacctacccccccttaaacggaatctcgaccccgagattcggaagaactggcgaagagatcaggatgggctgccttcagctcgtcttcacgctcccaagtagcttcttcttcggcgtggttgctccactggaccttgcaaaaacggattacccggttcctggtcctgcgctccatggtgtccaggatcttcactggcctctccacgtaggtcaagtcttcgcgaacttcaatttgctctgagtcggcctgctcggatggcactcgaaggcatttcttgagttgcgacacatggaacacatcatgcacgttgcccaaggaggcgggcagctccaattggtaagcgacttctccgcgtcgagcaacgatacggaaaggacccacataccgaggtgcgagcttcccttttgtccgaaacctgtgtacacctcgcaatggcgtgacccgaagatatacaaaatcgtccactgcgaattccagatcacggcgacggttatctgcataacttttctgccgggactgtgccacctttagattatcccgaatggttctgactttagcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttcccgaaatctagaacacatgcgcggagcatatcttctaggatctgatttagacgctcggtctgcccatctgtctgcgggtgatacgcggtgctaaagtttaatcgggtacccagctcttcttggagcttcttccaaaagtgagaggtgaattggcttcccctatcagatacgattttcttaggaacgccatggagacttacgatcctagcgaagtagagttcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacactggcacacatcacaaagggccacgaactctgcaatttcccgcttcatactaatccaccagtatttctccttcaagtctaagtacatcttcgtgctgccagggtggatggaataaggactttcgtgagcttcctgaagtatcagctgtttaagttctctgttaactggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaacgccacggacgttaagagtgttgcaatggctttttcgacttagagcgtcggcaaccacgttggccttaccaggatgatagtgaattcccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccaccgcggctaactccaaatcatgggtagggtaattgccttcatgaggccgtagctggcgtgaggcataggccaccacatgaccgtcctgcataagcacgcaccccaatccttggcgcgaagcgtcacaatacaccatgaaatccttgcgagtatccggcaagattaacactggcgaggaaaccagcttttctttgagagttttgaacgtcttctcgcattgcgggctccacacaaatttctcttctttcttcaacaactgtgtcatgggtcgagcgattttggagaagttctcgatgaatctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcaggatgtcatcaataaaaaccaccacaaacttatccaagtattccatgaacactttgttcattaagttcatgaagaaggcaggtgcattggttaaaccgaatgacttcaccgtgaattcatacagtctgtatcgcgtggtgaatgcggtcttcggaatatcttcttcacgaatgcgcaattggtgatatccggaacgaagatcaatcttggagaatacagtggcacctttaagctgatcgaacagatcatcgattcggggaagaggatacttgtttttgatggtgacttcattgagagctctgtagtcaacgcacatccttttcgtcttgtctttcttctccacaaaaatcacaggagcaccccagggggaagtactcggacggatataccccttttctttcagctcttccaactgttccttgacttcggccagttcatttgctgccatacggtagggtcgcttgtacagaggagcggttcctggagcaagatctatccggaactcaacctctcgcttaggcggcataccaggtagttcttccggaaacacgtctccgaactctctgacgatgggaatttctgacagtcctatctgatgaagttctgaacttctgactgaggttgggggtgcaaagaaaacaaccggttgttccggccctcggtacagagtgacagtgcgtctcgcgcaatccactactccttggaattgagccaaccaattcatctcaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggggcggggaggcgcttggccttgctgatgccttggcttcgggcatttatccgcaaagtgcccgggctcgaagcagttgaagcacagacgctgcggaccttgagcgtccctgcggccttgaccaggctgcacagtcggtggaggaggacggggcgcacgagtcccttgttgattcgtctgctgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccggagactagacggacggacagctcagggtccattcctgccaggaacttctcttgcttctcctcatcttcccacacatcctccggagcgtaacgggccaggttgttgaactcgtgcaaatactccatcacggagcggttgccttgcttcaactctcggaattcccttttcttaagggccacgactccgg

SEQ ID NO: 89166 - DNA, 1321 bp, Oryza sativa
caagatgccagatggttatgcctcaaatatcaggagatgtgttgatgaaaatggttggaaggttagtagacttaaaagccatgactaccatgttttattacaaaaacttttaccgttggtggtacgccatattttgcctgaagatgttgtgatcccattgatcgagctcagcaggttttttaatgaagtatgttcaaaggagcttgaggtgactgaaattgaaaaactatgcaattcaattggagagaccctttgtcggcttgagatgatattccctccatcattttttgatattatgatgcacttaccagttcatattgcttcggaggctagaattggaggccctatttgttatagatagatgtatcctgttgagaggtacctacgtacccttaaaggctatgtgaggaacaaagcgtgcccagaaggatcaatagcagagggatatatatcggaggagtgccttactttctgtgctcggttctttgaagatgttagtacaaaggtgaataggccagaacgtcaagaaaatagccaagtcagtgcaccacctgctggtctaagtatttttgggagcatgctgtacagtaagaacaaatttcatatcgagactgcatcttattcagacttgcatagaatgaggcactacataatatccaactgtgatgaggccatgccatgggtaaagtaagatatatttatgcctgttatgaatgcagagtgacaaaataactcatcattctgctaatcttttcatttttattgcagtgagcatatagaggaattgaaaaaaaccaacaggggaaatgttgataaaaggcacaaggaacaatttgtatcatggtttgagcgtaaagtgagtgttttttttgtatcaatttcatcaaactaattgaaaatgtgactgatcatacgttcgaagtttttctgagtgcagatgaacattcttcatgcagatggaaaaatagatcaagatatatattgtctatctcgtggtccagatcatcgagttcgtgtagctaacaggtgctccatcaatggatttctgttccgcacaaccaatgtggagaaaaacctaaccacacaaaacagtggtgttgttgttcagggcgaaggcatggactggtatggagtgattaaaaagatcatcaccctcaattttcccaatgacaaagaagtcttgttgtttgagtgcgactggtttgatgttccgggagcaaccacgaactaatccagagggtacaataaagatcaatatggaattattgatattgacaccactcgatttcgctttaaagacgagccttatatactggcgtca

SEQ ID NO: 89167 - DNA, 1037 bp, Oryza sativa
accctgcaggtcgaacggcttcagcaccggaaacaagtccgagacgttgggcgttccgaggagctcggtgacctctgcgacgagacccctgaactcgctccccaccgccgacctctcgctctcgcttccgatcgttcccccccacatggtgcccgtgatcacattcatggtgttcaggaacatctgcgcgccgacgtccaccggctcgccgggcttggagtggaggtaccggagggtggacctgaactcgcgccgacggaggccgtgcacgctggcgagccccgcggggctcatcatctcctggacgcagacgcggcggagcaggcgccacataggcccgagcgggttgcccacgatattctgtgcgccgccgaaggagacggcgtcgccggcatccagcatgacccggttggcgaagacggagtcctggtcgcggagcacctcgcgggccagctgggcggaattgacgacgatgtccaccttggaaccgaggcggatggagaggatgggcccgtgcttcgcggcgaggctagcgaagtaggtgtgcaagtttgggtcgatgaatgggaggctgccaacgagaggaagccccaccggtcctggtggcaaacggcggctgcgccgccgggtgacggcgaggtacagcaccgttggcacaagcaatgcagcgtagagaagatttgctgttgccatgggctgcatgactatggagatgcatcactgtgagaagtagtagcagtatcttatcaaataccacgctctacccaagcgatctatggatgccactgtcagctagcttcaggccggatttgaaaggtatcagtcgatgagagcaattgagattgttgttttgtcgacaacgtaaaaaaaaatcattctcacccttccattcctcaatctattatagatgtggatttttatccctacagggaacctcccctcattgtttacatgtcatctgaatagttattaaaaaaattaaaaaaaattaacaatatagattaataagaaatatatcactccataaatatgtatga

SEQ ID NO: 89168 - DNA, 521 bp, Oryza sativa
caatctatcttgaactaagcaaggctgcttgccatcagattttggatttccaagctggccattgctggaactacccatggtaaacacacgaccagatgtatctagggcaacagtcatattatgtccacaagccagctgatgaaaattgtactctaaaagcgcttgaacacatttaggaactaattttttttctttgtccccatggccaaggcggttcttatctccatcaccccaggtatataacttcttagacatcacatttgcacctgtctgattagtaacctccacaattgctgcagaatgccaaattccacatgcaactttgatcgttttgaatccactcaaggcttctacctcttttgggtatgctaaagtttcacggtcaccatgtccaagaacaccaaatgttccatcaccaaatgtgtaaagttttccacttgatgtggtcaaagcagaatgccatgagccacatgcaacagatagaacttgaagaccttctaagggccctgagactttctttg

SEQ ID NO: 89169 - DNA, 2721 bp, Oryza sativa
cagtgccagcagtacatagtgccaaatgatgtaggtttagtatttttgttcaacacaatttgtttcacatcagatcgaaatgagctgatatattgctgcccaaagtattccccgccctcctcccccccaacccaaaaaaaaatatttgactaaaggagtggaggatctgatcgtttggaaatggataactaatggaaaatatatagtgcaaagttcaccaattcaacggaatgaaatctcaccataaacaaaactgtcttgggaggcatggcccctagccaaatgcaagatcttcagtcggctcgcactacaaaatagggtatggacacccgtttgcaactcaaggggtggcataataactacttcagctaactatgcttccgaaaccttaaaaccattgaccacttactgttcgaatgctcagtatcagcgtaaattcggttcggtgggctcatgtggctactgcaagcacacatcatcttgaggtggaatacgagtaaagacttgttgattggtggatacaaagaacaaataacccagaaacaagaaaacacaaagctctcaaatcagttttcttgcttatcgcttgggaaatttggaaagaaataaatgcaaacattttcagagaacaacaagcaacagtccaccaaaatagttaactgcattcaggagctgggctgttggagtttgcccaccgcacaacatattgagttgttgccatgggaagcgaggaggattgacatgcaaggatgtttgcaatcaagcgagtacaattctttcttcttttctttaacttttggttatgtataaaccctcttctattaatatagggttaattggatccatgccaatgcaaatttcccatattagaaaaatatcgctactattcacgatattggttacgtgccacaggaatttagaaaaatcagacccatgccactgccgtcaagtttactgtcaacctccatcaactctctccctcaacttttcttcttttctcttctcttctcttctcttcggcaagtgattagtcgagcaaggatgagcggtgagcggcgggcgggagggctcgggagccaccaccgttgttgtaacgctccgcttctcgtgagacgttaaaaactaattcggcaaatcctaattgtgaaaaattttgtcctttgagtgcgagtctaagtcgtgccatggatctcggtttcaaatcccattgttccctctcatcgaaatcaaaatcctccgcctcaaatttcctcttccaattcaagtctccgaaatctaattccgaaagtcaatcccttcctttgaatcctcgccaaatacatttccgaatcccaaaatatccaaactcccgttttgtttccttccttgactccttgaacccttgtgtacaaagtatcaaatttagattcaaaacccaaactccaaatctctccaaatcaaaatctttcagcaaaagtctattttgcctcccttgtcgatgggctgattcctctatctcccggcccatcccctcctctcggcccagctctctcgcgtgtgcgtcgcacgtgttcgggagcgagagacagcgccgtctcctttctctctctctctctctcggcgtcgcttcccgccgacgccgccccaaaattccggccgcatcaccatttcccgcgcgctcgcgcatggccgaccagcaaggacgccgctaccaccgccttcgcccttcccgcgcgggttcgcgcgtggccaacgccccggtcgccgctgcgtcaaaccctggcgccgcctgcgtcgtgccctgccgcgctgccgctccgccgctccacgccgctagcttccaaggccgagagaggcagcccctgtctcactcccctctccctcctccttttcccgtttcggcaagggtcaagccctcatttccctcttcctttcccctttttcccgaccaccgccgatgtcatccatggtcccagcagctcgcggccaaagcgcggacgctggtcgtgcgactgcaccagctcaccgcagctcctcctccttgaccgccaatgtcggttcttcctccctaaaccgacattgccatctattaaaccgagccgccccatctccctctcgttcattccctcgccaccaccgtgcccttgccgctttgctaccgccgtcctcgcctccctcctccatcgcgcgtgctggtgaagccggcgtgcgcgcgaggagctgacgcgggactccaggcactgtctccttccccttccctggcccgaggccggagagctcgctcccgcgtcgtcggccgctcgacacagcgcccgtctcggctcggtagtgcatctcccgttctccctcctcgctccctctcctctccttagctctgggcagtagtgcgagtagccttccagtagcaagctggcgccgccccaaccgccgcagctgctcgccgtaggctcgccaccgtcgccgcccaaactcggtagtagctgctcgtcgccggccttcctcggtgtagctccacccaatccgactctagaaatgaactctggaggtctcgtagatgctcaagtccctaggaatcgagctctcgtcgcatcgtcgtcgtttccctctttagccgccgccggcaagcgccgccgcgattcgtcgtcgccggcctccttccggtgaatccgagccagtggatcaacccccttccttctgtatcgtcgtcccggtgtactccctccctctcgaatcgtcgggttg

SEQ ID NO: 89170 - DNA, 865 bp, Oryza sativa
aattttatttctttgtttggtttcagtatgagctgttacatgacaagtccgaagagaagctgaaagctctgagggagatcagtgacactgttatgcataggaagcttcttgacagcagtgttgatcttgtcggaaaacttctctttggatttggaaatgggccttctgtgcttcaagctgttagaccttctggtcagccactcgttgatgattgggattgtttgaagagaatggtaaagttggaaacttctttatactcggcttactgagaactgacatctgctattactccactgcgctccaatagttccatattgtcctgaaatctcctagtttccattgtttctgtttgtctgactttaatatgagtttcttcaggtacggatctttgagtcgcattgcggaccgctcactcagtacggtatgaagcacatgagggcgtttgctaatatttgcaacaacggtatctctggcgcttcaatgaaggaagcaagcatcgctacttgcagcagtcacaactcgggtagatggagctcgctggtgcaggggtacagtgcttgatctgccgcaacacgtgatatagcctcaaaacttatgccttgtactcgtacttcctcaaaacaataccttcaggactgcaaataaccgtccaaggatgtaccgctgtatgctactgtacctctatgtgtgcaatatagatgccctgtatatacgagtatatgaatgaatcgtgtgcttttacatgcccgggaattgatcgtgtatttgatagctgagaatgctgagatcgagatagcaaggtagaacttgtgtttcgaactgaatgaagttcgcctgagcacaactttgctgcggcgtcgcaact

SEQ ID NO: 89171 - DNA, 1156 bp, Oryza sativa
tcaattttgcagctgctgagcttatcctgccattaaactgtgctatgtaggctgactttgcgttgtactttccatttgccatccatcgccaagttatagtgtcctcaacaccttctgtgagtgcaatgtcgctattccacacgtggtagaaaacctcaaagaattccttgactagctcgactgtgaggttgtgcctgatgtctagtatccattggtcatttgctaatccttcgtagaccgtcctacctttccttttggcatgattgtataaggctggggctaactccttccgtggttgttcgccaatccaatttgattcccagaaactcgcttttcgaccatcacctatcgtcacccttgtagcagaggcaaacaaccttctgtccatttcatcacaagggggaggtgtccctgcccaaggcttatttgggctctcccagctgaactatagccatcgcactctcaaggctcgagcaaatttctctggccaatttactttgcatttgcccccactaatctctttgtcgccagcccaaaggaatctctttctaattttatccatatcatgcaggaaattttttgggggtttcagcgctgtgaggaaatatgttggtattgaggttagtaccgaagagacaagggtcttccttcccgcctgttgcaacagctttcctttccatcctgcaagacgagagtggagcttgtccatgactggttggagatgcactctcttgattctccccgttaacagaggtagtcctagatatgtgatggggaaattagtccgctttccattgaaattgttcagcacttcctgaagctctatgttctcacatctcataggcaccaccgagctcttacttaagttcacctgtagatctgtggcatgtccaaacttttctagcagggtgatcaggttgtccacatcagctcgacttgggttaagaaagattgccgcatcatccgcatatagcgatgttcggaacttagccaccctgtttgttattggtgacaagatcccttggtctgtggccacattcagtatcttttgcaaagggtcgattgctaatatgaagaggtagggtgaaagcgggtccccttgccgcaatcctctcttatgtgtgattgcctctcctgttgtttcattcaacattat

SEQ ID NO: 89172 - DNA, 848 bp, Oryza sativa
tttatcaatgctgttgacattataaaattggggggcacatatatacaaaaaatgaaaaataatgaaaaattagaagttatgttaatcggcataaaggatagtgaaaacagcagggtattaaggtatcttagccgattacaagaatttctaagtcctattacacaaaagttattgagacaagtactgctggatagccgaaatatctctttgcctaatttgttcgacttcttcaatggcttgggcatcttgagcatcagtcccgagaatgatcttcagggacttggttacgtcaacaacattcttgatagccgatttgagccttgctttttgctctttgacagattttgggagatcggctagctttttgtgctccatatccaattcaacattgcattgttcaagctgtgccaagagatcgatcttgcgggcttcaagccggttgatattggatttgatcggaccttcggataactgatcgagtttgactttttcttcatacacaagctgccgattgacttggattgtggcttcaatctccttacgctcacggcgttcggctaatcttagcttggctttttctagtttaaattgatgttgctcaagataagcggctggagttaggacatcggccagttcttcaggaattagaacttgaactttgtgcaatcgtgtcctaatcgatccacagtcgaccactaagctatccatagaagaggcttctagccgacgcgagatatcttcaagtgttttctttgcatcgtcagataagggagctagagctttgcttgaagtatcttcttctgcctcatcaagataatctttgatatcaaaagaaaagagatcggcta

SEQ ID NO: 89173 - DNA, 2109 bp, Oryza sativa
agagggagaggtggcgcccggagctcctcgtcacgcgcccacgcacgcaccggcctccccggtgcttggcgacgaatggcgacggcgcgagcagggcaggggcaataaggcggcgacggtggttcggcggcaatggcgcggtgggtgtgaagcgagtgaaaacgagagaagaaggggtttggggcgcggcttgggttttatagtggaggcaatgtcggtttgggaggcgggggcgagctgctgcttggctagcggccgcgagagcggcgttttcgtgcgcggcgcgaaacatggcgacggcgtggatgcgttgggcggcgaaggcggtggatcggacggcgaaaatcgaatacgggtgaacccccgcaaaaccgaggactagtatgtgcccatggaaccttctgctagcgtgtggggagctttgctctctgcatgtgctatgcataataacgtcgatgttggagagattgcagcatttaggctatttgagttagaagaaggcagtgctagcaattatgttaccctctgtggaatttatgacgcagttggtcaatctgatggtgttgcagggttgagatcaaggatgagagaactcggcatggtgaagacgcctgggtgcagtcggatcgatgtgaagggaagagctcatgctttctaccaggggagcatcccacgttatttgaggggatgaatgctttgggtattagatcagttactagacgatatggcaaattcagattctgaagatgagcttgctgacttgtactttgagttaactctgcactgaagttctgatggtgaaagtcatgtattgctgcaatcaattttgttcaaggaaaagcatggatcttccttgatggctgccatgccactcatgaacaaatttgaatgaagaccaacaaataatcctaagaaattggtcaatctagatgccttggaagctgaaacttttcaggaccagtatctggagcaacatcctgcatcatggtatggtgccaggatgagagcaatagggtggctcttctggtccaaacgactggtatctagtctgaggtgactgcaatgacagtaatacatgtgtaatgttgtcagtctggtttatcggcatatggctcaaatatagtgcttctgaaaatatgcgacaatattggatgcaggagaaattgtgaatgattggcatataaaagattatctcttggattaaataaaagagcgagaatgaatggctagtatttaaaaatgggtggaaaattatttccctttcccatttgacaaacattgccttatagcaaaactgaacgatttgctcagcacctccgaccgagagcaggacaccgcgccgacaagagagcgcgcgagccgcagccgcgcgagaggagcgaagcaggccaagctattaggcccattgggcttgtcttttttgtgtaaatggggcttttgactaggaaaccctaaacccaaatttcccctttctccagttctcccatccccaatctgtgcccgtgcgcgaggaggggcgcggcagggcgtatagcggcgggcgcgcgcgcgggtcggcggcgcggcagccggcactggcagcgcggcgcagcgcagggagcaaggcagaggcagccaccaaccaacagggactgaagtcaggcagaggcaggcaacaagctaaagaggaggagaggaagaggagagattaggaatgttgaggtattgttgcgtttctcgtctatttaacctttgcaactgggatgatggattgtgaactcatatgactagtgcttgttgctatgcttaatgtagacgtgatggataatgctgcgtcgtataatatcgtgaattgatattgcttttttttttcccttcttattctgttctaattctcgcgcgctagttcatgtgccacacctaattttttttctgtcctccgccactgaccttatatgcgctagttcatatacgattttttttttgtcctccgccactgacttatatgttctttagtttgctaaaatcctctcataacatacattttagctccttcaagaagtggctcctggttttcttgctctcctcttgcgatattgctgggtactccctctgtttcataatgtaaga

SEQ ID NO: 89174 - DNA, 671 bp, Oryza sativa
gctcttccacaaataagtaaccaagaaaaatcttaccattttagcgtaagtattggaggcatgtttttcttgtaacaccttcatgaagtcagcagcataaagatatggcagattgggcatacctgagaattggacatgtcaacatgcatgatggacaaaatttaactcaaagagcaaagcagcatatgcaactatcacataccaagaactccaggacccccatgatcagagtagaagataaatatgtggtcatttggtttgctatctatgaccttcctactacccccagtaactgcagttttattgcccaagagaaccgcgtaaaagttttttgcagtgacttcgtctccagtgtaatcctggaattatagagtgtgttatcttcatcaaacttagagaaaaaggtcaatatatatgttatgcacttgtgccatgtacacgcaaatctgaagccacctgaagctaataaagaagtgcaaaagggtaaataattggacataagaccctaacagtcctctctccagcccgaggaacgaataacagtgaggcagtacggcatcgtgtaataccttcggaactcctgcataaacatcttcaccctgtggatgattgacaataacccctggtctcgggttaagtatattattggcaatgtcgtcatacataaacac

SEQ ID NO: 89175 - DNA, 675 bp, Oryza sativa
gcgcataggatatctaaacatggtgccactaaagtcactccttttgagttggtttatggtcaagaagccgttttaccggtggaggtaaatcttggttctcttcgttatatcaagcaagatgatttgtcaagtgaagattacaagacattgatgggagacaaccttgatgaagtcatcgacaaacgcttgaaggcattggaggagatagaaaaggagaagaagagggtggccaaggcgtacaacaagagggtgaaagcaaaattgtttcaagttggagacttggtttggaagacaattttgcctttgggtactcgatccaaggagttcggtaagtggtctcctagttgggaaggtccttatcgagtgtgcggcattgttcgagtgaacgcatactttttggagacacttcaaggggagcgttttcagcgagcaatcaacgggaaatacttgaagaaatacttcccgagtgtttgtcaagacgcttaggaggtactatggccggtaattggattatcgtcctaagaccaaaaacatgctctatgcttttagattcacgttgttcataaaaaaggcaggggggcatgtgtttacacccaaatttggcacctaggattaaaataggaaagattgccaaaatttggaaatctaccggtttcctccgagtgtgccggtctg

SEQ ID NO: 89176 - DNA, 702 bp, Oryza sativa
gttacaaggtaagcaacgcacagcgcacacgagctagctatccagctgcatgaatcacctaaaccatgaataaacctactaatgcacaaaatgcctaatttggcaacctacatctcataggcccaggcgttctcgttacggacctcggcctcctcctccggcgtgaagtcgttctcgatcccaaatacctccctgacctgctccggcatcatgtctttgatcaagtccgccgcgcgctggcatgtcagctccagcaggcacggcatgttcaggaagttggcggcattgatcaggccgaacaacttcttcctgtcgacgctgacgaactcggcgtcgaacttactgagctcctcctctccgctagctttcgcggcggcggtggctgtggcggtggcggcggcgtgcttgttgcagtactcgaccaccttggcgaggatatcggaggcgacgttggcgagagggatggcgccgttggtggcgcagtcatcctcgatcatgttacccaacgtcttggacaggctcgccgccgcctccgacagctcgaatttcgcgccgtccgagctgatcagcaggatcatcttctcgccatcggcggcgccgtctgctgctgctgccgatgctgccatctcggtggcgcgcttggtgggcacctgatcgatctgacgagtgcgcgcttgctagtttatcacgaatctatttgcg

SEQ ID NO: 89177 - DNA, 4549 bp, Oryza sativa
gtggggcccccctattttttaataaataaattgctgactggactgccacgtagatcaaaaccaccgcggattgggttgggggggtaattcgtccagtttgcatagttgggggtgaagaatatccggttttatggttcaggggtgtaattcggacaatcgctatacttcgtggggggggggggtaattcgtactttttccattataataagggtttcatcggggtttcagccgatgagttatctaaacgttgcattagcttacaaggattgtatacaagttggttttaggtgattgcaacaaaggtttcattgtttatctaatcatttggatttaataacatcgaaacaccagacgatgtatgctttaaccatcggatcacttattctatcatatcattattagccgattgatttatattggattatattattgtcatattacattatcattagctgattgtctttatatcgttatctacattggacatatagccgattgttcaaaaccctatcgacatcggctggaactactccatcggtttgtcaaccgatcggctatttaatatgttgtgtacatatcttgtcatttataggatcaaactgactggcacgtctgcgtctcattaatttttgaagctgcactggagctgagcagatctcccaagctgttgttgttatagatttagtttgcgccaacacagatccgacaccatcagtcgagcgcaaatttttcatcaataccaccatggcggctgcttccctccccggcatggtggcagctactgccccctcacctccccaacgtggagccgacaacggctgctcccctccccggcgtggtagcagcagctgcgcccctcccccctccccggttgctgtaaaatcaaaggtgtttttgattattactctgtgatgaacaattaggcattggagattattggttttattatttgaaatttattcacgaagtggttttggagatgattggatttcacaggtgaatctgcaggatttaatgtggaccggtcagaccgggctttggtagccggtcagaccggcgtgtaatgcgcggtcagaccggcgcagcccacggtctgaccggccgacgctgtgtcggtttcggtttcgggttgtttatttggatatccgagtttattccatgattatgacttctagatggatactatacgtgtgtaatactattgtttgctgctaatgagtcaagttggagatagcttggtctcggaatatggtttctttgtttgttccatgtgtaggtgactcgatgtctcgggagagtatttgcggtgatggaccgggagtcggcttggggataagacgacgtccatggtggtcagagatcatgcgggatacttaggctagagttgatgcacgtggttgatggagattccaaatggcatacgatggagttattgtgtgcgtttgggatgcggagtcgaatttggaaggagtccaaatttggtacgtttggttatgtaaagtttctttcttgtactagtgggtttcctaaggtgtttaggactcctagtatgagtttggttcgtggctttaggctgcctacctcatgtataaatagagggggagcgtgaggcttcccggtatcgctttagagagcaattgagttgagttttgagttagggtttcgagtttagtcgaaattttgtaaggagtgctgttggtgcactttgtaaacacagagagaagtaataaagtcgtcatccactttaagagttcttcgatttgtgtttcaccgggtttcggcggtctaaccggcggcgcaccggcggtcagaccggcggcatcgcggcggtccgaccggcgggcacacggcggtcagaccggcggcttccactcggtcagaccggcagatcaatctcggtcagactgacttccgtcgatttcgagggtaacttttatttccgctaaaagtttttggtttttgggtaaaccaaccattcaccccccctctggttggcttagttcttgtgattcgatcctacaagtggtatcagagcctcgttttcttctttggatttttatcgatctaaagtttttgccatggctactccagctaggttttcaactaagcctgatgttttcgatggaactgattttcctcattggtgttgtaagatgcaatcttacattatggctgaaaattatgatatttggaggaaagtttctcttccttatgtgattcctgaagccattaatactgatgctttaaaaactgagtttgaaaataattgcaaagctcgtaatattcttttgagtgggatttctcgttctgattatgatcgtgttgcacatcttgaaactgctcatgagatttggaatgctttgaaaaactttcatcaaggaacaaataatattaaagagcttcgtcgagatctttttaaaaaggagtacattaaatttgaggtgaaatctggagaggctttggatgactatctttctagatttaataaaattttgagtgatcttagatctgttgattcttcttatgatgttaattatccacaatctgatatttctcgtcactttttgaatggtcttgacatgtctatttgggagatgaaagttacatctattcaggagtctgttaacatgtctactttgactttggattcactttatactaaattgaaaacacatgggatgaatattctttctcgcaaagttgattctaaatcgagtgctttggtttcctcttcttcctctttggttattgatgcttcttcatctatgccttcttttcttgctgcttttaatgccacatccgatgatcaactcgaacaaatcaaggaggaggatttggctttggttgctaaccgaattgctcgagctatgaataatgccaggaacaggaaaagaggtggtccaaatcgttgctttgaatgtggttcaattgatcatcttcgttcgcattgtcctaagcttgggagaggcaaaagagaagacaaagacggtgagaagaccaacaacaacaagcccaacaactacaagtcgaagggttctaaccaagggaggaagatggagaatcttaggaaggcctttcaacaagtttgcgccgctttcgagccactaagtgatgtagatggtgaaagtggagatgatgataagggaaagaacgtctccgatgtgtgcttcatggtgcgtggtgaatctgacacagagtatgaagataatgaggtgtgtgcttttgaagaagctattaatattttgagtgcaaaaaataaaaagtgtgagaagatatataaaaaacaggagtttatcattaatctcttaaatctgaaattaacaggttaaaatctcttattcctaatgatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaactaaaaagttgttacaaaaatatcaaattgcttttcatgctagtttgatgtttaacatgatttctgctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgccccaaatgtcgtaaaagcaaaggtgtcatggtagattgtgaaaattgtgctaatttgaaaaaagaggtttcttatttgaaaaattctttgctaagattttctgatggtaaaaataacctcaatatgattttggatcaatcaaaggttagcacaaataaccgtggtttaggttttgatccttatgctcataattctagacatcctcctgttgtgttaggtgttggtgctaaaagtggtgagattttgattaaacatgatactaataaaactgtgtttaaatctgctggtatcatgttaaccatgaatgtatcttcttcaaaatccaatgttgtgcatgcaaaacctcctgtttctgcttgtgttgctaaatcttcttgttctaacaatgtgtctaaacaacgtgaaaaatatacttgttctttttgtggaaaagatggacatattgttggtttttgtttcagattagctcataaacagaaaaaggagagagagattgcttttgcaaaatcaaagtggcaaaaatcgggttttccctcgaggaaaccggtcagaccgcagtggatctcgcggtcagaccggcgaccggtcagaccggctgcagagcctcggtcagaccagacaccggtcagaccggcggtacagaggtggtcagaccggcccccggtcagaccggccactgtacctcggtcagaccggcctcggaggaatttttctgaaaattccaaaattgatatgcctattgaatcttctggtcgtgtgtctcagtactggattcctaaatttttattatcatctaaccctagtactgaggcttcgacttctgcttgtgtgtaggctttggtggcaaggaaggagaa

SEQ ID NO: 89178 - DNA, 838 bp, Oryza sativa
taaagatcttaaagtagtgtttggaaagaggcctggcagccagcctatagagagcgaagatggtcacgcggcgatgtagaaaaagaactctatattttgggagttaccctattgggaattcttgtatgtccgccacgcaatcgacgtgatgcacctcactaagaatctttgcataaaccttcttggcttcctaggtgtatatggaaagtcgaaagatacactagaagcatgtaatgatctgaagcatatggaacaacgcggtgaccttcacccggaacctaaggagaaaggaagccattacttgagtccagccagctacactcttagcaaggcagagaaggaaagtatgtttgaatgcttggagagcatcaaggtaccgtctggatgctccacgaatataaagcgaataaccggaatgctccacgagtaaagagatatctttactcccggttgttctcaccaaccgggactaaaaatccgggggtatgtatattccggttgcgccctcgtcttctccaccaacacttagccgtttttcgatctcggcttctccttcgccgccaccgtgcctagggcaatctcgcgctgacaccgccgtcgtctctcgccgtcgatcggtggtcctcgtcgcctccgctgcagacgccgccgccgcacttcttggtgagagccgccgcagcctctctctctctctcgatctctgatctcgatctcgatctctctctctccacggccgacgatcgacgcggccgccgccgccgccgacgacgtcgccactaccacgaacgccgccccccctcgagctcgccacgccgccgcgccactgcgccactccgat

SEQ ID NO: 89179 - DNA, 678 bp, Oryza sativa
ttgcggatgatcttggtcaaatgttggaggacgccaaggaagattgcgaaagtgaaaagggggcccataaattggacaagatgttagaggaccacagaacgtcgttgtacccaggttgcgagcaggggcacaaaaagttggataccactctggagttcttgcaatggaaggcaaaaaatggtgttagtgacaaggcatttggcgatttattgaaactcgtcaagaacattcttccggagggaaacaagttgcccgagacaacgtacgaggctaagaagatagtgtgccctctaggattggaagttcagaagattcacgcatgtccgaatgattgtatcctatatcgcggtgaggagtacgagaacctagaagcataccctgtttgcaaagcgctacgatacaagattagacgagatgatccaggagaagttgacgggcagctaacgaagaagagaattcctgctaaggtgatgtggtatttccctataataccacggttaagacgtttgttcaggaacaaggggaatgctagaatgatgcggtggcacgctgaagagcgtcaacaggacgggatgctgagacaccccgccgatggttcgcagtggcgaaacatcgacagaaaatttaaagactttagaaaggacgcacgaaacatacggtttggtttaagtacggatg

SEQ ID NO: 89180 - DNA, 572 bp, Oryza sativa
atttgttccggcggatgtcgtcgttgattgtgcaaaggagcagcaacttctgaagttgatccacgttctgtttcagtactggtcgaagttgaattctctagaggaccatctcgatcagcatcaacagtatccgaacccgacgaacctggccggtctgaccgctcctcatgagccggtctgaccggaggtgtgccggcggtctgaccggcctggcgcccggtctgaccggccgagccgacctcatcgtcgtggtcgtagtcgctctcgtcttcaaaaatacgaccatcctccccctgaacctgtgacagtgtacctgcaatatcgggtctagtaccaggactagcctcatcaaaagaaacttcacaagtctcaacaattttgttagtccctaaaataagtacacgatagccacgagtgtgtgcggggtaaccaagaaacaatccatcgatagagcgtgcctcaaacttatccaaatttccagatttcaagacaaagcatttgcaaccaaaaacacgcaaatgtgaaactttgggttgatgaccaaatcgaagttcataagaagtttttccaag

SEQ ID NO: 89181 - DNA, 3072 bp, Oryza sativa
aacactgtagttttgtacgaagttattttcatgttttttcaacctgctaaggctacttcattgatacttatgtaagggaaatcttattttctttatagtttatagaaagatacttttctggagcagaactgcaatgcactgcaaactcattgtttaggaatctgagtatacatatgttgcccagagtgacttaccttggaacatgttatatctgcaggtgtgcataattaaaaatggcacaaattttgggtggtctagtcaacattgttgtaacaccgatctataatgctatattcaaacatgcattgtatccattcaaagttaccagaaatgtggagaatctcgagaaggctacaaagaaattgattgctaaacgtgatgatgttgagaacaagattagtaacgatgagagaagcggcatgagaataaaaagtgaagcaagaagatggttggaggacgtcaataccaccatatctgaagaagcggatattaatcagaaatatgaaagcaggggaatgactttcggcggatgctccatgaattgctggtcaaactacaaaatcagcaagcgtgcatcgcagaagctccttgaagtgaaggagcattatatagctgatatgagtgtcgttggagatcaaccatcgccagaacctgttcaaaagatccctattccctgtgatcatgtaatggacaatgataacaatcttcgtgaagctctggactatatcaagaacgatccagttgggataattgggatatggggtgtaggtggagttggcaagacccatctcctgaacaagatcaacaattcatttcttggggactcttcctttcattctatcatctatgttattgcctctaaagagtgttctgtgcagaagatccaagctgagattgtcaagaaacttaacctacggaaagatgacgatgtaaaattccaagcccacatcatttctgaatttctcgacggaaaaaattttctgttattgttggatgacctctgggagaggattgatcttctggaagttggcataccaacactaggaattgaaaacaacctcaagaggaaggtggtcctcacaacaagatcacaggatgtatgtggtcaaatggaggtgaggaaacagataaaagttgcttgtttacgagatgaggaagcatggaaactatttctggagaaggtcgatgaagaaactctcccttccagttctctaattgaacttgcaaaacaagtagtgaaggaactcaagggcttgccattggctcttgtaactgtcggaagggcaatgtacgccaaaagggacccggtgctatgggagcataccattgattacatgaaaggggcatgtcgtgataaggacggtcccctctctatggaaactgttttcaggcaacttaagttcagttatgatagtttacggaatgacaccctgaaacgttgtttcttgacttgtgcattgtggccagaggatgtgttcatagctacagatgaactcgaccaatgttggatgggcttaggtctggtggacaaggatgatatacaaagttcctacagagaagcatgtaacgtaagaagtgaacttcaatctgcctgtttgttggagagctggcatacttctcgtgtaatcacaatgcatgatgtggttcgtgacatggctctatggatctgttgcggttgcagtgaaaagaacgacaactgggttgtccatgcacaagttggcaaaaatttatcaagaagaaccatcccatggagcaaagctgaatgcgtctccttgatgtggaatcgcattgaagaattgcctcccatggattcaaattattttcccgcaaaactcaggacattatgtcttcaaggcaatcgtttggatggaaggatagttgaaactcttaagaatttcactgcactcacatatctggatttatgctcgaattccctcactaacataccaggggagatatgtgccttggccaatttggagtatctcgatttgggatataattcaggaatatgcgaagtccccacctgctttagagaactcagtaagctcaaattcttgtatctgtcatgcactaacgtatggagaattccagaggatgtcatatctagccttaaagcactgcaggtcatagacttgacgccaaaacccaaaccttggaatcggtacggtaacagagaaaaccacgcggatcatatgccttcagtagtactaatccaagagttaaccaaactaagtaagttaaaagcagttggcattactgttgaaagtgtttctagttatgaagcacttaaggaatatcctaacctacctattaggagacttgttctaaatatagaggaacgagagtcagtgttctatctactgactggtcctttgtcagatcacttggctcaaatgaccttacataagttggaaatttatcgcagcagcatggaggaaataataatagagagacacgagagtggtggccatttggaacaaaactatagttttgacgctctgaatcagctggacttacaatttttggaaaacctgaaagttattacgtggaaaggaatacgtccggaattgcttttccataggctcaccgttctgtataccattgactgcgaccagctggaagatatctcgtgggcgctgcatttaccttttctggaagaactatgggtgcaaggttgtggcaagatgagacatgccattcggaacatatcaaagcaagagagctcaatgcaatcgattgatacattcccgcgcctcgtttctatgctatttgcaaataacgatgggttggtcagcatatgtgattcagatgtgacattcccatccctaaagagcctgagggtcacaaattgtgaaaatcttaagaggcttccttttcggcggcagcagagcttgccacccaagttgcaggttatatactccgatagtgttgaatggtgggataatcttgaatgggaagaagaaggtatcagaccaatgctggagccccttcttaaaatcgtgtcataatgattacgctgagcagtcctgtgatgtgtttcatccatggttagtatctccccccgtctctctc

SEQ ID NO: 89182 - DNA, 814 bp, Oryza sativa
cctcgtgcccccgcccggtgtcgtcgtcggatggcgtgtacgaggaaggcgaggccagcgggcagggcgaggcggcggcccggtggtgtgcgaggtggtgctggccagacacgcggccttggcccaatggccggtggcgtgagactgtggagctggtgcgcgaggagcaagtcggcggtggtgaccgggtcatcaggtggctggctgccattggtgacctcagtggctttcggcagcacgcaggaagcggtttggcagtgaagagttcatcctctgtattgccagcttgacctgcggggtggtagactgagcttgggtgttgaagggatggcatggtggtccggcgatggtcgttgtgcaggatagttgtgtggggttttgatgggaaaccgctggcgaaagccttgccaggccatgggccagcatgacgacggcgacgccatttggcgccgttcccctccttggaggtgtcgtcctggcgttgacccctcataacaccaagaaccctctgcgcgcaatggtagccttggtggactcctgcaatgtccccgaagctcttcaggtctagggtgtttgacgaggcctcacttccttggcttcgttccttgctacagcgggtgttcatcactcttatctggttactgtggggtagtgtcggagctgctttgctggggacgaagcttggcaacgatgacacactgcaatctctttataggattgctgatgctagctgtgtgtaggagtggttccttggtagcttgggctgatgtccttcgtgggtgtcgttcttgtttgttcattttggcgttaggat

SEQ ID NO: 89183 - DNA, 1269 bp, Oryza sativa
tgttccgcctgtgtagccaaccttcgtactggataaccatgggtgtaagtctactcttcttttacgatacaatcgtcgtaaatcatgatttattactgcagcctaaccttacgcttcctcaaaccatctggtgaaaccatcttcttgcagctgattgttgcggtaggaatgggcccggtgctggctttgagatacttcaggaacatgtttcgacctaatgccatcaacatacttcagcaaatcgagcaatccaatggacatacccataccaccagaaatatggagtcacggatcatatctgctggcagttatctcacccatttactagccgattcgcgtcgcaacaggggcgctacctatcagcctcttctttcagattctgtagcatctgacggatgatctgctgcacctatcagcatcagaccttggcagcttgcgttaactgtatctcttaccagtgcaatatgctagcatgcacacccatagtctctaacagcaataggatttactgatcacacaaaattctgagagtcaaagcacagaagaaagtttcgcaggttcattgcaaaaatgctgcaatgcctggaattcaggaaaaaaaatacatgtgttccaaattatcccagatgtatagttttgctgttaaaacagaagtatatatggctgttttggtttgatggcaattattgccctaccaattatttggtacttcgttcgtcccaaaatataaagcttctagtattcagaatttgtcctaaaatataacaacttctccatttacattctcttattaaccaataacaatctcgcaccatttaacttcacctagtttcttcctcaaccaattataacattatcctatttaattccatctactttcttaatacccgtgttcaagtttaaacttcttacaccaaaactatacaccaaatggttactagataaccatttggatcggatctaagttcgccaattctacagggttggggcaaatcaacccaagaaaacagctactgtgtcgaagcatgtccaaaatttggtgctactaaccttattccttgcattgcataccacattgtcaaaaaaaaaaaaaaacagagagaaaccaacatcatctgttatccaaattgtccaaattcatgtgttccaaattgtcccagttgttttttaagcgtactctattaatacaacatcagaattgtaaaaaaaaaaaaggaactaaaagccagccaaacgaaccaatccgaggcgtcttcgcgggatatgctc

SEQ ID NO: 89184 - DNA, 1744 bp, Oryza sativa
aacatggaactctatgatttcaggttatgttcaaaatgatcagtcttcagaagctctaaaactgtttgcggtcatgtgccgattgtctattgaatgcagtgcttcaacgtttcctgctctactgcatgcatgtgccacaattggtaccatcgagcaaggcaaaatggttcatgctctcctatgcaagactccatttgagtccaatggctatgttgggacagctctagttgatatgtattcaaaatgcggctgtgtgagcgatgcacgggctgcatttagttgcattatgtcacccaatgttgcttcttggacatcactcatcaatgggcttgcacaaaacggccattggatggaagctatagtacaatttgcaaggatgctgaagaacaatgttaaacccaatgagatcacctttttgggcatcctgatggctagtgctcgcgctggtttggttaacaaggggatgagatttttccactctatggaaagctatggagtagttccaactgtggagcattatacgtgtgcagttgatcttcttggtcgagctagacgtgtaagggaagcggagaagttcatctccaaaatgcctataccagcagatggtgtggtgtggggagcccttcttactgcctgttggtacacaatggacttggagatgggtgagaaagttgctgaaaagctgttctacatgggcacgaagcacatatctgcctatgtcgctatgtcaaacatctatgctaagctggggaaatgggaagatgttgtgaaggtaagaacaaggttgaggagtatcaatgcaaaaaaggagccagggtgtagttggattgaggtgaaggatatggttcatgtattccttgtggaagataggaatcatccagagagagaagagatctatctaatgctagaagatttagtttctaatatatcttactctgaaactgatgatgaaacacatggttattatctcgagcctgcatcattagacctccttacttcccagaaaaggctagctaaccaatagtcaataggcaagttgaatggaattaacatttatgtacatatttcattttgcaaggtattctgtacagatgtaacatctcttttggcacaacaattgttagctcattgaatggggcaatcttggaagaaagaacgtattttcgttgtttttttttcatattttcgttgtttcgttgtttttttttcatatttagacatatttcaccctaaacggttcacttgaaacgtttatgtgccagaatccacagtcatctcaatcgtttttaatgtcttgggatagaaatgattcatctttttagtggtttgtgcacaaagaacaaaatgaaattgttttcacacctaataggtgtagaagaatatccatatatggtatatgatggtgcaaacatgtgtcgttgaattattttgtagcttttttcttcaattcggacgatatgcaaaaagacaagtgttgtccagacttgaatttatatttgttttcggattctaccgatatagtttagctatgcatatttatagaatgatctaatatatattgatatttttttatcatacttctttgctatttagatgtgttaacgaccaaatttggtaaattatgcattggatttggggttaaggctgaagcagatttggaaggaaatcaataacagagacagagcaaaaatcggcttcgggactgcatcggctacggtgtgcatcggcagataccgaatcggac

SEQ ID NO: 89185 - DNA, 904 bp, Oryza sativa
tgcggtgacgcccccgccctcgccatcgagctcttcaagcggatggaccgatgggcctgcccccgccactctcctcccaccatccacacctacaacatcctcatcgactgctaccgccgcgtgcaccgccccgacctagggctcgccatcgtcggccgcttgctcaagaacggcctggggccggatgatttctcgtactcgctcatctacggtttcgttaaggatggggaggtggacaaagctcactgcttgttccttgagatgatggagcagggcgtattgccgaagatactgatttgtaactcaattatcaaagagctttgcaagatgaaggaaatggacaaggccgagagcattgtgcagaagatggtcgattcgggtattgcaccggacttgtttacttatagcttgattattgacgggctgtgcaagtcaaaggcaatggacaaggctgagagggttttggagcagatggttgaggctggtactcgacctaacagtataacatacaatagcttaatccatggatattccatttcggggatgtggaacgaatcggttagagtgttcaaacaaatgtcaagttgtggtgtcatcccgactgttgataattgcaactcattcattcacgctctcttcaaacacggtagaaccaacgaagcaaaatgtatttttgactcaatggttctgaagggccccaaacctgatattatctcctactctacgatgcttcatgggtatgctactgctactgacagttgtttggctgatgtgcataatatcttcaatttgatgctaactaaaggtattgcacccaacaaacatgttttcaacatactgattaatgcatatgctcgttgtgggatgatggataaggctatgcttatatttgaagacatgcaga

SEQ ID NO: 89186 - DNA, 1790 bp, Oryza sativa
atctcagactgatttttgctttcatttcactattttctatttctacagagatttctttcaacggttctaagttctattatgatttgttggatattttggagtttacttccgatcgcaaaagaatgtctgctgtggtaaaggatgtccagagtgggaagatccttcttctttctaaaggagctgatgaagctattcttcctcgttgccatcaaggtacatggtataacagggaaaactgcatcgtgtttatgtgatatcatgcatgtacacccctccagagtaattaatccatttcgcttgaatataaatacattcttaggtgtcattttctgaatttaattatctcgaggcaagagtaattatgcttgttctaactcgaaacctgtcttctggtagataaagatccctccagaattttaaatggaacagcttccttgttctgatactgatggaactaattaattaaacagaatatcgctcttaggaaatatatatatatatgagtaatgtcttagttctattcatactataaaaaattatagtccatataatcctgtgatgtaaggcagtaatgcatctttatgtggatcaacttatctattacaaacatgggatatacctattgcataccttgactagggaaaatattaccaaccttttaaatttgggcatcaaactaaattggaaaattcccaaactttttggaggcagtcatttatgtaatgtaccatcagatttcaagtctaaacatgatcagtactaatggacactaaaggtaagatgtgctgctaatttagttagcgtttttctccatatgtcacaggacagcaaattagaacctatcttgagacagtagaaatgtattctcagttgggcttgcgaacattatgtttgggatggcgtgaattagaagaagatgaatacaaagattggtccaaaacatttcaagatgctagctgctccttggagaacagggaggtaagttgttgagcctgaccttggctattatttattgtttaactattttctgtatcttttgttgttcacactgttatctcaccaactttaactactgtattcttagctaaatattgcaatgcttcatcatatgtagcgtaaaattgccgaagtatgtcaccgtttagagcaagatcttcaaattcttggtgttagtgccatagaagaccgtctccaggtattcacgaccttccatttttcttagaataagtagaattacttgttgcaattgttatcattgcattcttgcacctctaatagagtcttgtggctagcaggatggtgtgccggaaaccattaaattgctaaagagtgccggaatcaatgtgtggatgctaactggtgataagcaacacacagcaattcagattggacttctttgtaatctcatagcacctggtactgcattgtcactagaaatttgatatgcattaaaattgagcatgctgtataggctactactccattaaaatgcattatcctgtaaaacgacaactgtttcccgactttgcttgcatcatttgtttttaatggcactttttttgtttgggttgttatttattagttcttgtactcacctgttcaagaattagagcttcatctaggtggatatttaatcccttagtccattatcttctttttttttagtataaaatgatttcatttctactgtatggtgctcaagtgctggtctcttgggttacagctagaagagaccagggtacctgttctcttggatatgtcaaaatgattaataaaaatgttcatcttat

SEQ ID NO: 89187 - DNA, 654 bp, Oryza sativa
cattttacttttagaactgtagatctaatttaattattgtgaagttatgtaggatgataaaatctatattattattattattattattattattattattattattattattaggaaaaagtacgaattaccccccgaactattacgatcgtccgaattaccccctgaaccacaaaaccgaacattcttcactcctaactatgcaaaccggacgaattacccccttctacccaatccgcggtggttttggtctacgtggcgtacgcgtggcagtctagtcagcattttatttattaaaaaatgtgggacccacttgtcatagtctctcatctctctctcctctctctctctcactctctgtctctctcactcatcctctctcgcgcgcaggacaagcggcagcggcggcgcacacggcgggcggcggcgcgggataagtggtgggcaggggcccgtgggtcaagcggcaacggcggcgcgcacagtgggcggcggcacgagacgggcggcgggcaggggctggcaggccgacggtcggcgcgaaccgcacggacgaccgcgctcatggcggctcggggacgggcaggcaggctgtcggcgcggatgattgcgctcatggcggcgcggggacgggcgggggcgggtgggtgggcc

SEQ ID NO: 89188 - DNA, 1042 bp, Oryza sativa
cagcagcgctcccgtcacgccgccgctctcgtcgccgacggtgtcgcagccgccaaagatcaggaagctggactgggacgtcgaccccttctagcaccccttcttcgcggtctccgcgccggcgagcccgacccgcggccgccgccttgagcacccggacacgataccggagtgcgacgagtccgacgtctcgacggtggactccggccggtggttcagcttccagatggccaccacggcgctgacgtcccgcacctacaacctcgtcaacccggcctggtggattgggaaatttcagggtgaagtcttcgattcgagtccttcccgtgcatgcaagaaagggcgatgtgccgtgaggagatccctcagctttgagcatccatggggttcctcaaccttgtgggcaactccattgggtgctcggcttccggcgagcggctcgtctcggcggacagggacggcgacctgcaggaggcgcgcgcgctgctcgagtacaacccgcggctcgcctggtactccactttcggtggccgcaactcgccgctgcactacgccgccgcgcagggtcaccatgaggtgatgccatttgtctgccaaactagctgaagtatcagtgtttctgtatagatgggtaaaagaactgcaatactgcattcacattttctgttgcttgcatgttcagattgtttctctgttgctcgaatccgaagtcgagatcaacctcaggaattacaggggccaggtaaaccaagatttatggtacatttaattgtttaagtttcacttgcgaaattcgacaaggggagggtgatgccatgggagggcgagaggaggtggcgtggactggggcgaaggacggcggccgcacaggaggacatgtgtggagagggagatgacttgtggggccggatgtaggtggcgacgtaggtgtcggagtggccgtcgaacacggcgaagaggccgacctcgttgccgtcctttaggcggcgaaactcggcggcgacctcctcctctggccacctccgccgcccgcgccctgccg

SEQ ID NO: 89189 - DNA, 1838 bp, Oryza sativa
cttgcctgtgtggcaataattaagtttaatatatatacaattactttagtttcagtattgcctagagctaggagttggactttttgctactgggatagataaaattaagtaaaaaaataataatcttttttgtaccgaaagtgtgagcactaactgcggtggttagtctatgcagccagtagtaattttgaccgtaatgcatgtaagctactagtagtactcctaagttaagctcccagtggtccaagaggatataataataattgattagttaataatctgagaggctcttgctctgtacttaaactaatcaaaccggctaatcaattgcaaggtcctggtggtttaggtggtgcgcacgattattttagttgccccaattattgccacggtagtgatgccaccgccggtggtcaaatttgggttgaattttaaatttggttgataacttttcttacctttttaaaatttattgctgagtttttttctagatgattgtttattgtttttgttttgttaattagttagcaaataaatgtgaatgttgcggtgtgcagatcaccggcaaggctctcatgctggacgagatcatcaactatgtgcagtcgctgcagcgtcaggtcgaggtaccaatgcaagcatttgctttaatagtgtgctaaatgaacttgttttaatgacaataaatatgttggagaaaaatgttgttgtgttctccttctgtcgtcctagctagctcttatttgaagttatgtatgaaattaagcccaaaagctaaattttgacattggtgtgtctcacagtttttgtccatgaagttggcgaccatgaatcctcagctggactttgacagccattacatgccttccaaagatgtaagtatagcatctgaaaacacttttatctgatctagagagacagttgacacagagtactattacgatattgtccctcaatttgcaaatgttatattcgccgcactcggggtatcattttcagatgagccatatgccagtacccgcatacccgtcaagcgatccgaccaccaccaccgcgttctcctacaccggctcacccgccactgctgatccattcaccgtctacaactgctgggagctcgacctccacaccgctatgcaaatgggagccaccaccggactcagccaagacggtccaatcgcaacgatggcaccctctccctcgccattgccgcaccatcctcctcttcacggcttctacggtaagtgaaatcgaaccaccacatctccttacatccctaacaaattatacatgaatttttaaaaatactcaattttttttttaaaaaaagttcaaaaataagattattttttttactggactacagtagtggagtggtggtggtcatactactccagtacggtaggtttgtttgtccaagtttgttgagtttcgctgttggtggtaattgggcgcaggggggcagcagcagcaggggacgacagtaaaccacatgaaggccgagccataataaatgcggcgacctctccttctgtacatacgcccagccgccgtacgtgtactccgcttttctgctcccatcctgcagcatcagcatcaccagcagcagcaaacccaagctcacaatcattgccatcaaagaagaaagaagaggatgttgtgtgtgactgtgtgtgtggctttgatcatggctttggcttgatcctacaaaagccactatctttttttccgcttttctacccctctgccgtctgtcactgcaggtggggcccagctgcacagggaaggagaaggttttccaaggcttaactttttccagatgcagtgtcatattgttt

SEQ ID NO: 89190 - DNA, 679 bp, Oryza sativa
ccaaatccagcaatgatgctgcaagacgtgttctagacttcatgcttggatggtattctttgtctcacacataatttcatcattatgagagtgaatattctaactatgaaatcccttctaggtttatggatcctctcattagaggagactacccactaagcatgagagaattggttggaaatcgcttgccagagttcagcaaagagcaatctgaaatggtcaagggtgcattcgattttattggactcaactactacgcttcaagctatgctgataaagtactatgccgtttgccctttcgacttgtccgttgctttgagggtgagagaccgaggtgaagcatatcttgactcccagcccgatgcagtaatcctggaaatcggcgctgatgaactgagagccgttgtcggttatgatgcggtgcggtagtccgtatctgcagaatatccccttgatgaatttgatggcgttgtcggccttgatttcccccgtgggtactgctttgatccacttagtgaatttgtctatcaccacgaataggaacctgtagccgccctgtcctcgtgggaatggcccgagtatattttacccccagcatcgagaacggccaagttaagagggatagtctggagcgcttgctcgggtagctttgtgtgcttactgtggaattgacaggctt

SEQ ID NO: 89191 - DNA, 1537 bp, Oryza sativa
aggggaggggaagaggaaagagagaggggcaagacaacctcgtacttctgcttccttgaaatctagaatcccaggtggaggttgatgtggtcaaaagggatgatggcggcgttcctcaggggagctatgtgcaggacccgggttagatggctggagggctggaggtagcgtggatgtaccagtagagggctggaggcagcgtgatcgtggatgctagggaggagaataacaaggagcaggaggaggcgggggcggcgtcgatgaccgcagaagcagccacacccacccacccctcatcctcccagtcccagatctagcgcggcggcgagctgctgcgtgctggtggtggtgggcgagagcgtagccgaatccatggcggcgctagggtttaggcgactgagcagtggttggggaatcggatcttggaagggagttgagtgcggattgcgaaggggaaccggggaatcgcttgaggggagggggaatggatggatcgctcggggtggggagagaacgggaagatgagatagcggcgcggaggccgtcttgcggtcgacgtcggaggaggccctctcactgcgcctgccctcccgccggatctggcggaggggagggcgtggttgccgctgccgcctttgctggccagccgccgaccgtgggcaggcgccatgagacggcttgagaaaagggagggagagagacagcgagagagagagagagagagagcgttgggagagagccgcgagaggtcgagaggggaggggctcggctgaggtggtgggaatggaggtgcagttcccggccgttcccggagaaggacgacgacggcgtggtaggcggcggcgtgagtgtggggaaagagaaggtgaaggagatggtgatgagcagcggcggccgcggcggcgggtgggaggaggaggaggaggaggaggaaggggacggtggtggcggcggagtggatactgtggatggagtttaggctagggtttggagaacaaggtatatatggataagaagcattccgacgcgaatttaccaaactgtccctggtgtgttctcagtagttacaaaattgtatggtcaaaatgggcatttcaccttaaattaatgagaactttaaatttaattttaggctgatttttatgtttcaaatgcaaaaatcataaacaataaaattgtaggactcatcgagatctacaactattgtattgctcctttttacaaataagttcatttgaacaattcaaattttgaattttcaaaatttgacaacttcaaacaaaaattgggttaataaatgatttcaaatggaaaagttgtcagaaccaaagttgtagaactcatcgagatgcaaaatttttattttggtcatttctccgtctgactctatttgaatagtttgaaatttaaaattcaaagtttgagaacttcaaatagaattttttattagtgaacgacttcaacttaaaaagtcatcaacaacaaatttgtataatccatctagatctataatttttattttggtgggctgcaggaa

SEQ ID NO: 89192 - DNA, 526 bp, Oryza sativa
gttgttccggccctcggtacagagtgacagtgcgtctcgcgcaatccactactccttggaattgagccaaccaattcatcctaaggatcacatccaagttcttggtgtctagaagaatcagatccgagggaaaaggaatcccctgaatttctatagggacggcagggctataatactttgctgtcataacccctccaggggtggtgatgagcagagggttcctaagcctttctacccccaactgttttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgattgacattgctggcgcctcggctttgggcatttatccgcaaagtgcccgggctcgaagcagttgaagcacagacgctgcggaccttgagc

SEQ ID NO: 89193 - DNA, 3671 bp, Oryza sativa
  unsure (1)..(3671): unsure at all n locations
ttatttnnattagcgctctcgtgtgatggatgaataggctatgttgaagaggcttgacaggatattgatgaagatgacgatgtcggtgatccagtcaatagcaatgtagcaaccaatgataatgacgaagacgctcatcagcgtttttataataggtcaaccgtgaaggcgaaataacaagccggcaatgacggaagcaactggaggcgaagacgtagtcatccattagcaacggcagagatgtcagggccgatgaagtagaggtgctgatgatgaagtcagtgataataatccatcaaactgttgagaagatataaagctcgagtagtttccttgatgcgagcgtgtatgcataaagaagactgatgcaacgcttcttgatttatgaagatggcaataaaatttaatgttgtagctgttggagatgcttcacttgaaggaaagtagatgatgttgtccaacttgtcgaaactaagttgattggttgatgactccaaactcccagacatgtaaatttaatcttgacctactgctctaaagcgaagacaaaattgatgactcccagagttgactcgttggctgattaattgattaattcatcttgacataaagcttgtcgaattttgagccatgtatttgtgtagcccccgactctttgattagttgggaaacaactgaacatagagtcgagaactttagcttcttgtcgtcgaatagtcattgcttgattgaagatggaaaatgctacacatacgatctttttagtacgatcttgttacgataagacgcaacggcacggacggcaacggcaaaacagcacgcacggcgcgcgcggcagtctaagcgtacttatgggccctaaagcccaatttacctctaaacctgactttacgttcactacaccaaaccctaaatctgactttcatgttctgatctaacctgcaagtgtgaaactaatccaatagcatacgcatcgaagacaaaggtatggcatcttatttacttgattttctttagcttcacaatcatctttttttttttacattattctctctttcttttttttcctaggcaatgttcatggccatgaaatgctttctttattattatggatttaatctaaaattttcctttgcaaaacatatgccattatttttaatttaatctgaaactagggttaatgttatcactgtccaaggttcgaggaacatatttgtatgcgtaatttgcttaaccatgccacatgataaattcaatgttgggtgctaagtacaattcttatatacagtaagatattaggaagaggattgcttaagatatgattgaaataaaaattgcttgggttggctcattggctgtccaagcaagccaaccagatagcaggccaggacgtcaggagcttgggcttggatatgggatcaactaaggcctgagggatccgtttgatcgtacaaccatcgtacgaaataattcgtacgtatagcagcgctgattgaagatatgtgttgaagatgtccaagtagaaatcctgaatattggagagccacttgttgtagtaaaataacacggcatcgcatgccgagatgtcgaggttcacaaagacgtcgtggttggtgaagtagcaaaacttgcgaagtagcagcaatagagtttgccggtgccgaagataataaagatgaagttgctccaccatgatgacaaagttggatagccgtgatgaagtgaacacgagtcagcagcaacagaagcaaacagcgatgacgatgatgccagtcaatgatgacgaagtcgcgcagccgtggaggtgaacgagccagtcggcgtcagacaaggcggccagcaatgaaaacgatgacgtccatcagtagtggtagcagtataaaccagcagtcggcagcagacgtagacagcttgcgttgaaggtgatgacgcctatttgcagtggcggagacgtggccagtcgtgaagacgatagcaccagttggcgtcatacgaggtggccggtcgaagaagatgtagatgtcctacaacggcggcataataaaccagccctgcaggcggagacaccagtcggcggcagcgaaggcaagccggtcggtgaaagcgtagacgcccaacaaacggcggcataataggccagccgtgcaggcagagacaccagtcggcggcggcgaaggcaatccggtcggtgaagacgtagacgcccaacaaacggcggcataataggccggccatgcaggcaggaataccagtcggcggcggcgaaggcaagccggtcggtgaagatgtagacgcccaacaacggtggtgtgaccacttaaccgtataggcgaggacaccagtcggtggcgacgacggcaagccggtggtgatgttctaactaatccattcctgaagcgtaggagataagcttaaagccatgaatcccttctatgcatatctggatctggatcctacagaacaaacatatcggatgagtagtatctgatataaatataatactcgagaaaaattcaagtatttaaaatatttacaaatatgtatttctcctcttgtcaattttgatttccccgagcggatgactccttacgtttaaatactctgcccgactagtcatagtccccaagcatcgggagtcggccaaagcacttcccagacatgcatatgagtgacatgagttcgtcattaatggaacaaagtttcacagatcggagtttactactcgggtacttttgcaattgtaaagagcagaaaataaatttatcttatctttatgcttttgatttattccgaataatacttagcaccttgcgttactcggtccatccaacgagcccccgggtgctaggaatcggcccaaaggcaactatccatcgacaaaccaaacggagaacataggaagataaaactccataactcgataggcacatttgtactcagattatatcgcaagcaatcaagataaatattatgaaaattgttgaaaatatgatataacatctgtagcccccgactcactagtcaacggtgaaccagttaatgtagtgaggcagaggaaaaggaaaatatcatataagaaaaaatgatgagttagctttttagtattcccttggtgatggcagaagtagccgatgtgggatcgaagtagtccatcaatggtgacaaaaacaccagttggcgccagtggaaccaagccggtggtgtcgatgatgaggcccattaacagcggcggagtccggcaaccgtataggcgaaaacaccagtcggcggcggcgaaggcaagcccggtcgtgaagaggtagacgcccaacaacgggggcataataagccagccgtgcaggcggaaacaccagtccgcggcggacgaggcggccggtcggtggaaaggtagacgcccaacaacggcggcataataggccagccgtgcaggcggaaacaccagtcggcggcgaacgaggcggccggtcgatgacgaggtagacgcccaacaacgacggcataataggccagccgtgcaggcggaaacaccagtcagcggcggacgaggcggccggtcgatgaaaaggtagaagcccttcaacgccggcactaataggccagttgtgcagncgnaaacaccagtcnnannnnnnnaggggnntgcgagntgacntaaggttcatggacatggg

SEQ ID NO: 89194 - DNA, 1807 bp, Oryza sativa
  unsure (1)..(1807): unsure at all n locations
aaaaagggtggagaccccccgcccttcccttaaaaaccccctgtgttacgcgaggtgctttatacataaagaaggcccactaagccctccccagtgtttcttaatttccttgggaagccaaaaaaccaaggggtccaagtagccacaaaggtcacaaaacccagtggggacagggaccaagcgggtgtttaataatggggccatttcaggggggagtcggcaccgtatagcgaaaacacagttggggcggggaagcaaccggttggtaaaagttaacccccaccacgccggcataatagccaacctgcagcggaaccacagtcgcggcggacaaggggcccggtcgttaaaaagtancggccaacaacgcgggcataatgggcaacccgtgaagcggaaacaccagtcggcggcggacgagcgggcggtcgatgacaggtagacgcccaacacggcggcataataggccagccgtgcaggcggaaacaccagtcagcgcgggacgaggcggccggtcgatgactaggtagacgcccaacaacggcggcataataggccagttgtgcaggcggaaacaccagtcggcggcggacgagacggccggtcggtgaagaggtagacgcccaacaatggtgccaaataggccagccgtgcaggcggaaacactagtcggcggcggacgaggcggccggtcggtgaagacgtagacgcccaacaacgatggcaaataggccagccatgcaggcggaaacaccagtcggcggcggacgaggcggccagtcggtgaagacgtagacgccaacaacggcagcataataggccagccatgcaggcgaaaacaccactcggcaagagtagtgccgcggcgttacatgcaaacagcagaaaatacccagagattaatttgatatttagagatcaatctaatgaaaaaaacaataagtcgtaagggaaaaaaacccagcgaagtcggagattaaattgttgaactcggcaagattattggtcttcctggatgcgtgcatgtcattggatccatcctcctgccatgcgtgtgtacagatcgcggacccgagtctggatcaaatcccagtcggaggcttcgcgcgtggtcttaactcagaaaagtccgataccacaacgcaatacgacagctccgataacacatgcatgtaaacaaatcaatctgattagcagagaaattaatgcatatatgtagttggttatgagagcaagtaagcaagttaatttatttgctcccctccatgcatggcctgcatgctcctgtgtgcacctttggtcgtcccatgcaggttctagtccgtggcatgtcaactgaatcagcacatgcgtgtgtttgctcctgatgcccggctttcctctgcccacctaaggcacgggcactccgcgtgggaagaaagggaaaagctcttcggcaccggtacgcccgagtggatgaccatgataatgaacacccctttgtctcaaccgcctgggaaaacacaccaacccctgcagtcaaacacgcttaaaagttatctaataaaaaatannnnnnnnnnnnnnnnnnnnnnnnnnnnnnnnnnnnnntgtatcccagtcgcgaccaccttgaggataagtgagtatttcatacgcaccctaatagcttggcgaaatatgggatagcttgtcctgcgggaatggtattcgctacacatccccacatacaacgcgaacttaaagaaaacccggtgcctaggagagctatcacatatgcgtggctcacggccctttcaacggaaactgtcgcccctcttaagaaccg

SEQ ID NO: 89195 - DNA, 521 bp, Oryza sativa
tccctatagaaattcaggggattccttttccctcggatctgattcttctagacaccaagaacttggatgtgatccttaggatgaattggttggctcaattccaaggagtagtggattgcgcgagacgcactgtcactctgtaccgagggccggaacaaccggttgttttctttgcacccccaacctctgtcagtagttcagaacttcatcagataggactgtcagaaatccccatcgtcagagagttcggagacgtgtttccggaagaactacccggtatgccgcccaagcgagagattgagttccggatagatcttgctccaggaaccactcctttgtacaagcgaccctaccgtatggcagcaaatgaactggccgaagtcaagaaacagttggaagagttgaaataaaaggggtatatacgttcgagtagttccccctggggtgctcctgtgatttttgtggagaagaaagacaagatgaagaggatgtgcgttgactacagagctctcaatgaagtc

SEQ ID NO: 89196 - DNA, 1058 bp, Oryza sativa
gcatgggcccgcaccacaatcctgtggcgggaaggtttacaaaaaacccaatagatctcttgaaagtacccggaaaattaaacccggcaaggaacccagcttttctttaagagttggaaaggcttcctggcatgcggggttccacacaatattctcttctttcttcaaccaattgtttcctggttagaacaatttttgaaaaagttctcgattaactccggtaagtatcttgcaaaacataagaacttccgacctggagtgactgtcttgggttctttcaatcaagtgccgcgggtcactgttcgggggtccacggcacttccttaagcagatatcacgtgtcataagaatttgacttcgaacaccaagaattcacacttgctaagtttggcatacaattgatgttcccgcacttttcccaacaccagacgaagatggtgctgatggtcttcctcggattgtgagtatatcagaatgtcatcaatgaaaaccaccacaaacttatccaagtattccatgaacactttgttcattaagttcatgaagaaggcaggtgcattggttaaaccgaacgacatcactgtgaattcatacagtccgtatcgcgtggtgaatgcggtcttaggaatgtcttcttcacgaatacgtaattggtgatatccggaacgaagatcaatcttggagaatacagtggcacctttaagctgatcgaacatatcatcgatacggggaagagggtacttgtttttgatggtgacttcattgagagctctgtagtcaacgcacatcctcttcatcttgtctttcttctccacaaaaatcacaggagcaccccagggggaactactcgaacgtatataccccttttatttcaactcttccaactgtttcttgacttcggccagttcatttgctgccatacggtagggtcgcttgtacaaaggagtggttcctggagcaagatctatccggaactcaatctctcgcttgggcggcataccgggtagttcttccggaaacacgtctccgaactctctgacgatggggatttctgacag

SEQ ID NO: 89197 - DNA, 1456 bp, Oryza sativa
cgcgcggaacaaagagaggctaccccaaaaggaaaaggttccgggcatcaaaggcggtggaacggaatttgggagcaaggagggaaaaaaaaaataaagcggcaaagttttatttccaacgggaaaagaaaatcggcaatgtgcggaacaggttgaaggtaggcaccggaaaggttttaaaaatttttggaagggaaggaaaaaggaatccccttaatttctatagggccggcaggaattataatactttgttgtcataacccctccaggggtggttatgaagcagagggtttcttaagcttttctatcccaaactgattcctccccacgaatggcacaaatataaacgagtgggaagctccagaagtcgaacaaaaatggtagcaggaatgaaatgaatgaggaacgtaccaccgatgacgtctggagttgtcagcacgtcctcggccgtcacatggttcacccatccccgaatgacatccttcccaccgttgttggagcggggaggcgcttggccttgctgacgcctcggctttgggcatttatccgcaaagtgcccgggctcgaagcagttgaagcacagatgctgcggacctgaagcgtccctgcggccttggccaggctgcacagttggcgtaggaggacgaggcgcacgagtcccttgctgactctgctgttgctgcggttgtgggacgcgcaccacgaattgaggtcgaggcgcggagcgaggttgctgctgttattgttgctgctgcgaggaggatccccctggatagggattggtgtagcggaccctttggttagcaccctgttggttgcggcaattcgccaagcggcgcttgtgcgactccagttccttgtgcttggcttccaagcggatgctcttgtccaccagacgttggaaatccggatagtccccggagactagacggacggacagctcagggtccattcttgccaagtacttctcttgcttctcctcatcttcccgcacatcctccggggcgtaacgggccaggttgttgactcatgcaaatactccatcacggagcggttgccttgcttcaactctcagaattctcttttcttaagggccacgactccggcgggcacatgggttctcccgaaagggcggtgaaacgggcccaagtaataggttgcccctcttggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatcctggggttgttggagctaaaaaaagaagtggggcgattccgaggaactccgccaggtatatgttgtggggggtgtgtggaacaataagttttgcggattttggattggggagggaagcatcattattttgccctgttggcaaggattg

SEQ ID NO: 89198 - DNA, 1164 bp, Oryza sativa
tttgaacctgatttgcatgtatgggaaagcgcgtggcgacggtacagaaagacggtcgaagagtggaatttacagctacctcagtcaccgatctcaaaaagtatattgctgaccttgaatctcaggttggtaccacatcacgacgccaggggcctgcaaggttttacgtatgaaaataccatctttagtgggtcctgacgggaaaacatccctccgggaatacgcggggtatcatggcggcggcggagggtttggtggtcagttgcggggctggaatccaccaagcgaaagtgctgatgcggctcttctgcctaacttctcgcgcggaaatgcccgtgctgacgatctggtcagaaataatggctatgcggcaaacgccgtgcagctccaccaggaccacatcgtcgggtcatttttcagactcagctatcgaccgagctggcgctatcttggcatcaatgaggaggattcacgcgcattttcgcgggatgtagaagccgcctggaacgagtatgccgaggacgacttttgcgggattgatgccgagcgtaagcgaacgtttacgatgatgatccgagaaggtgtggccatgcacgcgtttaacggtgaattatgcacgcaggcgacctgggacagcgattcaacgcgtcttttccgtactcagttcaaaatggtcagtccgaagcgcgtcagcaatccgaataatatcggtgatacccggaactgtcgcgccggtgtgaaaataaatgatagcggtgctgcgctgggatattacgtcagcgacgatggttatcccggctggatggcgcagaactggacctacattcctcgcgaactaccccgcggtcgaccttcatttatccatgtattcgaaccgatggaggatggacagacccgtggggccaatgcgttttacagcgtgatggagcagatgaaaatgctcgataccctgcaaaatacccagctcacagcgcgattatgaagcttggttgtcgttcccaatcggaggaactggttaccataccgggatggacttttatttccggccggataataagagacacggagcaaattatcgggttggttggggaaagaggcctatatttaaattgccttggttcctggtggggcaaagttctccaactcgtttcgggggtatctctt

SEQ ID NO: 89199 - DNA, 1610 bp, Oryza sativa
  unsure (1)..(1610): unsure at all n locations
tatgatgatgtgatgcaattgatccatgagctcctccctgctgggtcaaagttggatgataacttctatcgttcaaagaaaactcttgctggcatagggatgccatatgaaaaaatttatgtgtgctacaacaattgcatgctttactacaaagacaatgccgagaaagttagatgtgactttttcaaaacatctcggtatgagaatgacaatagcaaagttccacgtaaggttctaaggtatctccctatcatacctagactgcaaaggttgtatagtaatgaagagatagcagtccaaatgagatggcacaaagaacaccctacacataagctaaatgtgatgatgcacccacgtgatggtgaagcatggattcaatttgatgtagatttttctacttttgcacaagatccaagaaatgtccggcttggtctagctatagatggattcacacctttcaacatgactgctgcgtcatactcctgttggcctgtctttatagtaccatacaatctcccaccagacatttgcatgaaaccagagaacataatgcttgcccttgttatccctggtcctcaacatcctggaaagaacttgagcacactattggaacctttggtggatgagttacttcagatatgggatgatgtaaccacatgggatgcttcgaagaaggaaaacttgactatgagagcagcatatctttggtcgatccatggctttcgtgcttatggtgattttgcaggttggagcaccaatggtaacttagcatgcccaacatgtatgtgtgagtcaaaagcattcaggctccataatggagggaaaagttgttggtttgattgccattgatgcttccttccaagtgaccatgagtttcggactcaagcaaatgcatttcgaaagaacacaacagtacaccactgttagaatttcaatggttactctcattgagaagaggatggcacttagaatggggcaattttctggttttcttcattcacaaactcaaaagccatatcctcccaaagaggattggatacatatttatagctgcttgtagcagccatgctagggcaagtgggtgctgtcctagagcatcccaacaaactgtcctagagcatctcaacaaactgctgtcctagctgtcctagagcatccaaactgaaagtacaaatgctgtcctagagctaaaaagcaagaaaaagcaccacaagaccaagaccaagacttattcatacattctccccctaagtcttgtgcgccgtcttgtgggaaagttgagccatcccgatccgggagcaaacctcaaggaacttgatcctcccaaggggcttggtgagcaaatccgcaagctggtccttggtgttgatgtagctcgccttgatgctcccttcctccaagtagcttcggatgaagtgatacctcacccggatgtgcttgctccgttcgtgaaaaccagggttctttaccagggctagagcggacttgctatccaccctgagctccaccgctccaatgtctctgccgaggagatcactaagcagtagagcaagccagagcgcctgggtcgaagcgncggagcagccggcactcacgggcgatcatccgcg

SEQ ID NO: 89200 - DNA, 1232 bp, Oryza sativa
  unsure (1)..(1232): unsure at all n locations
cgctgacaccctttgatgatcgccaaattcaaggctcaagtactctccaccacgatcagatcatagatacttgattgtcttgcccaaatgattttgtacctcattctaaaatttcttgaacttttcaaaggactcagacttatgcctcattaagtagacataaccatatctactaaagtcatcagtaaaggtaataaagttttattatttttccgggtcgaattgccatgtaagcgccatgtcaatgccacgtcaaacaaagaccgagtcaaattagccacgtaggcgccacgtcagccaaaactgctctcaaaaccgctgaggaacataatctgcaccggttttaatagttgagggacccgttgtgtctggttttctgatcgagggacgaaaatcggattcggtgtaaagttaagggacctcagatgaacttattcctcataactaactatgaattccaagttctatgattcatgatccaaatgggcttcaaatttacaatgaaacaaccaagcatcaaaatacactgtaatgcctgcaaaaactgacagccgaatgacaccagggataaatttatacacaactactccatgagacggaagaagcttttagctgccaggcaagaataagcgccttctttctttgcaacccatgggcttctagaggaagccataatcataatcaatttcagcagcaattggaggcgatgtatggaccctcttggagtacagataagtcattttcagtaaggacaacaagctatcagctcaaagctttgctgtttagcgtgatgttgagtatgccgataggggtttttggcttgtaatgctcatcaatatcaacttcttcgatctcctgttaagtcatcaaacaagcaaaaagtctcattaaaatgacatactcagaaaatctaattcaccaggtgaagcacatgcgtctggatcacttgagaatatgacacttgaatagctatattctttcatttggccacctattaaaccatgtctactcttcaaatcctcatgcatagcactactgaactcanaataggnnccatttgtacaatctaatatgaggtaggcatgacacttcactgaaaatttgttttggaaaagttttatttattaaaaatgaagttcctgttgttgaactgccttataaagcttcgaggaattaagtaaaccctgcaatattgcttgtaattgccaaaacacaatgtttcacaggaatgg

SEQ ID NO: 89201 - DNA, 1341 bp, Oryza sativa
  unsure (1)..(1341): unsure at all n locations
aaaaaacaataagggtgttttccataggccgggacagggggaccaacgggggggttgtgctaggacactccaaggtttttcataggctttaggcccacaaccgaatcccatcgattttgggtaagagcccctgaatagctataaaaataccttgaactactgaaaaaatctaggaatttgttcttagtttatgaagcccagaaagcgctcattgtaattggttccattgacgcaagcttccaanccgacaaagattgattttagttcgcagtcggaatttgtgttcgccttgaatgaagccgttgtaggttgaaagagttccaagaaagatcaagtggttgatcctccaccagagttggaatacattgcggcttttgaacaaccaaagaggcttgtttgaataaagaaattcgttcctcagctagttgtgatgactagtgcttctagccctatggacctctattgcgatatagtggtgccattgcgcaagccaaggaacctagatcgcatcaaaagttcaaacacatcttacggcggtattacctcattcgcgagatagtgggtagaggagatgtgaagatatgcaaaatacatacggatttgaatgttgcagatccgttgacaaagccactccctcagcctaagcatgaggcacacactagggcaatgggtataagatacgttcatgattgactctagtgcaagtgggagactgttagtgatatgccctagagtcaatcatagagatgattgtatcacatactatgtttacatatttatccgactttgttccttgaaatagataaactcgttattggttaatgaatatgtgattctttcatgagactctttatgttatgtgttgctatttctaaaggatctctgatcaaatatcatatgtggaacaaatatgtttagatgatcagcacatgtattaattgatgatcatgtctcatagatcatggtatagagataccaaattaataatgtggacacatgttagtgaacatgttgttggatagacccaacataagacacggcccgagccatatgagttgtgtcatcagggatctcattgagtgttggagatgaatccttagacctaaaattatcatggttctcaacatgtgtagtagcttacttacggactgataaacgctactccgcaattgcgtagctataaaagtagctttcgggtatgctatgaaacatgtagtgggatatgaaaaatcaagatgggatttgccccttctatggagagatatctctgggcccctcgatggtgcagattatggaagtgcatggccatgccaaaggtgatngangagtcaatcaccaagt

SEQ ID NO: 89202 - DNA, 951 bp, Oryza sativa
  unsure (1)..(951): unsure at all n locations
tagtttgcctgttagatctagccttcgcactcttatgttcatttgtattacttttgctatttatcttcactagaaataaaaattttagatgctctggtgcaaagttgccttattttgtcttttcctggctgtagggacaccctcaatctgccatagaacggaagagacgagcctggtcagaatctgaggatgatgagccagtgcagaggccagtgcaacctagcgcaggcgagaacgatctgagtgattgaattagacggtgaagattatggccgaatttgggatcacttcatatatttgtgacgaagaatggctcctgggatgcggaatcaactatagggcgtgctcatatgcacttgtggataattcgatgttgaaatggagctcagacagatggttgaaccagaagtgttaaaaaaatttatctgggagcagagcagtcactgatattcaacaattaatctcgcgtcattctagacatgccatgggttggtggagctaacataaggcaatttgtaatttatgtctagtttacgcttaatcagccagacttttgtccttggagcttctaacgctgtaccaattttagctcacttacatctcaagatagctgatctcctactttgttctttgctgctaggcaagcgtgccaagaaaagattttcaaaagtagctgatctcctaccttgcaccctaattttttagacacttcngntttgcaggcaactgtacgtgctcattggcaatcgcttataatggcctgctctcgtccaaacaaagtaatggatatatagatctaaagtaacgaatttttcatgcgatttgtttcaaggtgcaccttttggggccaaagattttttgaggactgcatatatggtgcattcatggatttaattgagaacctttgtggtgagttagggagggagaaagagaatggccttcaagcttcaa

SEQ ID NO: 89203 - DNA, 1564 bp, Oryza sativa
gaggcctcattctttatgtggcttggagccatgaaattcgaaatagaatccatgcatgtcaatcaagttcggaactaggtagatccacctgatggtgtaaaagccattgagtgcaaatgggtctttaagaaaaagacagatgtagatggaaatgttcacatctacaaggcacgattggtggcaaaaggtttcagacaaattcaaggtattgattatgatgaaactttctcgccagtcgccatgctaaaatctattcggattgttttagcgattgctgcttatttcgattatgagatatggcaaatggatgtcaaaacagttttcctcaatggaaatcttgatgaggatgtgtacatgacacaacccaagagatttgttgatccacaattagctaaaaagatatgcaaattgcagaaatctatttatgggttgaagcaagcatctcggagttggaatattcgttttaacgaagtagtcaaggcgttgggctttgtcaaaaacgaagaagagccttgtgtatacaagaagattagtgggaacgcactggtatttctaatcctatatgtagatgatatattattgatcgggaatgatattcctatgcttgaatccgttaagacatctttgaaaaacagtttttcaatgtaggacttaggggaagcagcatatattctgggcataaggatctatagagatagatcaaagaggctaattggattaagctagagtacatacattgacaaggtgttgaaaatgttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacatccagatgtttcatatgcacttagtgcaacaagccgataccaatcagatctaggtgagagtcactggatagctgtaaagaatatcctgaactacttgagaagaactaaggatatgttcctagtctatggaggacaggaagagctcattgtaaatggttacactgacgcaagcttccaaaccgacaaagatgattttagatcgcagtctggatttgtgttctgcctgaatggaggcgctgtgagttggaagagttccaagcaagatacagtggctgattctacaacagaagttgaatacattgccgcttctgaagcagcaaaggaggctgtttggataaagaaattcgtttctcagctaggtgtgatgactagtgcttctagccctatggacctctattgcgataatagtggtgccattgcgcaagccaaggaacctagatcgcatcaaaagttcaaacacatcttacggcggtattacctcattcgcgagatagtgggtagaggagatgtgaagatatgcaaaatacatacggatttgaatgttgcagatccgttgacaaagccactccctcagcctaagcatgaggcacacactagggcaatgggtataagatacgttcatgattgactctagtgcaagtgggaga

SEQ ID NO: 89204 - DNA, 3352 bp, Oryza sativa
ggggaaaaaaaccccccccgggggggttttcccccaaaaaccccccaaagggggcccccccccaaacttttaaaaaactttaatcgtggcaatagcagtgcccacttgcagcaataacaaaaaaaatatagtggcgatagaagtggccacctatagccaccaaaccaataagcgtagcaataccgatgcccacctatagcaaccgaaaaaattcaagtggcaatagaggtgcacacttgtagcaaccaaacaattctagtggcaatataggtacccacttgtagcaaccaaatattttgagtggcaatagagggtccaactatagcaagagacatgtgtagcgtggcaatagtgggatctatcagtagcaaccaaaactgtgagcatggcaatagaggtcgacctattaccacgtttgaggcttgttgtaatacacgttttgcaacgcccaaaagcacttattaccacgctttgctgcgatgcgactagttcgtacagtaacgacatatgacgttgcaatacgtttctattaccaccaacccaccattgcattatctgttaaattgccacggtttattcagttgcaaaataagtttttatttgcaacggcaaagtgatcaagtggtaaaaaccctattactatggagttttgcgccatgagccctaacgacaaaaatccgttgcattttctcctattgcaacggttttgggcatattgcaacgaattctagccattgcataagtccgatttcctagtagtgtcctacaacaaattattctccaagcacaagtggaactatattattttgaaataaatatgcattataagcatagctaattctcctttattatagttatattgacggtcgaaattagtctatagcgatcatcaacatacattacctttattctatctcttttgatcaaaatattgtgttagtgactatttctataatattgtctggaaagcttaaaaaaacctaataaatgatattacagccgatgggacatatttagggtttgctttacttaattttcaactcacagccgatctggggaaaccaacataggctagatctactattgatacatcatcggcttatcggccaatcatctatcggttatttaactctgttttcttgatttccttgttggttgtaggataaaaccagctggcatgcccttgacccatgaggcaagccttggacctgaacatgagttaaccagatcgcccaagccgccttgttttccgtcaacaaggttttaacgaggaaacagatgcatcacaatattcaaagtgccatgcactcttttctcccaccttcttttccactgggttttcaggtggagtttttgacgaggcatgtgcataattcaaattcgtccaaggggggagtgttatgaaaactattttgttctggacaaattaagatattagtgaaaagcttactgcagaaggaggcatacattggaagccagcttccaagagaagccaacttatgacgtaagctggcttatgagagaaggcaacttacgacgtaaacggcgtaaaccaagtcagcttgtaggagaagccagcttagagtgtaagccatcaacttcctccgccaataaataggaccctgaaggcactacttggaaaagcattatcgcaagcggccgaaaacggtcttcacaggcggggcggccgtccgcctgtaagccaatgactgtgaagatcgccgatcttcgcaagcggtgcggccgtccgcctgtgaagataatttttgcgggcggacgttggctagtccggtccgcctgctaaaataggaatcggccgcctgcaaaaaaaaaaattccgcctgcgaagtttggtaggaaatattggaatttaataataatttgctcgtaaattacttttaaattatttaatagaaattcttgccggtagattattatgtacatatattggaagattatcaaacatttggtactgataaatgtacatatattacataactcaaaagtgttgccaaaaatattacaatatttttttacattgtcacttcaaatacgccatctaattaatacattatggcatagcactgttccactcccaaagatccttgaattcgtcacttgtggctagggcaccctctgggtcgatgaaatctcctttcacatggtagcactcatggtggatgaaatcgcacagatcacgctgaacatttctgatgcctgtatcttcaacgcttgttcgacgttctaatcttggcatctgcatgcattgaagataaccaatatattagtatcataaatatgtgaagctgtctagcacatagtatagatacttacatcctttgcgttagtcctgtacctcccattaactctaaggaattcgcaagcgtaatacccacaaaggaccgttccttgcggttgcttgtgacacttcaggacatatcataaaaaaatagttaaaatttgtaattagtgaaacaattggtatacattaagtgagtggagtattaccggccaataggtacgtactagtagcttctcccttgttcggtctgttctccacccttgaacttgtagtactggtacgcactgtacggatgtcgtaccgtttcacattaaggaggatatttacttataatacattcatataaaaatgcaagagtcataatcacttactactgtaagattattagaaattctttgtatgactgttgtttttaatcgggagggtccaagactaccacggttcagtctttagggtggatgagtaaacagatataatgatcgctaaaataagacatatgcgtagaagataaatgtacgggacgtacttaaaattataagctaccatgacgactctcttattttgaaagtgcaagaaggctcgtccaatgtactgtgcgatagtaatcaacttctccttgtgcaagcccttcttgtattcacctatctcttttgcagtcttgcccttcagctggtcagaccctggtgctagcctcacggtatgttgtgtttggcagatccgagttggatctaagaagccgataggtttcttttttcttcttagtatccatgtattgcatcctacagaagaagtttgttagtaacaatcacatggatttgtattgtacatatttttcatataattaattaaaactcatacttacatgcaccaaacaccgacatagttgacgtccatcttatcccgacgatatatggcatggagatctgagaaatctagccatacgtaaccttgttcgccgaaacaatatgccggtgatcgagctgttatattgcccaagcctttcttactggcctccatgtagaaggtatgttaccttctcatctcccatgg

SEQ ID NO: 89205 - DNA, 3474 bp, Oryza sativa
  unsure (1)..(3474): unsure at all n locations
gatgttnnttatgagcgctgtcgtgtgatggatttaacttaaaaatgtatatttagttctataggcctaaactcgtgataaatgttacattgttttgcatgatcgacaagtacaaaaccggacatctcaatcgggctatccgtgacggaggcgagcggcctgctgaacactaggtgagcaataggacactaggtacatgaaggagcacaatgactcaattaaagtggcacgtgagaagatgaacatactgaaagattttaccagcgagtggttgaatccaaattaacaatgtctattcaaagcacctattggagaggatattcaacttcgacaaggacgatggaattcatgtacaaccaagaggacaacttcacaaattgccgcaatctcaaggataccatccattcgttgctgatagagtcattcatgatccacatttagtattggcaattaacaattagttgtatgtccaattgatagtataatgtgatattagctcatccttatgaacccatggggtattttagttagtgtgtatatagtaattttggttgggtggatgagcctggatgggagatggccgcctgattttctgtggtgtttggttggatggcatggtgtatggggcggcccagaatagagaatattttcgcaatatgctggatgagtgcatccgaccgatttggctggatgaagccatccagttttggtctgggtgatgtgtcctgttctgattggctgtggttggtttgattttcggttaagcaagctccaaatgattttttgtcctaaaccgtttatctaatttatgatttgattacaccattatatttgttacaattaaatctttaaaataatatctcggatgattatattttgataaaaaaataatatataacaaatgggtctcactaacttttggctttttccatccatgctacatcctccaatcaaacaagaaattggatcgccatatccatataaaccaaataaaaaattggatcgctatatttaacaaaatatggatgccatatcccatccatgcatgaccgtgaaccaaacccaccctaagtgtcatatggggtactcttgaatataatctccattttggatatcaactactgtgtacactttagtaattaatcattgtcccttgttgatcacattttttgatgtccttttttctcatataaatgaagagtaaatattctgacctatgtatacatccagtatatatccacccattatttacaacaaaggtgttgaatgtggatagaattgattgagtacatcctctccatcttcctttggtataaatggatctttctccacgtctagaaatcgaaccaccataggggttttggaaggatatgacttgtccatattaaatttctccaaaattttctgggtatatgcactttggtgcacaaggattccagaaggtaaatgctcaagttgtagacctaagaaaaatttggtttgacccaaatccttcatctcaaattccgtctttaaatgatgacgtgcttcattaatatcttgtgtattgccaatgatgttgagatcatcgacatataccgagataatacaaaatcttgtgggggactttttgataaagacgcacgggcaatcctcatttttagtgtatccctttagtgaaaggaattcacttaatcggttgtaccacatcctgcccgattgttttaagccataaagtgacttctacaacttaacacaatacatgttacgatttaccttctgattcgggatgtcgattccatcaggaaccttcatataaatatcagaatcaagcgacccataaagatatgctgtcactacgtccatcaactgcataaatagacgattttgtactgccaatgatattaaatatcggaaagttataccacttgtactgccaatgatattaaatatcggagacgattttgtactgccaatgctacaagccttgctttatatctcaccacctcgttgttttcgttccgtttccggacgaaaacccatttgtatcccacaggaaagataccacaaggagtaggcattacagccgagaatacatctcttttgtaaagcgaggctaattctacgtcaattgcgtcgttccatttgttccagtgagagcccttttggcactcttttatagacctaggttctggatcaacttggaggcactcagcaatttgttcagaaaaattagtatcgacaattgtagctcttctattaaaagattctccagttttagagtagttgatggcaatttcatcaacccttatagactcatcgtgatctcctgaaacaatgtgtctatggtcttccgaattcctagtctcaacattgtgcaccaccgagctaggttgtagactatcacgatctgcttgatatatagtatcaatttggtgtgtaccaactaaaggttggtttgcatttaccgtctttctttgcttattaacaattgtttctcgctgagtggccatacttcttcctctttttttagtgagtggaagttgagtggttttatttggtacctccactctttctggcgcattctgagcaggaattaaagatttagtcacacctttataattggtaaatgcatctggcagattattcgcaagtctttgcaaatgtataattttctgaacttgaagatcagtttcagtagtacgtgagtttgtggctggaataccatgggcatcccaattaatttcgtggcattctttctggtacttgaagtctccccctaatgccgggaaatgttcctcatcaaagatagagtcagcgaaccgggcagtaaatagatcacctgttaagggttctaaatactttatgatcaacggagatttgaatcccacatagatccccactttcctgtgtgggcccatagcagtacgctgtggtggtgagatcggtatgtatacaacacaaccgaacttacgcaaatgggaaatacttggaggattcccacgtactaagtgcattggggaagtttcatgatatgcagttggtcgtagttggacaaggtcagcagcgtgcagaactgcatgaccccaacacaatgaaggtaatttgcaattcatcaataatggtcgagcaataagcttaattcttttgatcaacgattcagccaaaccattttgtgtgtggacatatggaacagagtgctgaacctgaattcccaatgccatacaataatcatcgaaagcatgggatgtatattcggcagcattgtccatacagattgattgaatcctatgttcagggtaatttgccttcaaccttataatttgagacattaatttggcaaaggcatggttttgtgtcgatagaagacacacatgagaccatctagtagatgcgtcaatcaaaaaccataaagtacctgaacggtccagattttggcacaatagggccacagatatctccttgaatgcgttcaaggaatttaagtggttctgc

SEQ ID NO: 89206 - DNA, 1274 bp, Oryza sativa
  unsure (1)..(1274): unsure at all n locations
taaaatctatgcaaactctaatcttaccactgccttttttttccaccgggactatactagaaacccactccgcataacgacatggcctaataaaccccgctttcaacaactgatcaatctcctctttgactcagtcatatagcaaaggattaaaacgacgaggtggttgcttataaggcctaaaacccggtttaattggaagccgatgctcaacatgctcacggctaagacccggcatctcatggtactcccatgcaaagcaatcaacatactctttaagtagctcgattatcttaaccttataatcgactctcatatttttgtttacaaaagtcagccttggtttggttccatcacctatgtctacttcctccaatggatcggccgatataaacccttgtccaagcttctccacttcatcaaaatcttcaatagtttcaccaatatcgttctttgtagaccgatattcttgcaccctcttttgtaaccactctaaattagtctctttactcattatacaaatttatatggcttagccatgctacactagccagctttacagatatatgtacaaatttgccattggagatactaataaaatcatagcattgaatatttcccatgacaccactcaaaagtagcatcggccattgcaacccttggcgatggattcggtttaacaattttaacattaatggttgtcccattgaataaacaatgatgccagggtgaaagcgcacaacaattggcattgattccaacacggacccaaaattacaatggtggtaccctgcacaatcgaccatgaagaaaaggcggtgggtacggcttggttcccaaccgaaagctccgcttaaaaagaacacctctgtgcttcggtgggttaacattggaggccattggattatggtaaggttntttaaacaatataatcattgccaaactttttggaaacgaggtttgctataaaatacaatggacccttctttccaaggatctcaagaacacgtttcattaaaagaaccttggaaagaagggtttaattacggttgaataattggctttcaaaaacggtctttgggactctgaaaaggggaacctggttttccatggaaaattcttagccaaacacccagtgttatccaattttttgaaagactaattttgaccaaatggtttcttttttctaaaacgcgtttttttttggtttaccccccaccggggggggaatattaactttatttttgttttacatttttttattttgggccaaa

SEQ ID NO: 89207 - DNA, 1812 bp, Oryza sativa
  unsure (1)..(1812): unsure at all n locations
tttcagagaananatgaaaccttnaaaanccccnanaattnnananncctcanacaccaaaaaaaaacccccccaaaggatgtcncttttttcaaccctaacagggagaattggcaagcgggcatatgctttgatagaatattatttggcttatgaaccattaaaatctatgaaaggccaaattgtatgtgattttatagtggaccatcatgtagatattgcttatgaggaagagatttgcctagttgaagttataccttggaggatttattttgatggttcttcttgcaaagaaggtcaaggcataggggtagttttgcctagtacgtgaaagcttttggtgattcggaattggtggtgcaacaagtcgccggagtttataaatgcttggacagatcactaaataagtacctcgattcatgtttggatattattgccaattttgataattttgctattagacatattgctaggcatgataattctagagcaaatgacttggcacaacaagcatctggctataatgtgaagaaatgattatttctgatattagaagagcaggtgcttgattttaaatctttgtgtgaaattggcaaaactagagaccaggggtggtctgaccggccacatgccgtcggtctgaccggcgaccccgagtggtctgaccggttcaatcaatttagaggccgaattaattataaattcgaacatttgtgcctaggaaacagaggaagattggaggattcatttgattcgatatttgaaagatcccacacttaaggttgatcggaaaattcggcggcaagcattcaaatacacattgcttgatgaagatttatatcgccgaaatatagatggtgtcttgttgaagtgcttagatgaagatcaatctaaagtggctatgggagaggtacatgaaggaatttgtagagctcatcaatcggcccacaagatgaattggttgcttaggagagctggattttattggccaaggatgattgatgattgcttcaaatattatagaggatgttaagcttgtcaacagttcagcaatgttcaattggcgcccgccgccatgttgaatcctataatcaaaccatggtcgttccaaggttgggctttggatttcattggtcaaatttatcattcgtcattaaaggggcataggttcgtgctagttgctacagattacttcaccaagtgggctgaagctgtgccgttgaagaatacgactcatacggaggtatttgactttattttgaagcatgttatccatagattcggtattccacaaacattaactacggatcaaggtgcttcttttatatctaaggaagtgaagaattttgccgaatcctatggtattaaattgttgagttcttctccttactacgcttaggctaatggacaagccgagtcgagtaataagacattgttgaaactagtgaaaaagaagattgaggaacacccaaagaggtggcatgaagtgctttccgaaccattttgggcgcataggatatctaaatatggtgccactaaagtcactccttttgagttggtttatggtcaagaagccattttaccggttaaggtaaatcttggttctcttcgttatatcaagcaagatgatttgtgaagtgaagattataagacgttgatgggagacaaccttgatgaagtcatcgacaagcgcttgaaggctttggaagagatagagaaagagaagagggtggccaaggcgtacaacaagagggtgaaagcaaagttgttccaagttggagacttggttggaagacatttgcctaagagtct

SEQ ID NO: 89208 - DNA, 2292 bp, Oryza sativa
  unsure (1)..(2292): unsure at all n locations
gattccaccttcttcttttgcattnttggccttcagttggtcagaccctggtgctagcctcacggtatgttgtgtttggcagatccgagttggatctaagaagccgataggtttcttttttcttcttggtatccatgtattgcatcctacagaagaagtttgttagtaacaatcacatggatttgtattgtacatatttttcatataattaattaaaactcatacttacatgcaccaaacaccgacatagttgacgtccatcttatcccgacgatatatggcatggagatctgagaaatctagccatacgtaaccttgttcgccgaaacaatatgccggtgatcgagctgttatattgcccaagcctttcttactggcctccatgtagaaggtatgttaccttctcatctcccatggtccttccttcagtgcccattccggcaagagtgctttcccatgttcgtacttttctgggcaatcatcagttgcgaagtatgttggcccggctagttcagcggccttctgggggtcatcatctctgagcttggcacgttccttaccccctctaaagacagttaccatgaacttctccttgttctcatctttggtcttggagtcgtggctcctaagcactctaggcacctcagaactggtagtggccttctcagggaccgtggtctgttgcacctcggggtctttcgcaggagaagggtcttcaaatatttctggctctgtaccgtcccattccaatcctggtacttcttctatttctgtcccaactgatgccacaaatttcacctctggttcagccactttaatatccatttggacatccggcactgcaatctccatgggcacctccggcacttcaatctccgatggcacttccggcactagattttccttatgcatctaaggttcctccaccttatcagtcaccttcttcttaggaggtcttgaaggttttcccaaccctggttttggcacctcatgttttcgcgtggcgtcggtgcccaatctaaaggatatgttattcttgtgctagagaattacaagatcgatcgcatccccaagtacggatacaccatctgcagtagggaagtcaatgtcataggactcaaacccttcgtggaccacttgcgtctgcactttggcatatgcagcaggtatgaactcttcattatatgttctcccagggatagcaatggctgtagcggcctcaagagtattcccggagcgtccaatgggaacgtgcaatctgcagggtgtattctccttgaggtcatcgaaggggtaatctggctcaggttctttggtttcggggcgaggtaaaagcatgtgcttgacgcagaaatccatcatttgcctttgaaaatccgcagccccatcatctctaagtttatccttgtacgcatcacgcttcttgtgggggtcatgtttgaacccttccttccaactcatcttggacgacacacctcgaaccctacccccatgctcaggagtacccaacaccgtacttagcacatctttctccctcttaggcttgaaaaatcctttcttctgtgaactggataaattctctattttatcggcaacaccctgcagctccggatcttgaaacgatactttgccttcattcgtgatctttggagttcaagctcttacccaattccttgatctctgtgtccattcctccattggtaccggaagccccgccttcctcatttcctcctcctcttttgtccactgctccacctttggtgcgtatcccgtggagcctaagtgatgaggaaatttgtatttcttggccaactctgaatacttttggctccttcgaatttcttccggggagtttttcaacgtcagaaagtcctcccactgtttcggggttatgttggcatacgtcgaaaacggtgtacgtcccgtcttcacaaatttcttgttcaaggtggttttacaaccatgccaagacttgggcattgtttgcagagcacaattcctcactgctgcctctaatccatccggggactggaagaatttctttaactctttccataggacttccttatccctattcgatacatgatcccagtccttgaccctgatggggatcttttcccttactattatgccgcactgtgaactgaatttcgcatgtgctgtcttagaggcgagcggctctccttttggcgaaacatgggtaacacatggaacccttcatccctggtttgacgcgtctgtaggctttctttcgttgcctttgtgacagtcgctttcttcagcacgtggttg

SEQ ID NO: 89209 - DNA, 526 bp, Oryza sativa
actgatgttattccgtgttatttataccaacccgactctttgtatattgcgccaatgcacggcgacttcctaactctttgagactaatgaccttctgagacactgcgtttaaaaagtagcacaatctggagatagccacctataaatgctccggatgtatggtctttattgcaattgccagaaacacagtgagcacgacatgactgtcgcgtgaattatcaccagatactgataaatctttcatggaaactagtccactgatgtttgatgagaaacctatgggcactctgacatcacggtgtgacttgcaaaatgacttctttaccgcaggagttagtgtgaaacaggccggtggaagatatactttgccattcttctctccttctttagggtgtaactcttccctaattcccatctcgactaggaccatccttgattgcagaacatctttagtcttcttcggcatgtccaacaatgttccaactatgttgtcaaacacattcttttctagatgcataacatttat

SEQ ID NO: 89210 - DNA, 1081 bp, Oryza sativa
  unsure (1)..(1081): unsure at all n locations
gagattttgacngatcttgtacataaaaaatagtacaaactaatatgcaaaatgttgagtgcaaatgttcgtcaatttgcgatataatcacacatcaccttatataccactattacataactactaacttcttagatgcttacatgcgactcaacaatcattaccctttaacattttttcccacaccgtccgtgcgcatgtaaggcttcatggtcttctaagtagatgtctcaacattcttaatcttctgtacaaactgactataaagtggcatactatcatattgattgtaatcttcgacatcttcaaccccatccactcccaatatcttttgtttcccgggtagcactatatctttcttaaaatttgaagggtctttcacataaaacacttgtgccacgcgattggcgagtacccaagagtcatccttgtaacccacactcgctaggtcaacaacagtaaggccgaacttatcaacattgaccccgttcgggtattttacccactggcacatgaatatggtgaattgcattgtgtgcccatagtcgatttcccatatttattcaataaacccaaagtatgattgtttttccccggctttatcaattacctccacacggacaccgctattttgtgtacatgttttattatctcgggctcttgtactaaacgagtatccattaatgtcatatccctgccaagaatttactgtagttgatggaccacaagccaaccgcttcatagttatttcatcggtagtttgtccctcaagcaagtctaggtctcgcaaccaatctatgaagagtcgcttgtgttctttcattatctactcggtggtgcgacccttattgttagctcgtattagttcgatatgttgttcgatgtaaggctcaacgatagcaaactgatgaaggacgctgaagtgagcttcttggaatgatttgtgatcatgggtgatgaatctcttctttcctatcgttcccttgccactcaatctgccctcgtgtcggggcacaggtactccaattgcatatccatctttgaggtaatcgatacagcactcgacaaccgtncacatctc

SEQ ID NO: 89211 - DNA, 1494 bp, Oryza sativa
  unsure (1)..(1494): unsure at all n locations
tttattgagcaaaacagtaaaactgttgagtaattaaagtaacattaaacctccactgatcaacgctacaccacgttgaacaggcccaaccaacccacctgaactacagtgtattgggtcgatttattaagatgggactaatcacggtgaatctggtcgaccgcccataaccgccggcacggctattcgaatagctttactctgatcagaggtgtacaactgtacccacaagacacagccccacgacacgtttccgtgtgccgacatgccaccacgacatactggaaagaggccgtgacaggacccttcgcataaccccctctagccaagcacaccacacctcaggtttcacccccgtccccagcgggcaacgggcagtcccctctcgtacctaggtgaatccggaagcgacagaggccgtcgcagggcccgccccgctccatcacgcccacccttgcctggatgcgtcagctagaggtaagctacactacaagcccagccgttgcccacgctggcttgtggtaagtacgataagttcttccagggcatcccgcgaaccggtccttaactaccatgggtgcgaccagcaaaaccatgcacccacagcccaccattcagtcgcattttagttggataattacgaccatgaagcatggccagatgtctcgagcacgcagcttactctgatactaaaaaggtctaatactgtaattatcccatcaactgagctagtggtaattaagcatggctaatcatatagttctaggtaggtcacataagtaacatgagcggcgaagcagataggtaatacctggatcccatgtaattagcaaaacatgcatatttatttgtaaacggtaaaacatttataaattgggatcaacatgctcaaggggaatgtgtgacttgcctttcttcttcacttggatcttctgaactcttatccttgcgaacgcgaacttccgaaacgacggattctacacgctggcacgcaaaacgaggaaaaactctaataaaaaccaaggaaatagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgatgtaattattatttatttttccaaagaaaaagagggttgctggcgtcatcaaaggggaggggcggcgccggcaagcgggccccaccggtcaacggcacaagggggagggcggttcaccgtggaccgggtccacgcgggtggtccactgccggtccacggaaccgacggcccagatcaccctcggggtcgatcggacgggcggcggcgacctggctcggctcaaggccggccaagcggccacggcgacggcgacggcacgcgcgaacgcgttgccggcgacggcaaccggcggcgnagacgagnngtacatctca

SEQ ID NO: 89212 - DNA, 1099 bp, Oryza sativa
  unsure (1)..(1099): unsure at all n locations
tgacatatcctcctccgccataaaaatttgattatagccagcactaccatctaaaaagctaatcaccttatgacccgaagcatcattgatcatcatgtcggctataggcataagatattcatctttgggagtggctttatttaaatctctaaaatctatgcaaactctaatcttaccactgcccttcttctccaccgggactatactagaaacccactccgcataacgacatggcctaataaaccccgccttcaacaactgatcaatctcctctttgactcagtcatatagcaaaggattaaaacgacgaggtggttgcttataaggcctaaaacccggtttaattggaagccgatgctcaacatgctcacggctaagacccggcatctcatggtactcccatgcaaagcaatcaacatactctttaagtagctcgattatcttaaccttataatcgactctcatatttttgtttacaaaagtcagccttggtttggttccatcacctatgtctacttcctccaatggatcggccgatataaacccttgtccaagcttctccacttcatcaaaatcttcaataggttcacccatatcgttctttgtagaccgatattcttgcaccctcttttgtaaccactctaaattagnctctttactcattatacaaatttatatggcttagccatgcttcactagccaagcttacagatatatgtaccaaatttgccattggagatacttataaaatcatagcatttgatatttcccatgacaccccctcaaaagtagcattcggccattgcaacccttgggcgatggattcccttaaacaaatttcaacatcattgcttgcccattggaattaacattgttgcanggtngaaagcccacaacaattgtgcttggatcaacacacgacccaaaataacaatgaggttcctgcgcacctacaataaaaaaacggttgtaacgtttgttcccaccgaagtcccctgaaagaaacctttgctccttgttaccattgaacttgtgaaaaagtaggttttaaccaaaatcattgccaaatttggaaacagttggtttaaatcacagcccc

SEQ ID NO: 89213 - DNA, 562 bp, Oryza sativa
  unsure (1)..(562): unsure at all n locations
caatatcctaccaattgagccaaggtcaaccactttacttgacacttgaaaagttggatttctagaaatgtggaatttttgtcttcatattgtaccataatgcgtgccaattctgcctgtagctgataannnnnnnnnnnnnnnnnnnncaacaaaaatataatttgtgagtagaaaaattatatccgtgtccttagcaaaattcgaaaattaagttttgaattcaaattttggcgacggcttataaagtgaaaggcaaacaatgtgaggcctgagtcatctctttttaatattttcaggccgagcattccttaccccagcagttcattcatgctttcaaagatgggcaatttacaacattaccagcatgtcattcaggcggctgacctacttcaccatcaacgcctttcattattggagttcgttttcttttaattgtttaaattaactaaccagttacccttccatcctggtttgtacatagagcaagccagtcctgttcatttggctcaggtactgcacattttcctctaccacaacgtattaatcctacagttccaac

SEQ ID NO: 89214 - DNA, 3238 bp, Oryza sativa
  unsure (1)..(3238): unsure at all n locations
aacgcaaaagattaccggttttcatcccaccgttttttgggttaggttgtgccgccnccgccttaacaagctacaaaaatggtaaaaggccttccgcacccaccctgttaaaacaaatttccaaccataggtccacccaaaacaaagttgagttaaaatttgaacatacgcgtaccaaggaacgtaacggggttcgacacgcaaacactcgcgcgacgtgcgtggacgaaagttccaagctgtgcaccctcgactgctgacaggaacgagcggtgtttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtctgaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcgtgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttccttaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctgattgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcgtaataattgattttggttcaaagccaatgttaccaacaacactgctgtacatctcacttgccacaaaaaatgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttccatcgatggtccaacaacatcccctgtattgctaggaccctccacatcttcggttcgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaccaactataaattgactgaaatgntcttttccgaggcctatcgatgccc

SEQ ID NO: 89215 - DNA, 2879 bp, Oryza sativa
  unsure (1)..(2879): unsure at all n locations
accacctggtgaaggaacaacaagcacgcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctcagactattgttgtactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcagtccttctaccactttgtaggcttgttgaggcggcggcggacgaccgtgacccagcgaagcggtgggatgcagaccggtcactccttgccgctcttgtagaccgctggagacttgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcaccggatgagtgttttgtactaacatttcattcttaattgtaggcggaccgtctgcaccctgacgctgacgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccacagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgttgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccatacacggagaagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttatttccatcttgcataggctgatgccacacgggatatcagtgccgatatcaccgcagtccaggtgaggttgaacagaggtttgcacttgactgacgttgagcagagggtgaccttcgcccggatgcaggagaagatgcgtgcggtcatgcgcgnttctnctgncnnanccctttggcgtcgtaccttcagtgggnncgnncacccacaggcttctcgcctaccggcgtgcaggaccatctttgcttagacattcgtagtttngagcagngcgacctacagaccgggtttggacggacaagtcagtccacatttaggtatttttggttaaggttttgtcgaaatattaacaggtttaactgcacggttcctattggaagaactcgtttgctttgagcgcggtcgcaagaacaaccgcgctttcggaggttcctagggacgttgccaactctttgggcgcggtggcaggttttttttttaggagacgtgattccttggccacacgggccttaactttttttctaccggtaaaacttggccaaaatgatagggcccccctttttgtttgttttcctaaacaaaccccccaaaaaggggtggggtataaaaatatttt

SEQ ID NO: 89216 - DNA, 7207 bp, Oryza sativa
cccgcggtacggatcatcatcctttttaggtttccactatatatatacctcttgtaagccgccgtgcggcgatgtaacctcacctcagatatagtgaagatattttgctggctgacgcccgtggttttttctctcctgttttgggagggttttccacgttaaatctcgtgtcttttgtgattgatctattgttctttattgtttgttcgcctatcgtttgctaacagaagtagcaggcatgaagacagcggcagccattctgttggtggcggcactggtggcgtcgcactgcatggagatggcgtaagcgatcgacacttgccatgaacagatcctcgtggccatccactccaccgtgaacgtgcaaatcagcggcgacatcatggagctcaccgctagagccgccatggtcgtgcccagtgcggcaatgctgatagcgaggctccacaaggagatccatgcgccgccttccccagtggcggcagcggcgatactagcagcagagagcccgagaaggacatatcgcccttcgtttccatctcaagagagtcacactcggcaccgtaacactacaaattctcctagcgctgtcgtgacggccacaaccgtcttcatacatgctgctccgacgactggttcgggtgcggtggcaccactgttcctgaggaagagagaaggaagaagatggaaaatgaatgagatggatgaaaaatgtgacgtcagtggcacggtcccaattttataaaattccagtaacacggcaataatagatgaattgtaatggcatttatataaataagcacatttacccttaacaaaataaaaatggaaagcacaacttatctctactactataaaagtggggtcctccttctacccctcctatcgttcttagcgcgtccatgcgctccgcgtgagtaacaatcgtattcaatattttattctcggtcacttttctatcccatctataattatataggattgacatgttatagtacgtaatgagacactgtcacagtcatgtttttagtttcaaattaaaaaaaaaaagctcaaaataatacgatgcaataatgtcaccacattttagaaaaaaaaatgcaagcttgaccaagcatgagtgcatgactatagcttttatctataaaataaaaaaaggactgtagcttattgcgcttttattacaaagtcagtttctatataaaatttgcataaaaatattcgatttaaagctgcatacaacagatggcaaccgtgacaaccgacaaggaacccaacatgcggtgtgcctcatgctagcaaaagttcgttttttttaaaaaaaaaactcatgctagcaaaagttgatgcaacagaacaaacacgcgttcaactccaacggttgtattacttgtatgtgagctaaactcaaaatatagttgggcctgactacaatgccatctcaagtcaacaaatgatatgaatttctttttagaactcatcatcattttagtgagaaaaaaaaacagacctggtattctggtggttgtacattattcgtcacaacctctaagcctaccaaaatatatatcagtgtataattcgttacatagttttatattgatgatgaaaaagcgtgatttttcttaaagacaaagacggaacgtagataaatttgaccaatttctcaacagatgatccaaaccattcttttcttttagattcggtaacattacatccctaccttaaaaaaaggagaatgtatattttccttcggctaacaaaacaactacttcctccgtttcacaatataagactttctaacattacctatattcatttaaatgttaatgaatctaaacatatctatgtgttaaatgaatttagacatatgtatgtgtttagattcattaacatctatatgtatgtgggcaatgctagaaagtcttgcattgtgaaacggagggagtaattattcttttatttataggcaatatatccatcaccgacaaggtacctataatgactccgtgaatattaagatatacacctagtcatcaacaacactatatgtatagttacgtgtattcaatacatgggtatgagcatgtgtgtgtatataagagcgtcccatctacactgtgtttggattaagaaaaggaaaatgctacttcctccatttcacaattgaaaactttttagcattacttatattcatatagatgttaataaatctagacacatatatgtgtctatattcattaacttctaaatgaatatgagcaatgctagaaagtcttacaatctaaaacggagggagtacgtaacagtatctcgttcaaacggaatgatgcgtaacggtatgtgattcgaacgggattactgtagcataaaaaaaaaaggaaaaagaagaagcatacttttcccttccaatttgttttttttttccttcgtcaccgtcatcgcacagtacaatcattgtcatcttccctgctcatcccgaagcttctctcctcctcagacctcacctccacgttctctcaggcaagcgagccccccctaccttgcctccgaagtaaccgccgccgccgcggcagctaggtcaccgagcccgggcccaccctcccctcccctcccccacgccggatgatcgccgccggcgccggctcgatgggccgcgccaccgccactccagcccacggggcccattcgcggtggccccgcgccgtcgcgcgcctccgcctcgcgttccgctccccggcgcccgcggccagcggcggcgcgcggtggataggctgcttccgcccggcgccaccggcggcggtgaaggaggcgaaggggaagcggccggaggtggagaaggagcctgcgcggggcggaggggaggacgtgtggagcgcgcaggcggaggccgaggtggcgcagggcgggggtttccccgagcacctcgtcgtcatggtcaatggcctcgtcgggaggtggtggatccgtgttactgtttgtttttggttcatcgctttgcttgtcagctctgatgcaacctgctggcatttggcttgcagtcgtaaaattagcctggttgttttttttttttttgcagcgcggatgactggaaattcgcggcggagcagttcgtgaggcggatgccggaaaaagtgatcgtgcaccgtgagtacccccaatcgatccacaggcaaatctatctcttgcggagttcagttgctctctgaattgtggattgtaaagcaaagtaagatcttttcgtttgtgtgcctattcgcatgtcttgggggtgatatcagggaaaattagaatgttgggaaagttttgacctctcggcataaaaaccgtgttttggtaatctatatagcgtagtcccactttgtggaagaaatcgagttttcgtaatcaacatgctagagtgcaggctacgctgaagaaatatggtttgagcatgcaggatggcaacatgaacatgccattgagacccagtcatttaggaaaaacatattaaccacttgtgccaacttgctaataattgtctagttgggcctgactaaaattaattttctaattgtgtgagaccgtgggagaatcggtagttcacaaattttaatcatacttatacttaagttactatatgagagagaaacataatggtagatccaccaaccagtgtgaccaaatgcatttgattctgttgaaatataattacatccatggattacataacttggagtggggatgaagtaacagaacctgccaaaagaccaccataaagaacactaaggatttatatgacaaaggttgcattgaccaagttagcgccatcagctagttgcagccaaatcttaacaatatactgctgtttgtgtgtgatatctatcatttagaatttcattcttgttgttccagaattatcagtttacatgacctggttctagatagttccattcaaagaaactcttcaagccaatcatcttgctcctcttttttagattgtgcagaggtaaaagtcttttagatttcaggatgatggatatgatgatacatcatttatcattccttctctagttatggttgtttcagtcactatcttgttttcctgtaataagatttagattgccacttcgcatgcaggaagccagtgcaattcggctacacaaacatttgacggagttgacctgatgggtgaaaggttggcaaatgaggtacctaatgacttattgctcaaactaaattttgtcctctgtacaaacctttgtagttgtttgatcgattttttgtgtgcacttgactatttatcttgtcattgcatatgccctatggttcttgttgaagctatttattataattttcttagtttgcatctggtagatgaaatgacgtctgttctaagctgattgatagaaaagtagatatagttattagggaaaaaaaggtgataaaatggtgaagttgttactttttaaatcttattctacagaatttataactatccttcagatgaaagcgtaaaatcaaaattgatctacattgatccatgggagtttgttttcatagttcaaacttgtaagtcctgtgtattcagctacatcatttcatattggaagctaactaaattattataggttttatcagttgtagaacaaagaagaggtgtgaagaagatctcatttgtggcacactctctaggtggccttgttgctagatatgctatagggaggctttatgaaccaaataacaaaactaaatcttcttcggagaagagcagagatgaaggtgagcgcttggagggtttcattgctggcttagaacctatgaattttataacctttgcctcaccgcatcttggttcaagtggaaataaacaggtaagactaatatcctttattgtttataaactagacagatcagttaaccatctctttctctttttttaactttgcataactacccacttaagttgcctctccaagaacaggttaattggtagcgcctgttaattgctactcttatttaattacaattattgaaagtacatatgaggttcaaattttgaagtacttttggagacaaaaaattctggaaattgttattcatcaagcaacttcataaagattaatattatggattttacttttgttgctttcagctttcctatagattacttgcaaatatgtaggtgcctttgtttaacaacatttaaattcttcagtaatgtcagtctcatatggtttcagttttatgagatggcatacttttgtagaaaaatatttcttaagtagttaattagtccaacaactcgataatgactaatatttttgattttacttgttttactttttgattctctagagtttgcaaatatgtaatcagttaatcaccttgatttaacctgaagtagaacaaaacatttaaattcttcagtaatgttagtctcatgttcagattcttccaccagctccctttcttatgtggcctgcctttcctggaaagaagagcttcggaaactgcacatttgcttgttgggagaacaggaaagcatttattccttacagacaatgatgatggcagacgcccactcctccttcaaatggttgatgactgtgatgatataaaattcaggttattttctgtatgatttatgttgtcttatgtgtttaaaatggttggtgaatgtaaatgtacagaaatgaagttcattttctgtatgtttaccttcagtttcccaaagtagtccaaaaatgtttgggtatcatttctgagcacaatatgttctgttatgcagatcagcgttgcgctctttcaaacgacgtgtggcatatgctaatgcaaacttcgaccgtatcctttaacaattaactgcttcgctgtttactctgaattttctagcttcttacaagatatgcacttaactaaataaaaagatatggttgggtggagaacgtcatcaatccgtcgccaacatgagctaccaaaagtatgtcttagaactatattcatgcctaaagaaacctatggaattattacatatttcttttctgttctctttaaattgttggtttacctttcttctgcggttctgcctcttctcagcatcgacttcttgttcgtgatgagaaatatcctcatattgtccatgttgataaaggagcaacgaacagtaatgaagcagaagctcgttctgatctttatgacccagaaggtatatttttctgtttgttagttaccccgaactgtcaaagttgattgttcatcaatagatgacaaaaatcccttctatttgcagaggagatgattagaggccttacacaagtaccgtgggaacgtgttgatgtgagcttccagaaaagtagtcaaagattggttgcgcataacaccatccaggtgtgaacttattacttttccaacctgcagtatatattttgagcaaagtcgtcttcttttctactggtgcctgaaattttgaatagataattgcggagtggcatcttaactgtgattattctaaggaagttggggtatgcagtagaatttaagattttatgtgcttttctgtgagttgcatctagtgaagtattctatgataagatttcacaaaaagtactttgcatggaatgacctacatgcaagaatgtgagaagttccttattatccttcaaaccttcaatctggatggaattgacagccacattgttacatcttccacactatcaaagtataaaaatttgtgggggcgtatcttctttgctgcaaagatatcttaaagtaatgtattgtagtgtgttcctacaagcccatcagtattaccaactcttttctgtcttgaagcatcgacattcttgtccacaagatgccatccatttaaccatgaaaatgccatggtctttctcaactgttatttctccgtattgttgtgaactgatccattattttatattgcaaaagcgagagatgcagatgcacaacttctcaaatctgaccatacttttctgtactctgactgctgttccaggtgaagagctattggctaaactcagacggcgcggacgttatcaatcacatgatggataattttatcgtctagtccctgaactctacgtgctgcactgtaccaatattcagagaattttagcgattggcaattcaattttgcttaggtattttttttcccttgtaggttacagttctcatagataatgtatacagtgttttaatgggccta

SEQ ID NO: 89217 - DNA, 1264 bp, Oryza sativa
ttgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaacccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaactatgtgctcacaacccaccattaccaggttttagttggcacattaattaattaactaatcacgattgaccatcgtgaactatcaataagccatcatgaaataatagtgagtcattagttatcccataagtgtactaatgtttctaagcagggctaagcaattatatctaatatctagttgaaccaatataaataaagctcaactagtccaattgtaataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactcttcggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagcttagatgaattagttatgaatttttaaagaataaatcggattaaaacacttaaatcggtttaaattgaattatgacgcaataatgaattatttttgaaaaggaaaaggggatttattgcgtcagccggctaaggtttgggtggaccggcgcacgggcggcggttcacacgaacggacggccgagatctacccgattcaagatggacggccgaaaaccgacccggtccaccgcggttcacggcggacggcctttgatgacgccagcgatgaccgcaaccgac

SEQ ID NO: 89218 - DNA, 2077 bp, Oryza sativa
  unsure (1)..(2077): unsure at all n locations
agttttcatctgtattcaggngatcacatgttccctcaggaatgatcacactaagaaaacgagcgtttcgctacctgaagcaaggggatttgaccgtcacagagtacctgcacgagttctatcgtttggctcgctatgcaccagaagatgtggaaacggatgaagaaaaacaagagaagtttctccaggggttaaaagatgagcttgcagtgcaactactcctagaggattatgaaaattttgagaaacttgtggacaaagccatgcaacttgaaagtgagcataatcggatgacgaactgcaagagaaggattgtcaacatcctagtatttccaggtggtaaccaaagacagcgcactgagccacttccgatcatcggatcttctgttgggtatcacgagttcctgccccaagaagatgaacgcaatgtagacaacaacaacatcattcaccaagatatcgacgatagtatcaatgaaggcacccagaatggcaaccctagcaattttgactctgagaaagactccaagggtgatagcaataatggtaccactgatgccgatgttagcaaggatttccaaccaccaattccaactcctagtcaggacgatcgttcccaggcggacaactcagcaaagaagacgttgatttgttacaactgcaaagaaccaggtcatttctcgagagattgtccacagccgaagcgtaacctgcgtcatcactccggccattatgcaagaagaagacaggtcactcgccttgtggtcactggagcaaacgccgtacctgtgaggcctcatgttaattctaacccatagtagaaacaatgtaccgatgttaagcaccttccctttttgtttaagacagtgcctcgtattcatgtaatatgggaaaaattggtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaatcaagtgattaaccaaagagacatttgtttggactaagagtttcagatgtgtcttttccggatcaaaggcaatgacagttagtatagcttttggcgaaacacttcaaggtttcactgaaaggcagcaagccaaaggacctcatcgtcaccagaagcatccacaactctcggagtgaagagtacctggtggacaaagtttaagaggtgattgatagaagataccagcaaaggtgttgattatcgaaccaagaagtaggtcgaaaggtgattgataagagaaatctaaaaagaatacgtcagggctgaatgtgtaaaggaatactttgaatgctaaatgatgacaagcatggtatcttagtaatgacgagctgatctcgacgcatgacatgaagtgggtaacttgtatgaggttgactccaaagatatgaactatgcaaagttctggaactgaagccccatcttcaagtgccgcaacccagtcgaagtcagctaaaggttcaaccagggacaggtcaggtgaagagaagattcaatctgcaacaggagatcgagccaagcagtccagagtgaagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaacattaaaatacgtataagaaaaattcgaatgtggcccggagaatttttgttaaattctccttggtctaaaatgagccctcaaattttacttgaattttcagagcaccggaaatatttattaaacaacaacaccattattcaaagttcaaataaaaggaaacctaaaaatccctcctcttcctctttgggccaagcccagtgggaagtcctacangggnttaagggggcg

SEQ ID NO: 89219 - DNA, 1610 bp, Oryza sativa
  unsure (1)..(1610): unsure at all n locations
cgctcctgtttcagacaggttaaatttataattccatgggtgcggcaacttttgattccccattaaagagggactaaaacccaaacatggtggtccatttgattttgagagaaaaaactgcactgttttagggacngaaccctaattgggttctggaatatgggcaaggactgcaaaatgcttccatcccaggaaaagcttccttctattgtgtgttaaaacggaatacggttcttatgcttggaatcgccctccgaaggtttatttcccttggctcggcctggagtaggtcggggaaaaaacacaactttttcattaacgacaattcttttttgaggctgtcaatgaagagaatggttgctataatttattgcccagtcagggtgcagcaggaggagcattggtgcattgtttctgctatgggttctgattaacacgaggcttacggggtcgggcgtttgctccagtgaccacaatacgatggaaatgtctgcttcgtggtagatggcggtaatgtgaggtcgatttgctttggttggggacagttttggaagtaatgcccttcttcactgcagttgtaacaaacaataactttcttacactcgggttcttcatcttgaacttgatttctcagctgctgtattggaacttctaaagggacaacgcagatactggcctctgtcttgtcagctggtggctggggctgaaattgagcattgacaccttgtggtagtgcactcattgaagttggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttctttgtcagcagaaaactgaattgacaatcttttggtacatgatcagttccttcacaaaagaaacaagtgatcctgctcgttggacacctgtcgggcggatggtcttcctcacaatgaacgcatgtagaggcacacgagctggcaacatgaccgatttctccacaacgagagcatgccttaagttctattttattctggttaaagccttggggagacttcgcatcttcatcatctgaggagacttgatctgaatcttcactaccagacactctacctccattagctaaaagatgctctgtcaactgttgtgcacctcgggaggaatttcttctccgatgttttgtcattcctggtggaggccattctgtgctggtaatgatcatcttacggacttcatcttcggttcgcattggtgtttttcttttctgctgaggacgctcccttgcatagtgcacttgctcatcacacgtaaagcaaatgttacttgcttcttttgggccaacaggtggcacgtcatcatgggtccttcgggatgctgtc

SEQ ID NO: 89220 - DNA, 989 bp, Oryza sativa
tgcgtgtgatatgtaccggcgcgtgtaatagaaaacgacgtgtattgagaggaagtgcgccattgtagagagcgagcggcgagtagaaggagaatgagtaatacacgcctcgctatatgatgcggcgagagaatatcggcgggggaggagtccaccgcctttaaatgggagagtggaaggggaggtcggccgagaaaccggagaagtttaggacggggctttaagatggaatccaagaggcgggcttttagaaggggtctttaccagagccttgatattagagggaggtggaaatcttgggaggaggcgcggcggactatccctccttgtgtgccggttgggcgcccaactaatcacaccgcttggaggaaaaaaccggctttcctcccccagtttgtgattgcgtgggtggcttcacacacagcccccaagttttgggtggttgtaagctcggacaccaggcctaccatggatgtcaggagtttactgaggtggcatggggcttggctgcaaccaaccaccatttctatgggtggtccgccaaatctttgccggtgggttgcgcttgcatcccagtaagctcctagttgatttgcaggaaagtctcattggtcgaggcaggtttgtctcttgggccccgcaaaaaaaggttttgggtcacctgtctgtccgcgcattcatgacgcataatggatggagcccgacgatagggagtatatctgaaggcgcgccgatgatatgtagcccatgttttggagatcagatggaaaatgcgaggtttgtttgtgctgtttgaaggttgggtgtgaagatggaggtagggagtgttctcaagagggcaaaggttcaaacggctgttgagatattagtgaatggggagaacggtcaatgtgtgtacgagagaatgagaattctgaggatagaagctgaaaactgtgtaagtgaaggaggatcattagccaccggtctacgcagctgagtagatccca

SEQ ID NO: 89221 - DNA, 4524 bp, Oryza sativa
  unsure (1)..(4524): unsure at all n locations
aggccccaccaggttcgaggttatattcctggccaacaaaatttaccgaggccccctctatttcttttccaaattcccctgattccacccaaaattataggttccagccttagtaccttttaaacatgggaaccgggtaggggacccataatcccttatgaggggttgaggaaaaacaaagaccttcataccacctgttgttagggtctgcccgtttgggcgtcctacacccaaatttcagttcccaggaggtcagaaaaagcagcagtgtcgatcccattgaactgcagctcaccgagaatgtcacggagaaatgtcaccgaatcccagtcccatggtataaagtctttgaggtacctgatttagatttcagtaaacaaatgactacatatgattgagtaaataatatgggcacacatctgcaaataaaagtaacattattatgatatagttattgtagtgaatactcttttcatatatatactcgaactgcttgtaaaataatttaacaacaatgttctcttctccattgcaaatatacaaataaataaaaacccatgaaacattaagctcaatttattgtaaatcccatcatcatgacatcataccatctcattttcaaattacattttcaaggaaaaaattattagtctgcacaagcagaatttgaatgacaactaatagtaaaaactgaaatcaagaaaatgaataatctgaaaacttttccctgcattagttagtacagagtacgtgcagatcagtggtgagagggacataccgaactccttggcggaggtcgcgctggaccggacggcatgggcgaagcccggtcggcggggaaatccatttgcgatgcgatgtagagagaacgaaggaagcacgacggtgactggatggtagcggcgcgatggtgacctgcgggggcgacggcgattgacggtgacctgcggggagacggcggttagggttgggaatcgcaaggcgaggaggtgcgatggtggtgagggcttccggtggcgaggaacggttgggcgaaagcgtaaaaagatcggtgaggaaagcaatgccggtgggagagatcgctgcggagcagatcggcgcaggcggcgacctagcgacgggagggtgaggatggattttttttcggaagttacgggggatagacggggtgagcgtgtcgatgagtctgaccgttggataagcgttgaagcgatgaggtgcgttggatgtgtgacatgatgaatgatgaatgagtaaaccatttgtttaactataggatagattagacattctcaaaaataagtttatggggattggattttagcagtttcatagtgatgcatgccgtttggacgtacatgtgtgttttcgtgtaattcaaaaaaaaattgtatttttttcatgtgcagacgctcaagaggaccgtatgtgatgtggttgcattatgggtcctcttagagcctactggggttctcatgtagaaaaaattatttgtgaagtagtgttgtgaaaaataatgggactacattaagtgaaaatcaaaggtcggatgtttttgtctcttcattgaattttattaggccatttccaactcaagacactagccatagtttccttaaactccacatcattaagaaactagtaatagacactactcttccaacgcaaacaccactattccatacttaaatttaatgctacttatctcacataatgtcttggatgttatgtagaaaccatgtctaatgcaagacgtggtttccttctctttcctcatttattcacttgccacgtcatttttcatcctaggtggcatcttatttaatgctatggacaacatcctagtcattgggttgggaatgcccttagagaaagtttaatagtatagcccattactagctccaaatcatttatagccaatgtaatagccaattcatacaatagttgcttactatatgtcacgcccagaaatttagcccaaatttttagactattttgtgtattaaatccctgtccaggactagccagggtacacaaaatgacaagtaataaatagatccaaacgtaaataaagcgtaaaatacttaaagaataggcacttagtcctcacactgaaacaaaagcagcagcagcggaaaaggcgatcctagcggggcttcagctccactccataggcaaaactcaactgaggtctgaaccttggtcctctaacttcatcttcagctcagaagcactacacttctgaaaaaggggaacaacagcaaggctgagtactaccaccgtactcagcaagccacaccaatgatgcagacgtgcaagggcagacaaagaggggtttgtggctatttgcataaaggcggttgtaaaacattttattgagcaaaacggtaaaacagttcagtaattaaagtaatattaaatttccactgatcaacgctacaccacgttgaacaggcccaaccaacctaccagaactacagtgcattgggtcgatttattaagtgtgagactaatcacggtgaatctggtcgatcgcctataaccgcgggcacggctattcgaatagttttactttggccaaaggtgcacaactgtacccacaagacacaatccaccggcatgtcaccatgtcatcatgtgccctgatgcacacatcaccatgtcgagtgattgtgacaagacccttcatataaccccctctgaccaatcgcaccgcacctcaggtttcacccccactcctcgcaaggcagcgggcagtcccctctcgtgccacggtgaatccagaagccgatcaactgaataccccagccaacccaactccattacgcccacccttgcctgggaacgtcagccagaggaaagctatacttcaagtcaggcagttacccattcctgcttgtggcaagcgctgtatgtcttccagggtttcccgcgaactggtccttcattgccatgtgtgcgaccagcaaaaccatgcacccacagcccaccaataagtcgcattttagttggataattatggccaataaacatggccggatgtctcgagcacgcagctcattcagatactaaaaaggtctaatactgcaattatcccattaactgagctagtggtaattaagcatggctaagcatatagttctagctatgtcacataagtaacatgagctagtcgatttatcatccaaggttgacaaagaacagatatcaagtaaacatggcacaagcgagcagataggtaaaccctattcccatgtaattagcaaaacatgcatatttatttgcaaacgataaaacatttataaattgggatcaacatgcacaaggggaatgtgtgacttgccttgcttcttcaaacaatcttccgaactcttttcttcgcgaccgcggactttcgaaacgacggatactacacgctggcacgcaaaacaaggaaaatctctaataaataccaaggaaatagtacataaaagtaaacaaacatgtagagctcaattttagatgagttttgcaagttgaatggctcaattcggagttcggatgaattagatatgaattttagaagttttgaaccattttaatggatttctagaattattaatgatttattgcgcaattaataatggtttatgacgtcaccaaggggaataggtggcgccgacaagcgggccccacctgtcggtggctcaaagaaggtcggcacacggtggactcggtctacgtgcgcactgcccgcgggcgcaccacatggcagccacgaggtggccacggcggacggggaggacgaggtggcgccgatgtggcaccacagggcagcgacaccaggcggcacggggagggccacgtggacggcccaaatcgcccctgtagggggatcgggcggccacgggcgagcaggagccggctcaccggctggccggccggggagcgacgatgcacggcttgatggtcgccggcgatgaccactggcgtggtgacacacgcgggaggcggcggaaaaaggggaaagggagaggagatggaggggttcctcaccgaggggcgccggcggagctctggcgaagggaggtggcgttgcttcggcgacgggcggcgcttaggaagaaacggacgagggtggccgcgacctgcggaaggggaatgagggattaaggaggggaggaccggagcggtgcagctaaaacaatggccggtagcgacagtactaggtggagctcaccttgagtgatagggatggggtttcggcgatgattcacggaggatgagcggtggccgagcttgcccttgggacggcaaagccggtggaggtggttgagcggcgcagcgacggctaggacggcagtggtggtctgctggagacggcgtatggtggtggtggctcgggcgtgtggtgnaagtggcactaggcggttgttttggaaaggtggagtggcggctggcgtgcggcaaggtgtggcgaatgtggtgnaggcggtggtgcggcatgaggtggctgggnncgccgacttgagactgaattcaaaa

SEQ ID NO: 89222 - DNA, 1691 bp, Oryza sativa
  unsure (1)..(1691): unsure at all n locations
gagaggaggaggtggcggaggacggcgnccgagctattgcaggtggtcggcggtggaaaatttcggcagcctaacggtgccaaattttctagggttcctgcctggacttagaaaatttggcacgggggtggctgcccttatatagggtgcggatcttcgcaggcgggggtctgcctgtgaagatacgttttggcttttttcgcaggcgggccgcccggctgctaagatgtctccgttaaatattttcctaggagcacacgccgcctaaaaaaatactttcagaaaagtgtaataacgctgctagttcgatctgtggaaccccaacttgtcagattcatcttatatttgcaatattttcagattgcatcttctactcacttgcttgtgttctcgattctcttgtaggatatagccttatcgggcaggtcaatcatgtttcggctcgattgataaccaagggaggagtggtgtagtgaatgcgaggggttcaatcgtcttgatcaaagcctttggatcatcaacgttgagtctccataatcgatttaacacctataggaagaatgagaccctagttcctcatcacatgatttttgccatatggcgggtcttgccgagcttagaaatttaggactgtgacaatattagaaatacattatgtacaccaagaaatgatgtttaacttatttgctccattatttcattacttttatttataaaactttggtatgccacatgttccttatttcttgcaaatccattatttaaattttagccaatttctattatacaaaatatatttgtcccagaaagaaaatctcaatggaatgacaaggaaataattggctcaaaagatgaagcatgcacttctcattacatcaatgttgagaattttattctttaacgtatgtttatatcacgagatcaaattttggttggtttgaagcgtattaaggagataagctagcaaaattcttgtgaattatccactcaattcacgtaacgaggaggtattatttcagggatcaagattgtggtaggccttgtccctccattcttccagctcagagagctgcatcttcctgtgctgtccggctcccttcaagtccatgttccaagtccggatagcccagtgcgccctgtgttccaactctaccgaaagatgacaagtcttcccatagacaagttggtatggtgacatgccgatgggcgtcttataagcagtcctatatgcccaaagtgcatcagatagcttgttcttccatgccttccccatctcattgacagtcttctgtagaatattcttgatttgtttgttactcgtttctgcctgtccacttgtctggggatgatatggagtggcaatattgtgctgagcccaaagttcttgcaataagttttggaaggtcttatcgatgaaatgagaccctccgtcacttatcaccatatacggagttccaaaacgagggaaaatagtctcgtggaacatccggcgagcgtgcttagcgtctgcggtcctgcatggcattgcctctacccacttggacacatcatcaacggccactaggatatactcgcagtcataggactttgggaaaggtcccatgaagtcgatgccccatacatcaaatagctagacttgaaggttaaaattcagaataaagataagtaatattgaaaaaatagtccatgta

SEQ ID NO: 89223 - DNA, 1596 bp, Oryza sativa
  unsure (1)..(1596): unsure at all n locations
cagttggacgccgctttgtgatggatttgttgagattgaaagccgatcagcaatttactttgggggcagagcagcaaaaggctttggatgatattaaggatatcttagctctactcctggtttgattcctccacagaaaggaataccgtttaggttatatttatcggccggtgagaagtcaatcgtctcagtcttcattccggagttggaagggaaggaacgagtcgtattttatcttagtcgtcggctcttggatgctaaaactcggtacccgatgcacttattgacccctggtgctaaatcggctgaacgatttgctgtcttaacggagtctgttggatcggctgcagaggctgctgccttggtggtgtttgctgaatcggctgcaaaagctgctgccttgcacgacctgttgctggattggttgtacaaccagctgaattgggggtgtctgctgaatcggctgttgctgtattggatcaacaacaggtggaggtgggagaaacatggcagcaacctgatcttgggtcagccgattggcagccttgccgccatgctatggctgttccctcattaacacaccgaggttcactagcttgcctggcgccatagctgatgtagcagataggggaattgatgcccgcgcccgccgctgagttgttggtgcaacgganggaaatcgcttgatagatggctgaacatcggtgatcaaagactgattattggggaagacactncttgcaaattaccgggcctgcagnctgatgttcagctattgaaccatcagcaatcgacttcatcatgtttgatagggtattgactaacaccccagactgattgatcaaagcatgatgcacagcgtaatcaacccgatcttgaaagttattgaaaaagtcctgtgccacttcactattaaaatttcctccctgcatcccgtgagcaccgtcaccttgaactccatgcaccccgtcaccttgtactccatgtactccttgagaattgtcaccttgatttcctagagagccgtcggtagcacccttgatactcggctgagccgagccgtctagagcttgtttcccatctccatccttagaagaactagtcccaggatcatcagcaacgacttttattttgtacttctgaacaagtgtccccttgcgggtctacatgaatgagttcacgaactgatcccgtgcttgctacaacattgcttcaaactctttcttctgctcaggtgtgaatttttctggatcgaccggcacgacgtttccttcattgacgtcagtcaatcccaacttcagcatcttttctttaacacagcttttgctagatagtggtgggggttgtcccagaatgtagcataagacatcaaatttaccgcggccccaccatcaaccatcatcttagacatcggcttcccattgacatagccgtttatatacaatggtttaagatgccgattatctgtcccctcaggtttctcgaacactgcctgttccggtgaaagaaccaacttagccgattcctcttccatgagcggaggggcggattattttcctgcacacgaaaatatatttccttgtgcgggggacggac

SEQ ID NO: 89224 - DNA, 2636 bp, Oryza sativa
  unsure (1)..(2636): unsure at all n locations
cacggattcgactcgctgctgatgacgtgaccgattttgctcccccccccccccacaatttccggtggagtgatcgattagaaggagtaattccaaatattttttttctacctttatctactattgaaaaaaaattgagaataaatgaaaatacaataatgcaattgttagttaagaacataccgtagactttccccctgtaacgtagcttacttgtaacactttccctctttcggctaaattattggttagtcttttttgcccacaagctatgtgcagcccatttatggcccaactcataatacatacaaatgttgtatatatgcattttcatatagaaacattaaacaaagtatagaaacttcacacaatttatttttaacttttaagaaaaataaaaaaaattgtctattttgggccggatacccatgctgtgttgcagccactcgctgctggcccgttgaattcggcccaaaacatccgttctcacaaggccggaaaaaataggaataagttcagttttgtgaccctcgaaagtgatcgaaatctattctgtgaccataaatcacaaagccggatatctcgaacccctaactcttaaaactggtgtaatttgactccctcggcggttttggagggtagtttcgcagacgtggcatctacgtggcagtattgattcggtcttctttccacgtggcgttgatgtggtgcttaggtggcattaaaaataaaaaaatatgtgtaggtcccacataaatcatgctctcttctcttncttcatcctcccccctctctctccctttctctttccttcggaaggcacttgtgaggagcggaaggcggcaatgaggagctgtgccactcgtcgccagctaccgcatcagtgcctatatcgcatctgattccaccaccatcaaccaccaagatccggcgncggtccccttgtcctccactggcacgaggcgtcggcgcccaacaaggactcgaaggtcgaaggtgggcgagggactcgaaggtccactactacatgaaatatttttccgtgcgggtggaatcgattttcgcgtgcggagctttcacctgtctggaaggcggcgtctgcgaaaatcccgattttttcatgcgggtgacgcacccgcacgcgaaaatcgtgtgcggacgatggatccggcctccccacggtggcaggccgcggatccagcctccccacggtggcaggccgtggatccagccttcccgcggcggtcggcgatggatccggcctccccgcagcagtcggcaatggatccggcctcccagcggtggtaggccatggacccggcctccccacggcggccagcgatggatccgacctccacgtggcggccggagacggatccgctccgccaacaccaccgtagccgatgccgccaccccggccgccgatgccgccgcctccgccaccctaaccgagtgcaccggcgtcgccgaggaggagagggggagagggagatgggaggaggagagggagagggagagggaggatggcaggatggggaggaaatggcagcgcgcgcccatgatgggaggatggggaggaggataaggatggtagcgtgtggggtggattattttcctgcacacgaaaatatatttccttgtgcgggggacggactggtgtccatctctcattttcttgtgtccagaaaaatgtttcatgtagtagtggtcgggagcgtctcgccggcagcatcgtgcacgcaggcggccacgtcgtcgaagtagacggtctccttgctgtccatggcggcctcgatctcctctcgcgcctccgccgtcgagaaggcgcgcatgtgggggcaccccgggaaggggcggccgcccgctaaaaagaaggaagcgccggcgtcgcgtgcgctgggccggtggtggcacgaaggagtagtctccgtgaaatcccatcaacaaccacgggcatcatacgcttggaaggagttgttcgtcgctgggtgggcgaatgctgttcgtcacgcgaggctgctccagatcgtacgaggcgaacaagtatccaggctgccgccgccgaagccgaggagcggcgatgccactgctggccatgcagagacagcggcaagtggctggcggctgccggggacgtggacaagttcttgccggagcaaggcccgttgaaatactcaccgccggcttggtttctccagtaagagatttctgctgatcgatttggatgagatgtgcttacctcacatcgaggtgtccccccagtttttttttttcatgaatgataaacagataccacacatatttttaaaattataatgccacgtaagtgccacgtcaatgccacgtggaataaaaccatgtcaacatcgccacataggcgccacgtcagcgaaaccgctctccaaaaccgtcgtgggagttaaattgtaacggttttaatagttgggggtcgaaatatctggtattgtcgtttagggatatgaattagattcgacaatagttaagggagtcaaagtgaacttattcaaaaaaaatactccctccatgctcgtaaaggaagtcattttggatagcgatacggtctactactcgaagtccaatttatgcgnngntnntatcagnnagtcatcatcagg

SEQ ID NO: 89225 - DNA, 1107 bp, Oryza sativa
ccttgaaagggaatagtcattttggtgcgggcctttaaattaatcccgataaaccctgaggtattcggatccaggcaattcctttagaggcccgtccaccgaaggatttggctcattttttacaaaatgaaacaataaattttttaaaaattgggtggccaattttagagttgaccgggaagtccaaatatattccattaaatattttaccagaattaacctaaattcactataaaaattattattttcatatatttcactaaataattcactaaagtacaataattcactaaataattcatttatttcactaaataattcaccaaactcactaaattcactaaaaaaactattttcatatatttcactaaataattcagtaacgaacaatagttcactaaataatttatttatttcactaaataattcaccaaattaactaaaatcactataaaaattactattttcatatatttcactaaataatttactaatttcatataacagaaaggcttgtttaatgctacaatagaaattcataggaatataagtacttcattcgtacaaaaagtttttttaataatacaaaatatttcatccatcacatgaaattcctaaaagatctatgttcggatattgcttgtggtacaatatgtagtggtttggacaagcgtgaattctactgacctctaaccccaggggacacaaaacctgattagcttcatatgtcatctcggacaatgtgttctcattaggaagcatggccttcaaaattcctataagatctatgaaaatcttgcccgtccatccactacttgccttcaacttcattaggtccaaggtagctgacaatttggtgtgttttgctttgcacccggcatacagagacatctccgagtcactggccaacttgttaaactttatagaatctctctcgttgtaagctaggttctcaacatcacgtaacatgtcttgcagtagattgtgatccacatcaaccatttcaccgcccagtggagaatgtacaaacatgtcatgctcatctccatcttcctaattttgtgcaccacttcctgattcatgctcatgatcttcatgttctagatt

SEQ ID NO: 89226 - DNA, 980 bp, Oryza sativa
  unsure (1)..(980): unsure at all n locations
ttgggntntttgtttgttttccgcttgcaaatgncaattatgggacatgtaaaaaagcagaggaaaaccaagaatagagaaaaagcatactcgaactgccaagcttttaatttcagaacacacctcatcgaactcattcagttcggtgaacaagctcggggtgctggcaggtaagacaagattacttactccctccacaaagggaataaggtctgctcgggtctcaaaatcgccaggggcgaaacggggcgccgcaagagaatactccgaaacagatgtctcgatggccgcccccttccccttcgccttgactagcggcgaaataacccgctgacgcatagggctgccgaagaccctcgccgcagctgtcacgatccgttccgcggaggctgaagccccggcggcggcgctaccgcctgctccatcggcgccaagtgaaagaacgggggcggtcgaaaagtctaggctgcggccagcaggcgaagtcggagtctcgtcagaagactcgtcgtcgctgaagacgcgagcgacatcgacaagtccttttttcttggaaatccttttgaccgaacctcccttcgccgccatgcctgccgaaaacgcaattagcgccttcgccccatccaactcttttcagcgaaggggggagctgttcgactccaccccggtctcattgtgacccgggcttggagtaggagtatagccaggggtgtcgacgcggttttcgaccgcctcatccacggccttttcgacctcaacctcctcctcttcctccccttcctcttcgacgtcgtcctcgtcgtcggcgtcggaatcggacgaaacaggaacccttcgtttcctgggcgcaagctttacttgtccgcgcgttcgctttcacgaaggtcatgcatcgtcgtaggcctgtgggggttcgcccgaggaggcagttcgccgtcgtaaacccggttcgctcggccacccgcttgtcgcgttagcag

SEQ ID NO: 89227 - DNA, 784 bp, Oryza sativa
  unsure (1)..(784): unsure at all n locations
gcgtcatgaaatcactgcanatncccccctgttcttgattacaggacctaatctttgatgaacaaaaacccttgtctgccttagccgattacccttattatatgatcggcttgagctctcgacaatatcactgcacccagggcagttttcaatagatggcaacctcatgccttcattccagcagaatctaaaaaattcacaaccccaatgaggatcaaaaccatcatcgtattcttcataatgcttctcttgctgcttgtcatatttcctctgatatttgttgataatcttagccgaattcacttgaaaaccccttgcgcgggtcctatcggctgtctggccagctgtatgcaccatattaacaggaaaaggattaccatcgaccttcatcggttttttggaatcatcaaacttaatcttgcccccctcaatggccacctggatctgatgtctaaaaaccttgcaatcgttagtagaatgagacccaaaattatgccatttgcaatacctctttttgcctaactcctcggccgatgggattgtatttccagcaggaagttgaatttgcttctctcggagtagcagatcaaagatcttgtcagctttagtaatatcaaaatcgtatttctcttcttttccagaacttttcacccattggcatggtatgacctttttactccttacccattcggccgcagctatttcagaatcatcctcattatcatcctacctatacatgtatggacaaacatgattaactctcttagagttcttcctaacttcc

SEQ ID NO: 89228 - DNA, 2380 bp, Oryza sativa
  unsure (1)..(2380): unsure at all n locations
ctgttatganttcgcatacgcttaaccgntttgcaattccgttcttcgagagccgattctaacctcccacggcaaaacagccacatgcccataaacaggtttgtaatgagggatttggatcgatccatgacaagccatcctataagaccacaacgcttcggccaaccgagtatgccattgccgaggataatcagaaattttccgcttaatcaatttgatcaaacttttattagacgcctcggcctgcccattagcttgtgcataataaggtgaagaattcaacaatttgatacccatgctatcagcaaactgaacaaactcatcggacacgaagattgaaccctgatcggtagtaatagtttgaggaataccaaatcggtagattatatgttcttgaacaaattgaatggcatcccgagaatcaactttcttcaaaggaatcacctccacccacttggtgaaataatcagtcgccaccaatataaacttatgtcctttacttgatggtgggtttatcataacaatcatatcgactccccaacctctaaatggccatggcttaataataggattcatagccgacgccggcgctcgctgaattgctccaaacttctgacaatcttgacaccccttataatatttgaaacaatcctccagcattgtcggtcaaaaataccctgcacggcgaagtaaccacttcatcttatgaaccgattgatgagtaccacaaattccttcatgaacttcgccgattgcaactttagcctgatcggcactcaagcacttaagtaatactccatcaatcgtccgataataaaactcatcatccaatagtgtatacattaatgccttataccttaatttcctagaagccgattgggatggattactcaaatatcgatgcacatcatacctccaatcatcggctatcattgctgcaatttcaactttaacatctttgatcattggcttatatcccgatgccccttgggctaaatcattagcatcaatattttgctctcgataaacatgctttaaagtaaccagccgaaactctttcattagttcttggcacttctcattataaaccatcaatgtatcattcttgcattcatactctcctgccaattgactgattactaacagagaatcccccatgatttcaatggtatcggcttcaacttccctgagtagttgcaaccccttgagcactgcctcatactcagcttgattattagtcgcatacggtttaatagtataagcaaactataaacatgcccccctaggggagattattactaagccgataccacagccatgagtacacaccgatccatcaaagaataaagtccacggtactatttcaaccgagccgattgaatcatcacgatgttccacaataaaattggctatagcttgtccctaaattgcctttggagactcataccgaagatcaaattcggttaaggaaaatatccacttcccaactcttcctttcaatattggagccgatagtatgtatctgactacgtcggctttacatataacagtacactcgttagatagtagataatgcctcaaccttgtacacgaaaaatacagacacaagcataacttctcaacaggggagtaccgagttttagcatccaagagccgacgactaagataaaatacgactcgttccttcccttccaactccggaatgaagactgagacgattgacttctcaccggccgataaatataacctaaacggtattcctttctgtggaggaatcaaaccaggagtagagctaagatatccttaatatcatccaaagccttttgctgctctgcccccaaagtaaattgctgatcggctttcaatctcaacaatggtgtaaaaggttctaaccttccaaacaaattagaaataaacctcctaacaaaatttaccttgccgatcatctcctataattctgtcttattctccggaggctgaatcttcttgatcgcattaacactcctttgagttacctcaatccccctttcaagaacaagaaatcccaaaaactggccagccgatacaccaaaagcacatttcgtcagattcatctttaggccatattttctggttctctcaaaaaccttcctcaaatcggctatgtggtcctctatttctttagacttaacaatcacatcatcgatgtagacttcaaccaaccagccgattagatcatgatatatataattcatggctctttgatatgtagctccagcactcttcaagccgaaagtcatgacaacccattcaaataagccaattgcaccagaacacctaaaagctgtcttatgaatgtcttctgcggccatccatcacacggcggccgccatcaaaacgt

SEQ ID NO: 89229 - DNA, 1037 bp, Oryza sativa
  unsure (1)..(1037): unsure at all n locations
ggttgctctgcttggaatacctctagaatctcagcacaagatcttccctaacttaccgcgttccctttcggagggaaggtaatctttcccaagcttgcctggcacatcgacaatatgcaacggattctcgcgggtcatacgtatccgtctagtagataataagcccggagatggcaggtaagacctgggtggataatagccgatcgaattgttaagtcgaaggaagactttctgggatagcaggagcaactagtcacagccgatgtgatgccttcccacagccgatggagtctagtcacttgatgattgccgtacagtggaacaagcaggcgaaggctataaaatagacaagtgttatatagacgccggttgagtttgattaagtaaaagaattaaagacatcttactggtggagccgacttgggaatcattgctgctggctttttcttcacaacagttttctttttctacaaccacaaagtctatgggtaattagccgaagagggaagtaattttggtagaagtcaaaaagagatgcttactcttgtaaaatgaactagggcggaaggagttggaggcgtttgcctgggtgaaaccgatggtgttcgttctgtatcgcttacttcggctgcagcctcatcaacgtcatcttcaattatttcttcatccagagcttgttcactggatggatctagagcaggtagatcatcagctggtgtagtcttctttgtcttagctgtcttagccggggctgaaatatttacagtcgatgatttgttgtttcttttcttggcagcatcggctggttctctgataagcccttggagaagagctgaagtcttgggggcattatagccgatgatggggggagatggcccacctccgttggggatcagtcctggggcatactcgatatccctgacgttgttgctttggtgagggaacgaagattctgttgtctgcaaatcaggagaaaggttagctaaggactaatcgaccaagtagtgttcnnatngngcnttgaaggggattcaaaa

SEQ ID NO: 89230 - DNA, 2083 bp, Oryza sativa
  unsure (1)..(2083): unsure at all n locations
ccccccccccccaccatatattacctccctcaataccccttccacctattgtcaatactcctagtgttgtaaaaagcccatttgtctttattttaacacacgcaccgttttgaattgccaaaccacaaacctttcacccttttttttcaaagccttttcattactgtttttaacaaaggcgccatccgcccccatggttttattggcctcattttctttcaatcgaaccccggcaaaaatttttgtatattttggggccaacctatccctccatttctaggctttttggctggtccccatggtttttttttagttagctctaaaataccctatgcgagtctaacttcctggagagcgcatgcccccacctccttattgcccttcaattcccatttaaattcaaggtttattttttccacccacctcattcttctcgaatccaaagccctagatttccaccttgaattgattgtttacaaggcacaaaaagtgattgattcccataccgcccatccagtttaccaatttaaggaagaaattgtacctttcagtctccagttccgcagaagccagtgatcagtttaaaccaggctgcgggtgaagaacaagaggtagtagtggagaaaaccactaagaagttgaaggatattcccatagtcagagaggtatccaaaggtttttcccggatgatctgacaacaatgccaccaaaaagggatatcgagttccggattgacttggtacctgaaactgcaccgatccacaagaggccttacagaatggaagccaacgagttggcggaagtcaagaagcaagttgatgaacagttacagaagggatacatccgcccgagcacgtcgccttggggtgctccagttatttttgtggaaaagaaagataaaaccaaaaggatgtgcgtcgactaccgcgcactcaatgaggtcactattaagaacaagtatccgttgccaaggattgatgatctgtttgatcagttgaaaggagctacagtgttctctaagatcgacctgcgatcaggctatcaccagtttaggatccgcgaagaggatattccaaagacagcattcatcactcggtacgggttgttcgaatgcacagttatgtctttcggactcactaatgcacctgccttcttcatgaatttgatgaacaaggtgtttatggaatttctggacaagtttgtcgtggttttcatcgatgacatacttatctactctaagtccgaggaagaacatgagcagcatctccggctggtacttgaaaagttaaaagagcaccagctatatgccaagttcagcaagtgcgacttctggcttaaggaagttcagtttctcggtcacatcgtgaatgctcaaggagtagcggtggatccagcaaatgtggagtcggttaccaagtggaccccaccaaggacagtcactctggttcggagtttcttaggacttgcgggctattaccgtcggttcattgagaacttctctaaaattgccaagccaatgacacaactattgaagaaggaagaaaagtttatctggtctgctgaatgcaataggagttttgaagaactcaaacgacggttggtgtctgcaccagttttaattctgcctgatcagacgaaagatttccagtttattgtgatgcatctcgccaggggctangatgtgtgttgatgcaagatggcaaaatgttttctaatgcttcacggcagttgcgtcctcatgaaggcactacccacccacgatttggaatggccgaagtgttcatgctttaaagacttgcggcactattcatcggtaaccgtgggaagtttttacagacaccaaatctaaagtcatcttaccccaactgacctgaattntgccaaccaagaggttggagctaatcaaaattttgattggaaacacatttattccgcaagcttaaggggttcacacccctgaaccggaaagaacttgaccttccagggtaaagaactttcttggggttcaacggattggaactatgaccttgtttattaaccacgatttgggttgttttaggcacccccacacggtgacaggttt

SEQ ID NO: 89231 - DNA, 1513 bp, Oryza sativa
  unsure (1)..(1513): unsure at all n locations
caccgcgcttctctccttctactaatattccgtctcgccctgtatcttctnctaccccactgttactttctctcncctccttttcccctcnntngcgttngatatacttnnntcnnncnnnaagatgtccgatggtggacgatcgctccttaccacccatnctncctctttcatttaatcctaatctttcattcatttcccaatcccaaggcgagtgccatttcttattattcaaacacaccctaacagtctaccgggcactcaatgaggtcactattaagaacaagtatccgctgccaaggattgatgatctgtctgatcagttgaaaggagctacagtgttctttaagatcgacctgcgatcaggctatcaccaggtgaggatccctgatcccatcggtcgcccactcacaagccagggtccttgtgacttggttcattgctcctgacgttacaaagcgcatagctagtgattattacaacttgggaagcaactatcaaacatgtttcaccaaaggtattcacaatgtttcactatgtatatatataatgttgtagtatattgaaatattcttttaactaaggagacggtgaccgtgaacgagaaggagccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaagagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgcaatgtggtctcaggtgttcggttgacgactggcaactggcaaggctgttttgtttggggtaatcctgatcctgaaggaaaacatgaaaagaccatgggaagtgaggggtactactatgtcccggacatctgacacgaggcatatcatcagacaaactgtggatcatccactgcatttgggcttttcatttgctctctctttgttacttacgaatatatacctctcacattttcttttagctggagcaacaagcatcaaaancccgt

SEQ ID NO: 89232 - DNA, 2367 bp, Oryza sativa
  unsure (1)..(2367): unsure at all n locations
aaactaaacccatcgtcgaaagaacagctttcttccccaaaattgatattgcttagtgtgctttcacccaaggccccaaagtcttgtttggttggaagcttcggcccccatgcccacctttattgccaggagtttcgtgaagttgacaatgggcttgnctggcaacaaactnaccatttaaatgggtgtgtcgnccaaagctttgtccgtggggtncgnctgccatccaagtgagctccctagtgattgcaagaaagagatcaatggtcgagcaagaatagtctcttgggcaccgcaagaaaagggtactaggtcaccttcgtgtcggcgcattcatgacgcataatgnatgganctcgacgatagagagtatatctgaaggcgtgcgaatgatatgtagnccatgttttggagatcagatggaaaatgcgaggtatgtttgtgctgtttgaaggttgggtgtgaaaatgaaggtagggaagtgttctgcagagggcaaaagttcaaactgctgttgagaaattagtgaatggggagaaggtcaaaatgtgaaacagagaatgagaaatctgagaatagaagctgaaaaatgtgttagtaaagaaggatcatcagacaccggtctacgtaacttagtagattcgatattatcttttggaaaatgttgattatctgcacagatataacgtagtcatgtcttcgactaatacttgtagcctctttaaatgcggatggtattgagaagatcattaaatgttgtaatatctagttttcatctactactaataaccaggttcaaaaattgccgaatagaatttccaaaatttcagaccgcatcaaaataggaagctgtttcgcctgtttttctttcgaatttcgcaaaattagttcaaatatgacctaattttgtgcaaattctaaattattttggaccgttatattccaaaatatccaagattatttcggtcacatcggttgcccccggtggaaatagccaaactgatatattacattctgctataccagaaaaaaatgaaaatatatttgttgtgaatttgcataaatatacaaaatttgaaaaaaaatatatacagaaattacctgatttgcctggcagcaggatgtacaaaaataatctttaatatgtgaaaattactaaataatctttaatatgttttttcaacaatcaagtaaggaataaacatgatattagcatcaaatgaaactgtttgtcaaaacatttttgttgaaagatgaatttaatagactctttagaagattgcagattaaatattatattgttgaccaagatttgcttcgcaagaagtgaaagatgggaaacaaatgaaaagtagggtttttcatgaaacaaactaaacaatattccactaacacggaatatatggatagatatatgctaagtattataaaaataatagatagatatgtttaaataatgtgagaggagatgattggatatgtttacatgttgatttgtataattcaataaattatagataatatttaattcttgcataagtaattatttctacttgcatgttgagctttagattgagtatgttgtatttttataatttatttaggtatattcataaaacattgcgtgaaaaatagtatattttagtgtgcgctagaaatgttactatctaaacaatattgtgttggtctaaaatgtccaattaataggcctagcagctcgggcagacatgattgggccagagagagcccagtctgctgtaaagaagcgaccaggcccagctgcagggagcaagtgcttcggaaggaaaaactccatcttgactccctcaagtatcttaatagtaaaaatcgagtacattgactcactcaactattaattaatactaagcattttaccgagctcattggtttgcgaggtggttttggctgacctggcagcctaagcatttaaaaattaaaaaatagatgtggggcgcacatgtaagtgacagaaaaaagaaaatctatagccacaagtccgacatgaagaacttgagatagaagcttgcccaagcgggggttgccggcaagccctcttgactccgaatccaacaccatgccattgatgatggacaacggcggtggggtgccgcatcaggatggggagttcttcgagctagtcgagtcgatgattccgctcgaagggaacagtgcaaagcgccgttgttgctttggcagaggcaacagttcatcaacgggttgatcgatattcacgatcctggcagtcgacgtacgacagaacatattttggaaaccctctattaatgaaattagtttcatttttagttccaccaaatatgattcacctagtgtactcacaatgttata

SEQ ID NO: 89233 - DNA, 1191 bp, Oryza sativa
  unsure (1)..(1191): unsure at all n locations
cgtaccaagggcacactttcctgggttttggtgtttacccaagggggaatctgggggaaagaataattaggtaagccgggccagttccaagacataaccgttaggcccttccgatgagcagagccaattttctaaagagcaanatncncaggttaccttggttcgcaacaaggttcttggctctgccagcngaccaaaagttgtgnccacgtaaaggaagtttgaaccatatctaaatgaaacaagtggtaaggtgttaccnctcttctagtttacggnnaaaggttgtccgttgnaagagaatgagaagtgaatgcggggcatgagagcccggaaaaggcaaaggggagggtagggaggatgttaccgcccctttataggtcagagaaggaaggggaacttctagggggagctcggctggtcatcaatggtggcagtttggccagagttaaaagattaggcagattgagacaattaatgcaccaattgaaggggaattcggtgggcattgatgcccatcaaagatgaaacctatttttgcagttcataagaagacgaaacgcatgtggagacatatctagagggtcggcaatgtttgggtttgtgggtcaaggagaggagcggtcggctgaaggtggaataaaaaaaaaagtacttcctcagtttcatattataagactttctagcattgcccacattcatatagatgttaatgaatctaaacacacacgtgaatgtgggcaatgctagaaagtcttataatatgaaacggagggagtagtaagaattttagttacttcaaaattgtgtttatttttctttttctattttcaaaatttattttatttttattttgagttctaattaatctcgtattatgttatacatggactattttttcaatattacttatctttattctgaattttaaccttcaagtctagctatttgatgtatggggcatcgacttcatgggacctttcccaaagtcctatgactgcgagtatatcctagtggccgttgatgatgtgtccaagtgggtagaggcaatgccatgcaggaccgcagacgctaagcacgctcgccggatgtaaaacgagactattttccctcgttttggaactccgtatatggtgataagtgacggagggtctcatttcncgnntngcnnantggannatgaaatcaaaa

SEQ ID NO: 89234 - DNA, 723 bp, Oryza sativa
ccgcgatgcgaactgcgtacgagcccgaatccgaatccaaatgtgtagatctttatctcttgtcttctatggaccaaaagtgacgtggtgagatgaaagaaaacttggagaaggtcttggtttggtccccaatcaacttcttcaatcatctatgctttccttacgctcggtctcttttctttcgcccaagcaagcacctctgcgaacaaaaacacatgaaactcattgtgtagcaacgtttattcaaatatataacaagtaaatctaatatagaatatatgtacctttatttgattaatacataaggtagtcatggttatatccgagctagttatgtcctcatcatcctccccttcttgattggaatccgtcctcagtttcaccttgtcatggagcgtattgcacttatctttgtctatcacagcatcctgtgcggaacatttcttgatggccatatgattggatcctaaaatctttgtagtcaaaaaaccacaacactccccttcttgcaaaccaacctgtaactcatttatacaactagaggaactagatagaaaataacttatatgcatgcggtcctctagacaacacatttcatcatgaaaaggaggtatagtcaaattcgaacaaatatatactcgatgcacattatattctcctttactatcataattgcccattatatgaaaaatcacatcagaagggcatggcaattcaaatcta

SEQ ID NO: 89235 - DNA, 1197 bp, Oryza sativa
  unsure (1)..(1197): unsure at all n locations
ccatgaggtgcccgcaatatatcctttaggttggttttcagtgactgccgagtgcccccattggcccattcccaaacttcctgtgtattaaccagcaatcccaggtgttttccgggcagtttccagtcccagattaaaaccacgaggggtttccagtttttttcctaaagctttgaaggaacggaacaggcgccaagctttgggtatgaacccaatgattggtgccccacacgctgggcgttgaagcgcgtaggcttcaatgtcatcggtcgggtcatacgtttctttgtcgcggggtgaccatgcagccgcaccggcctggacaatgttgttaccagcgctgcggcccatatcgacttcaacaggctcgaacgcttccccggtcatggtgtatttaccgctgagcaccgccgaaacagcctgtttctcttcgacctgagcaatcgccagctcttcatccttcatgttctgaaggataatgcggcgacggcgatagaccgggtcagcgagattctgcggatcctcatccggcaggcggcggagagtcatcagtgggttaacttcgtgtttcggcttcacataacccggcgtgaattcagacgtgctgccgccacgggagcggatcactttgccggagacaatcggcgagacgtaaagcgccatattgaccaggccaggaatttgcgacaggtaaaccttctctgtactgaagggataggtttcgcggaaaaagatacgcaggaaaagcggatcgaatttgaatttcttctcattgaccgccagcagttgggcagtggtgtaaacggacatagatttttcccgtaaaaaaagccgcgcaagcggcttttatgaatgatgatggttgtagaaatgcggattaaacgatgctgattgcagtaccggcgaacgcgttacgtttaatgttgtcgtcggtgacggcagatggccagaggacatcttcaatacggaaagnnnnnnnnnnnnnnnnnnnnagttccgcgctgttctggtctgcggttacagccaggatgcccattgccgcgccagcatgagcaccatcccagacggtcagcttgccagaagtggcatccagcatgagcggcgtcatggctggagtggaagccgtcagttcgccaggaccatacgcagtgtgcgccgggtcgctgttaccgagaggatgtgtctacctnaaaggcc

SEQ ID NO: 89236 - DNA, 1205 bp, Oryza sativa
  unsure (1)..(1205): unsure at all n locations
tcgtgccnttgagatcgctaacccagatgaggcgtatgaaccggataatataggaattggaatcattgcaggtctagcatatgcatctattgaattaaatcaaaaagcaaaatgcattcgtccaataatttttttaagggataatatatttaggtcgctatcaaaggaagatcctgattactcgagaaatatagagggtcaagtcataaggttgcattgggactgggcacaactcctaatgctgtcagctaaaagaatgaaagtagcatttaagctagatattgagaaagatcaacgagtttgggatagatgcacagcggatgatcttaaagggaggaatggttttaagcgatgtttgcaatttaccctttaccggcccagggatttactatcattgttgaatgaagcttttttttccgcattcagagagaatagagaaactatcataaacactgacctagaatatgcagccaagtcaatttccatggccagacttgaagatctctggaaagagtatcagaagatctttccttcaatacaggttataactagtgcatttcgtagcattgaacctgaattaacagtttatacgtgcttaaaaaaaatagaagcatctttcgaattaatcgaagaaaatggagatcctaaaataacgtctgaaatacagttgttaaaggcaagtggaattctccaaagtttgtatagtgtaggatttgttggtattcgtgataaaaacacctcatcctattcattttgccatgacgggcgaactccagataaaggttttgaaagtaatgaaaaattattaattcatccatgttactggctgggtttgaatctaaatcgtaatgcacttgctccagaggaagcagaggagataaatgacgaatatgatattaatattatttcagataattcagccattagaaataaaacaataggtcaaataactactcatctagatcagataccgataggaaatgaaggtgccactgatttgacaatggtgtttaaaacacttagaatagtattgcttccaactaacagcatgaagttccatcaatggnaacccagttaaagaacagatatattgcgacaatggttggcaactggattttggaacagtattgaaggctttaaacaagcaagttgtttgaggtaaaaatttgagaaataggccttggtattacactccatcatattag

SEQ ID NO: 89237 - DNA, 3170 bp, Oryza sativa
  unsure (1)..(3170): unsure at all n locations
atttggnnnnnnnnnnnnnnnnnnnnnnnnnnnnnnnnnnnnnnnnnnnnnnnnnnatgtttttaacgacttaaaaggtaattctaaaaatttcaatgaaaaagcttcaaaattaagttttaaaaattaaactttggcagtagtagttgattctatatagggcaaacgatgaggcccacaaaatttgtttgagatatgtgcgcttctaaataggcataagttcacttttcagtttgctaaactttgtcagacgcagccgaagaacatctgtatgaggaactccatgtgtcaagcagaatgtggcaaataaaatgtcagacccggatgcattgcagacttccatcttgttgcatcgaactaaaacagttcaattcctgtgaaaaattttcagacgaacatatatatactacttgcataagcccgttgcaacatttcagttcatactacttgcccggagtatgaagtatgaaatgaactgttgcacaataattgcataagcctgcacgtgcaagattaacgaccaaagtatttgccaataaaaactctaagtggttgtttggatcttaaaagatacgaaccagttttcagaaaacatgttttactagcaaattcgctcattccaattacacagtccaaacagataaatatcacaattcacaaccgtagtaagaaatattttttaagcaaaaccggtttaatcaaaaacagatgatccacacagcctcttaatgcataacaaaaatataaatattctctcacaacactcacactggattctgcatctgccctacagcaaaacagcagatcagcattattcttcatatcacttgttcctgcaaaacttcatgggtctatccatggactatggacttgcaaactcatcggtgcaactctcccactggccatacccggagctgaacgttcctccaccgttggtgaccgttcgcacggagatgccccactgccgggccatgtccctgatcgacattggcaccgggagtttacgcagggcacgctggaacaccttgtcaaccatgcctgaaatcacgctgtacattccctggtgctgttcatcaccatcttcgtacaccggggagcttcgaggataatcagctgggacaaatagcttcgccggcttgagaggagacgttccgtatgctgcaaatggtagctccatgtcttgtgcaagagacactgcattgtagctgaatttgatcactgtcccaccatgtttgtgaccggtgatactgatcacggtatcgaaaagctcttcgttgatgaggttgatctcatacaacagagtgatgtgaacactctgttctttctgcctctttgtctcatcatcttcatgattaaccaagttgtcaatatggcttagctcataagctgatgttctatcagtaatgtttttccatggatggaaaatggtcatttctgcaggttgctcttgccgattattctgaatccgtatgccaccagtggatgggtttggctcaccagtaggcttgaggattcggggtgactcacgacttgcatttgtctctttaattttaccattcatctctctaatgttcctcctcgaatcaactcctccaatacctccatcttctgaaacatttcgatcggccaatcgttcgggaatccccgatgaccaacctgcacccctgcaacgttgatgtccatgtacatttggttcaacagttggctgtccttgggttcttactgaattcaccaaatgctgaagaagctgattgcaacaccaatgaaatgctagtggagggattgctccaggctgagtgttaagaatctggtggatcataaccttgatcaggacttgcagctcgacaggtagccttgtgggaacagctatatttgacgcagttatatcaatgctgctggtatctttcaatactctgtccacaaattccttccaataggcacgctctgccacacgaagtccagccaatgccgcatctctggttgaacacaaacgaaaaaaatggtgggtttagaaattcagatcgaagtaaaagctaaataccttaaaaaaaatgttaaagcttcacaatgacatcaaggtgtcatcttatatatttccagaatctatccacttatcccctaaatgagagattaattaaaagctaaatcacaatgacatccaggtgccatcttatatattttcagaatctatcctcttatcccctaaatgagagattaattgaatcctcagaaagctaaatcacaatggcatatacaccaccctcatgaacaagtaattaattgaatcctcatgattttgtgacacacaacgcaaactgctcatgatcaatgcaattttccaatttagaatacggacaggagaaattcagagaataacaagaaaggaacaaaaggactaagatcacacatcaaagcagagaaaaagcatagtacgtactttcagttcttttaaccagacaaaaagcatgttgacgcaactggttgttgaaattttgacttgcgtagatttgatttgaatcgcataataccgttctttaaaatgaggaaatagttaaaaagaaactattcggttctttccaaaaacaaaagaacaaaaccgatcccgttcgaataaatttgatccaacccgaatctcattattcagtactacttaatttcataactgaatccaaccaatattacagcactcatgccgtcttccgagctcgacaaggcaccgcccgcatggcggaccgtaccaattaccaaagattttttttggcccgtgaagagaaggttggagaagagggggaagacgagagggaagaagaagacgtcctgtagccaggccgcctcctcgccgcgttcccggatgacgagggaagaagaagaagaagaagaatccggacaccgccgcagagatggcggcggcggcggttgcaactagggcatctgggcatcacaacgtgggcagatgggcttaatgggcctcacgatgacctgggccaaaatgagcaaccttagtcattgttggagtggggcccacatgtcaacggccgctcgcatcgaatcaaatccatcagccgttgtccacgttaatcatattcatagtatagcagcattcacatagaccctctatcatcaagaanaaaggggagcatgtaattattncccaagatcgtagtcgacct

SEQ ID NO: 89238 - DNA, 820 bp, Oryza sativa
ggaattaaatataaattcttcttgagtaatttagatttatcttgtgagaattacctcttggttaattcctaattagcatacgggattattgttccctataaacagctaaaatatagtgattgctatggtgagttataaacactaaagtagatattaattgcttagacgtggtgtttgggtaattattatgcagtaatttctgcgtatcccacagtacgttgaggtgggtgtagaggtggtgatagccctcgagatcactaaagtcatccctgtccgggtacgcagtagagcgacatctgggaacagcgggttgccagtgcctgaagtattgcgttaggattaaaattaagctttccctagacactgtttctcactagtaaatcctctctatcctggcctattatttgcttggtgtccttggatgaaccagaggaagctctgatcacacacgttcccttggattcgatacccttggaatactccgtagaggaaagtgctacatcggtatatccgtgcgcttgcggattttatctgtaaccgtatcatataccaacacacgtacatgagtcggaggaggagcaagagagataccgaggcgaagattgcagatcttgagtacaaggtatcgagctacgagctcagcatgcaagaggaggtggcaaggaaggtggatgaacgcatggccgtacatcggtcccaggatccccagacgtacattccttctgtaatggtcaggccctcaggcaatcgtagcagctgcaccttaacggggcaggtagaattacagagcatggacgccatgcaaacttaagacgaaacc

SEQ ID NO: 89239 - DNA, 1950 bp, Oryza sativa
  unsure (1)..(1950): unsure at all n locations
aaaaatttggggggtggggggggttaatttcttcccccttttaaagaaggttaaataaaaaaagnaggncccatacctagcggaaagggggatcgaactctggatcccgaagccaagctttctctaaccctaggttgtacatcggagattcaaaggctttccaagcatagaagaatcatcatacacacaggagtagggtattcggcttcatagcagcccgaacctgtataaatcccttgtgtcttttgtctcaaaaacctcggatctcacccgctgcccttggcggaactcaaaaaaggggggcctcacggttccctggtggagaagatcaccctccgacttttggcgcgttaggtagggggcgcgttcgtgatttttgaggttctttcgagcgctggcatgataagcatcgcgccgccaatgcaggggaaagcgcagcctcttcaagagtgccgtgccaccccaggcagggggctaggccccccgcctcttccccgggtaaggctggcggccaggtatttatggcgagtcttcggaatgtccaatgacccccaaaagtttcggcccagcttcacagaaaggtaccacggtagcgtcaacacctccgagtccctctagaaccacacgacgatcatataggcggcgtggggtgatgaccgggtcaaggcaaattttttccccatggccctctagggccaagcgcggggatcactcatgaacctgccacccgccttggtctactcctgggagggctcttgcagttgagctccgggtgccgtcgaagcccgggaccccctgtgctggctctttcgtaacggctagctttggtcccgccggctgcatacagtgcccggcccggctcaactgatcgtcctttcaagcttcaagcttcccaaaatggttaggaacacatggtgggaggccctttttgagctaaaggtttgaaaggtcgcgacatgcaagcaaggtttgtgtttgcttcattcatacaagcgattctttgctataagtgtgggggctatgattcctagttctatcctagccctgcgtcgagctctgggcgccgttgacgcccggggccccctgtgctggctcttccgtagcggctggctttggccccgccggctggctacagcgcccagcttggcttgatcgtgggtaaagattgttggctatggaaaatttagtcctcgcactcgcgcgaagataatcatttgcatagaattattgttgcttatatttatttctctcccatctcttcctcgcggtcccgcagtacccatgtgtcgcgcgctcgtttgccccccttggtaacaaaaagtttgtattcgcttcatccattcaaacgattctttgctaaaagcgtgggggctacgattcctagctctatcctagccctgcattgagctctagacgccgtcgacgcccggggccccctatgctggctcttccgtagcagctggctctggccccgccggctagctatagcgcccagcttggctttatcgcgggtgaagattgctggctatggaaagttcagtcctcacactcacgcgaaaataatcgtttgaatagatgaaatagaacacgaacagaggttaacaaaaggcaggggcaagtgaggtacgcggcgtaaggtcacgggcccgagagaatctaacaacatttgctgtgtatataaaggaaataagttcacggcctaaggtacgggctaaattcctgagcccacggcacctcggaacagcggaaggaagtgggaagtaaggctggcgtgtgaacgtggctaaactcccaccggccaacttccaggatgatagaacagaagaccggaccacatatcattagactaggagagtggcgtcaccctggccacctagggaagggtttggtcagggctaacgccgggggctactgttcgtgatatgggcccagggtatcattgttagagga

SEQ ID NO: 89240 - DNA, 1301 bp, Oryza sativa
  unsure (1)..(1301): unsure at all n locations
cgcgtgcnttttgaatcnnnnnnnnnnnnnnnnnnnnnnnnnnnnnnnnnnnnnnnnnnnnaatcctacctggattttttttttttgggatggagggagtattgatttacctgttagtatgttggtagcttggaaacctaagttctataattatgctcaaatgtgtgtaatgcctaatcagcttaagatggtcatgtattcatcttgaacttctatcggcagtgaggcagtctgagtgatgggaaggaatcaactagtaaatctttttcttatagtgcaccattctaaacttgaaatggttttgtgttaccatacttagcacttatccactgttgattaagataaagttttctggcatcaccaattgctaatttgagtcaggtttaacatatcctcactcacctatgcatgtgtagggacataataaatacatggtttgtcacagagacaggacctaagttaaacaacacctgaatgctcagggtccataatggcataatgtagcttacattttatttacatagtaaatggattactaaatttcacttttcgggtcaatgcaacaggtcttgaggaagttggtggacgatgcatctaagtttttgaatgacaaaattaccaaagcagtggttactgttcctgcatacttcaatgactcacagaggacagcaacaaaagatgctggacgtattgcaggattggaagttctccgcattataaatgagccgactgctgcatcccttgcttatggttttgagaagaaaaacaacgaaacgattcttgtgtttgacttgggaggcggtacctttgatgtctctggtatgttatgtgctagaacaccaaactgtttacttttcttgcactattactgtagcatagggatctcgtggacctgaatcttatcatacttctatgacagaccttttttcctagatggatcgtactggaaaatagatgatgaattgatttgatcaaatggaatgtgaaatgctgttgctgtttcatatctgtgaaatcttttaccaaggttcacaactgtttagccagaaacatgagttctttatatggttcctccagaacttaatatattgtcttttatgaaggttcagaactatttagccacaagcatgagttctactttatatggtccctcctgaattaaacatatcgttactaaatatttgagttgagtagctccttgttctatcatcatacatatagaggctgccctcgagttttttaaatagatcaatatttagttaaaaagggacttntgaagagagatactcaaagcagatttt

SEQ ID NO: 89241 - DNA, 2490 bp, Oryza sativa
  unsure (1)..(2490): unsure at all n locations
gcgggattgatatacnnnnnnnnnnnnnnnnnnnnnnnnnnnnnnnnnnnnnnnnnnnnnnnnnnnnnnnnnnnnnctactaaagaaacattatcctgcagtattggaggttggagatggtgtgtttgaggtgctttccacatctggtgacacacaccttggtggcgatgacttcgataaggtatgtaattccatttttatttttaagagattaactactgccgaatctccattttggaatttcgtgaaaatacatcgcaactgttcgaactgttttctatggaatgttgcactatgcatttttgacaaatattatatgatgtggtgcctcttatgtgtattacattattctttctttggtaaactcacaatatcagtcaaccaaaatttctcaataggttgctcgttctatataattatgttattgcagttttatttctgttgggtattttactttggagccatgactcatgaaactcctgtaagtatgagctctgtgtgttttgtgctggaatctgacctcttcaagccttccatatattctttatgtaatgcccatgacctaaaaatatgtaatttgaacttttgaaagtcaacttaggcttcgttcgttcccgggtgatctgggagattgagagagaaaacatctcgttttccgcgcgcacgcttcccaaactattaaatggtgcgttttttgcaaaaaaaattccataagaaagttgctttaaaaaatcatattaatccatttttaaaatttaaaatagttaatactcaactaatcatacgctaatggctcacctcgttttgtgtatctttccaatcttcccaatctcctcaatccccttctcctcaaacacacccttagcatatcaaaggtctattggcattgtagtgtagctccatggacaacatacctatcagttgaactgattcttttactgacagtatgctatatttattgtttttttttaatttgaatgttatccttgaattatgtagaaagttgtggattggcttgctagcaactttaagaaagatgaaggcattgatcttctgaaagacaaacaagccctgcagcgactcactgaggcagcagagaaagcgaagatggaactgtctacgctgtctcagacaaacattaggtgagcttctttccaattgttctcacagagtattctattgctcatttggtgatttttcttcttaaataattgaatgtcttgaattgcagcttgcctttcataactgctactgctgatgggcctaaacacatcgagacaactctctccagagccaaatttgaggagctatgttcggacctcattgataggtaaaatatggacattctgctgatatataagcctattgcttaggaaaatgatttgcattttctcaaatttttttaaggcttgactaatatgtttcttattgataggcttaaaactcctgtcactaatgccttgagagatgccaaactgtctgttgataacttgacgaaagtgattcttgttggtggatccactcgtatcctttccgtccaagagcttgtgaagaagatcactggcaaggatcccaatgtcacagtcaaccctgatgaggttgtttctcttggggcagctgtacaggtcactttcttgtcctcacaagtgctttaatttgttgttctttgcagaaaatcatccataaaccttctaattacttcactgatcttaagtgcatgtttcctgcattatagtggatcacaaatcaatttatatgtatttaaaactaactgcccaaagcgtgttttaacactgccaagactgcatttatcttgttccgaatctgaaatctcaaatcaatatattttgtgtttcccttgtaacaccagggtggagttttggccggagatgtgaaagatgtcgttcttcttgatgttactccattgtctcttggtctggagacgttgggtggagtgatgaccaagattattcccagaaacacaacactgcccacctcaaaatcagaggtattctccacagctgcagatggacagacaagtgttgagataaatgttcttcagggagagagagagtttgtccgggacaacaagtctcttggaagcttccgcttggatggaatccctcctgcaccacgtggtgttccacaaattgaagtcaagtttgatattgatgccaatggtattctctctgttgctgctattgataagggtactgggaagaaacaggatatcaccatcaccggcgctagtacactgccaaaggatgaggtatgttcccaccttatttgcttaagcattgtgtgattacattcatcaaaagttggttgccagcttgctatattgcaactaggtacaaagttggcaagtttcttcttaacgtatgatagttttctgcatggttatctagttgtagattttcttttccaccatatgttgtgcagcttctttctttgattcccaatcccgttatttgctactggtgtgaaatt

SEQ ID NO: 89242 - DNA, 818 bp, Oryza sativa
  unsure (1)..(818): unsure at all n locations
cgctgtccnnattgttgacactctgnnnnnnnnnnnnnnnnnnnnnnnnnnnnnnnnnnnnnnntggaacaaataatttatatacttgttttaataatctctactcgctccatccgcaaatataagagattttaagtggatgtgacactcatagtacaatgaatctggacatattttatgtccatattcattgtacaggaatagaaaatctgtctagattcattgtattatgatatgtaacatacatctaaaatcctttataatatgaaacggacgagttaataacctgaaaaaaattaagcctaaagctagctttgtcgcattggttcaataatcgtatctccacggtcactctctccgatgttttgggcagttcagaacatataatcaaattagttgagatggttttgtgtttgtgcttattaaagggcaaaaagtgaataaacttgttttgcagggataaacgagaaatttctccaggtcctgatatagatgtaacctcgcccgacatggcctggcccaggcacgggctaggcacagcccgaggcgattgggccagcacagcacggccggcacttcaggccgtgccgtgacagcccacgggctgcacctcaggcccaagcacggcccaccagtagttgggccgtgctgtgccgacccgaaggaacgggcggcccatcgtgccttatttaaaataaatttatttccccttcctcatctatgggctgtgacacatatatatagnnnnnnnnnnnnnnnnnnnnnnnnnnnnnnnnnnnnnnnnnnnnnnnnnnnnnnnnnnnnagtgtcatcatacc

SEQ ID NO: 89243 - DNA, 1095 bp, Oryza sativa
  unsure (1)..(1095): unsure at all n locations
ccgctcccatttgatgacttgcctgcctcnnnnnnnnnnnnnnnnnnnnnnnnnnnnnnnnnnctagaagatatgcttcgcgcatgtgtcctagattttgggaagacatgggataagagtctcccctatgccgagttctcctacaataactgctaccaagccagcatacagatggcaccgtacgaagcgttgtatggccgcaaatgccggacaccactattgtgggaccaagttagggaaagccaagtgttcgggaccgatatcttgagagaagctgaagcgaaggtcagaatcattcgggagaatctaaaggtggcctagtctcggtagaagagttatgcagacaaccgacgccgtgacctggaattcgcagtggatgattttgtgtaccttcgggtcacgccattgcgaggtgtacacaggtttcagacgaaagggaagctcgcacctcggtttgtgggtcctttccgtatcattgctcgacgcggggaagtcgcttaccagttggagctgcccgcctccttgggcaacgtgcatgatgtgttccatgtgtcgcaactcaagaaatgccttcgagtgccgtccgagcaggccgacttagagcaaattgaagctcgcgaagacttgacctacgtggagaggccagtgaaaattctggacaccatggagcgcaggaccaggaactgggtaatccgtttttgcaaggtccaatggagcaaccacgccgaggaagaagctacttgggagcgtgaagacgagctgaaggcagtccatcccgatctcttcgccagttcttcggaatctcggggtcgagattccgtttaaggggggtaggtttgtcgcgtcccaaaacgactctaaaatatatccattaaatgatgcctagaataatagaaatccgtgtgaaagcctccaacaattaaaatgtgcaaagttaaaagtcaaacaaggcttagaggatttttatatatttcctaaaagcctaaaatgcgtaaataaattttagtggaattttcagagcacaaataatannnnnnnnnnnnnnnnnnnnnnnnnnnnnnnnnnnnnnnnnaagcaggtgtcatcatgggggtg

SEQ ID NO: 89244 - DNA, 740 bp, Oryza sativa
  unsure (1)..(740): unsure at all n locations
gcgtcccntttgattgttatgcnnnnnnnnnnnnnnnnnnnnnnnnnnnnnnnnnnnnnnnnnnnnncacgtagcggacaccatgtgagctgcatattcccttcaagaacttatcaatcaaggtattctcgtagttttatgttttttgacttgtacatattccgcaagttgctgcttaggtttcactaatagataacctctcatcatgtgaaggtggcgttgggaatgaccatcccaacggacccttcagggacttaccattgcaggccgattccagcaggatactcgagggtcaaagttgagctggtggaagccgcgtacgaggtcctcgagttggactaccctggaggagacggtgagacgcatctacgagacacaagccacgccattatactatggcgcaagcggtacatcttcctccctgggcgacaatcggtgtctcgtgcaccatctcttccggctccgccatctcctctgcaccacctcctgcaccatctcctccagttcctccaccacctcctcctgcaccatctcctccggctcctccgccttctccacctccaccgtgtctgcctgcacctcccaagacaaggtctcgccaagctccaccgcttgcccgcacaagggcaacgaagaaggcgaaagttgacgccaccaaaaacaaggagccgccgtacgattgcagtcaagaggagcttgacgcttaagtggcaggagaagtgaagagctactcaagcctg

SEQ ID NO: 89245 - DNA, 1280 bp, Oryza sativa
  unsure (1)..(1280): unsure at all n locations
tgtcaagttcttcttcaactcgaactggaacacgacagacaacctcaattataagatacaaacgggcttggtctaccatgtcaatattggtgggcatcatcatcaccggcttatcttcgccgctgccgactggtgtctccgcctacacggctggcctattatgccaccattgttgggcgtctacgacttcaccgttgtctcgctttcgctgccgccgactggtgtctccgcctacacggctggcctattatgccactgttgttgggcgtctacgacttcacctccggcctgcctctgtcgccgccgactggtgtcctcgcctatacagttagtgggtcacaccaccgttcatgggcgtccacgtcttcaccaaccggctagacatcgccgccgccgactggtgtttccgcctgcacggccggccaattatgccgccattgtcgggtgtctacaccttcaccgccggccgccatcatcaccgtcgattggtttcttcgtcttcacggccagtgtactccaccgccgttgcttatggcaaccatgtcttcactactggctgcagtcatcgccgccgaccggtgtttttattgccattgatggacgattttgttcccacatcagccacctctgccatcaccaagggaaagattacaaagctaagtcatcattaattttctttatatgatattttccttttcctctgcctcactacatcaactggttcgccgttgactagtgagtcgggggctacagatgttatatcatattttttaataattttcataatattcatcttgattgcttgcgacatgatctgagtacaaaagcgcctatcgagttatggagttccatcttcctatgctttccgtttggtttgccaatggatagttgcctttgggccgattcctagcacccgggggctcgttggatggactgaataacgcaaggtgctaagtattaatcagaagaaatcaaaagcatagagataatataatttttttctgctcttaacaattgcaaaagtacccgagtagtaaactctgatccgtgaaactttgttccattaatgacgaactcatatcactcatatgcatgtttgggaagtgcttaggccgactcccggtgcttggtggctatgactagtcgggcagagtgtttaaacgtaatgagtcatctgctcggagaaatcaaaattgacaagagaagannnnnnnnnnnnnnnnnnnnnnnnnnnnnnnnnnnnnnnnnnnnnnnnnnatcaacntntcaaannntcgcac

SEQ ID NO: 89246 - DNA, 1239 bp, Oryza sativa
ctgtctgcagatgataagcagtactaaagttcagcttagaacccatctctacttgaagtttcttccaaaactttaagtaaactgactgcctcgatcagacactattttcttagggacgccatgcaaacacacaatccttgccatatacaattccgccaaccgtcttccggaatatgttgtctttactggaatgaaatgagccactttggtaagtctgtcgactattacccaaatagggtcatggcctgatgacgttctgggtagaccagtgatgaaatccataccgatttcctcccacttccattcaggaatcttcaaaggctgcagcaaacctgcgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctctcagaattgcatcttttaaatctttgttgtcggggacgcagattctctcgcccaaccatacagttccttgctcatcttccaagaaaccgatagcttttcctcttctcatattcttcttgatttcttgaatatcaggatcattaatttgggcttctctaacctgatcgattagagtgggctttgcttctaaggctgcaacgaaacctctactgacaattcccaaatttaatctttcaaattccttgcataactccaatggcagtcgtccttccgtagcattgcaatagcctttcctgctaagagcatctgctacaacattagcctttcccgggtgataatgaattcccatatcataatccttaattaattccaaccatctccgttgtctcatgttcagatctggctgagtaaagatatactttaaactcttgtgatcggtgtacacctctgtacgagtaccgaaaagatagtgacgccaaattttcaacgcatgaaccactgcagttaactcaagatcatgagtagggtagttcttctcatgcggacgtaactgacgagatgcataggcaaccaccttcccatcttgcatcagaacacaacctaacccaattttggatgcatcgcaatacacttggaaactcttctttggatcaggtaaaatcaaaataggagctaatattaagcgattcttcaactcttgaaaactctgctcatattcttctgaccacttgtactttacgtc

SEQ ID NO: 89247 - DNA, 724 bp, Oryza sativa
  unsure (1)..(724): unsure at all n locations
agggaagtnagttttgangccnnattgannnncactgatatcnnnnnnnnnnnnnnnnnnnnnnnnnnnnnnnnnnnnnnnnnnnnnnnagattgaatgtatggccaacaaacaaaaagtctcactgacatagaaatcgaagttgagagctaaaaaaaataaagaagcagaagaaatcacctgcgcggaaatctcctcggcggcgaactgcttgccgatggcggggcagtcgagcttgacgttgccgttgtcgtcgcggacgacgtggtaggagacctgcttggcctcgtcgtcgacctcggccatcttgcggccgatgaagcgcttgacggagaagaaggtgttctccgggttgacgacggcctgccgcttggcgatctgcccgaccagccgctccccgcccttggtgtacgccaccacggagggcgtcgtccgctggccctcggcgttggtgatgaccgtcggcttcccgccctccatcgccgccaccgcggagttggtcgtcccgaggtcgatccccaccaccttctcgcacgccacccgcatngncaccccccgcgcccggcccgcccgcggnacccgcatctgcaccgacgccgccgcgggcttccgccccacgaacagctgcccgctcctccgggccgcgaggggcgaggtggagggggcggcgccccacgccatggcgccgagctgggaggtgaaggaggccatggcgaggccagga

SEQ ID NO: 89248 - DNA, 2428 bp, Oryza sativa
tcgggaaggaacgtgtaacgccggttggggggtgggttttcgtgaccgtctgactatgactggattgtgtgagtctatttgttgccttgtttttaattttgcacgaaatttgggggtgacaaaggtgctttttgaatggatttcgtgtgaatttggtggaatgggggtgatcggtttggtttgtgggaggttaattggttcgtgcaagtcaaataaaaaaaagaataaataaaaggaatatccctacactttacaggttatatatgatgatctgatatgtcttctattggaagaagtcgatgccgcgttcaagcgtctaggtgcttcttaattctcatttgttcaatttatatgtgacgtgtgagttcaatataaattcctggcaccaagatagctctagaggtgggtctaggaaataaaaacagtgtacatcacctggtagcagttttatatttaatactagcaacttgcagtagttaccatgcttaccaaaaataaagatttttgttttctcacttgtagtaattgtagcaaaagtggaggaatgcaagtagataatttcactacccacatgaaaatcccctttaattcatttctcacatggtggtgttgttgatgggctataccgcagacgagatttttacactatatataaggatcgttggaaccaggtatacgcaagatcgggtcaagtagacaaggatgaagatttatactggttcgagctctcaagtagagtaataaccctactatagtttatatggatttatagatggatttatagatgggatgacacaaagattacaatggagaatgggataattagactaatccgccgaccaaaagttgtcgagaatgatacaacgagatctattcagcaaatatggctctggcttcctctagaattcttctcaatgtgtctttggctatttataacttgatgcccctttctaaacacgggagccttgtatatatagcgtagatcatctttctctccaagtagaactcaaagtgataaaatagtgataaaataggatacgagcccaaggagatcttaccttctccgattaaaactcgaacaccttctattctgagaagataatttcattccttatccatcgtatttccttaatcaattggcactttctggtatacaatcgggtatacggtattgtcatatttcataaatccgtgtataagaggtatgtcttatcctcaacgctaacaagtataaattttaaaaggaaaaaaatgaaggaaaattttacacataaattttataaatacaatatttaatttatatatacaaactttgcttcaaaaatcatattaatcttttttcttcaaatttataatagctaatatttaattaatcacatcctaattcattgtcaagttttacgtatggaccaaaagctcacgtgaacttagataccgaaaagaaaaattgatacaaaaagaaaaaagaaacaacatacaccccaaaatatagtggaccaaaaataacaattctatcaaaattcacacacacaaacttgaccaaaaaaaagatgtactagcgtgatcgcgggcacggctaatcgctgattagtgttttctttacatggatgcccggattcccccaaacctctctattgagtagaccaaggatatcatgacctgacaaatgaccgtaggtatgttatagcgatggaacgagggaggccaactgttgacgcgaaaaatcaacacgcagcggcctgggaaatctgcttagctctagtgcagttccaaaagaattgccttcgggttctaattgccttcgggttctgagcgtgcctgatggtttgatcctgcaaccaacaagatagaaaacaacaaatagttaaacccatcgacgatagccaatcggcaagattgccgatgacatatcgtccgaggccatgccaatgtaacttgagttagatcggcaagggcagataaaaacttggagattgttcggtgtacccgatcggctgtagatgttagcgatacataatccgtccgataggacatgcttggatcgagtgattaggatagatcggtggccacaccgagacagtataaatcactctgtatccaaatgtgcccaaaagtagggattatgcatgctaacagcatagccgatagagcaaacctaacatgtatcggctagtactccgataccaccctataccaagataccaacgtggatgaaatatatgaagctaaggccaaactagaaagcatgatggactagcttaatatacttcaaaaggatgggatcttgatataaggggcggatttagacaatctagagccaaatgaggaagtaaaacaactaaatcaggtaagatcggctgaaactccgatactatctctattagcagtcaaagaaaagattagataaaacatttcaggacagtgctta

SEQ ID NO: 89249 - DNA, 6867 bp, Oryza sativa
  unsure (1)..(6867): unsure at all n locations
tttttttttgagaattacacagtacaacgcagacactcacaacgcacacgcactcatccctatgaacacacgtatgcaaaccctacccttatgagcatctttgaagactgggccggcaaattctggagagattgacgaagtcaccacaggcgccttggtgtcgacgggtacgtcgcctaccactgaaagcacaacgcccgtaaatcctgaaaaattcgctcccatgggaaatcgaactcaggacctcaggtgctactgaggctcttgttaccactaggctacaggccctttcacctatcaatcacttcttgagaactagataatataaataacactcacactaatataggtatgtatcctatgcacactattagcttaattaataaatactaacaatttttttaaaaaatatatatttactttcaataatattacagcaacgtagtctcattttcgaaataactcatacatgcctctactcgttgcactgaaaattactgtttttatggaaatttacgtgactatacttgataacgagtacgaaactgctaaatgactgtcgacagttttcttgagtgaaaactgtcaaatttttaggccgtcgattccgttttaagatttgtactgagatattttgctaccggatctaaaccctcttttcacaagctagccacatcatcacatgtttatggtaaatttgttcatgttatatctaaattgcattccagttatatgctagttatattatagttacactataattacattgtaattatattgtaactgtagtgtaactacactataactacattgttatctctatataaattaaatataaagttacatatattattttaataaatatatgtaccagttattattattatagtatagttctagtgaaattatatactatagttagatttgaaagtttttctctcaaaaaacactcgacagttttttagctagtccaacgagtaagtgaaaaatcaggcgacgagtgaaaacacaaaattattatatttttctgtgtgtatgtgcaagaagagcagatcgttagccctagagggcgctgggccctagctaggcccaccatattcgttggagatgttgcctgttcctgctggtgtgaccaacgattaatttaatttctgtcggttctatatatagttatcgacaaacatatctagggacctgaatgggttggtgtgttgagacctagctatgaccccgactcacggccaacctgagttgatcctgagagctagctgtgacggcgactcgaggccaactatatgagtggtaatgtactaatgtttggactggctggctctagtatgtaaagggacatacgagccggcggcctgtcattctcgtagcaagttttttattttttgaaaattacacagtataacacaatatagacactcagaacacacgtatactcatctttatgaacgtacgcacgcaaatcctatcctatgagtattttcgaagactaggccaataaatccctagagattcgtagcaagattctaatcaaagcatcagcatcagcattgtcctgtagccataatagtatgatacccccacccaaaaaaaatgttttagcttttaaaatttatccaaaaaacttgttccttactttagagtttttttttatcatatcaattagttgccttcaatttaaaattatctttatcgtacactcattggcaatcccactatctactacagatcatttaataaatgacactatagttttttttaaaccttaacttttgttaaataatttaggtcgaaaactattttaattttaagatggtgattaaattttggatactcgcagcacgcttttaaaactgctaaacggtgtgtctcgtgcgaaaactttatatatgaaagttgctctaaaatattagactaatccatttttcaagtttataataattaaaactcaattaatcacacgttattaatacctcgttttacgtgaaacacttaatctttatctttatctttattttcaggagattcaatcaccagttgaggagtattggattgagtcattgagagtacgtacctgactcccatcgttttgtccaataacttcaatcccatgcggcttaatgtcgtcaatacttggtgagcgggagccgatcgatccgtgcatgcctctactccttgcaaacggagtttgcaatatatagtacgattgaactctttgattgatcattttctcttataaagtgatgtgtgttttgacagttacggatgtgcgatgccttcaaactgggcgttaggtggtgttttgacagtctctgattgatcagtccatatttaatatttttaattagtgtccaaatatccgatgggagataggaatcaaaatttagtcactggatccaaatagaccctaaacgtggggttgacatgtggctgagagtgggagtatagataggggccagaatagcgataaatttaaataaaggtcaaatagtcctatagaattacacttattttgagataattgtagttattttgggatgaatttaggctgtgttcagtttcacgttaaaattggaagtttgaagaaattggaacgatgtgacggaaaagttggaagtttgtatgtagaaaagttcgatgtgacgaaaacgttaaaagtttaaagaaaaaagttgaaatctaaacaaggccttagtagatattaagaatggtactattggctcccctaacatataaaaatattactacaccaatgattccatcgtcccaggtgatacaactagatatgtatacatttgttcacactttctccacttcaataaataaataaataaataaataaataaataaataaataaataaatatatatatatatatatatatattttttttctacgttctttagcatatattgaggttgaaaagaagagatttgatacactcatttaaaaaaaattaaaaatgattgtcatccgactctgtatcggttcgcagtgcacacatggtagttgtccgactcagtccgcgagaagacgatgggctcgtgattgattcagaacgttgtaggtgtaatgcgagattggcagctccctattttgtgatgtctcgatgaatacaaagccatcttctcatcctacataacacagttctcagcctattttgggctggcctcctacgttcagatttgtttgagtttgattcaagaattttccacacatccaaatgcaaaacgcatcgaattttaaacacgcggatctcatgtatatgcaccactggtggagaaaccgtttgtagtcccggttcgtaaccccctttagtcccggttgtccaaccgggactacgaatccgggactaaagatagcggtctttagtcccgggtgaaataactgggactaaagatcagtcagccacgtggccggctgatccatctttagtcctggttggtaccattttttttatttgcatggccctgtttgctgcatggttgattatatacatatatacatatatatatatatatatacatatatatatatatatatatgtgtatgtattctatatatatgcataatatatatattacaatgcatatatatatatatatatatattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttagagatttaatataagattgttacacttagcatatatggctaggatgagttggaaactatgtcatgtcttccgtccgtatgccgtggtggtatgtggcacgtggttacacgtgaggaagacatgtcttgtgggtaaagatgtacacctctgatcagagtataatctattcgaatagccgcgccctcggttatgggcaagccaagcaatgtacccaagttagtgttttaattcttaaaacctgcttaacaactaaaatgtggaatggatggcctgggttggcttgggacgagctgggacccagggtcgggttgccagtttggtctgaatcatcgtaggccttgggttaaggcaggctcgtgtgggttcacggccttgattaataatattatatagctctagaatcgtgtttacaaaatagctttgagcaactaagtgtctttaatgctgtttactgcaaaccctaaccctttatattataacccccttgtactcccttgcatttattctgcacttgtgggtgtgtcttgttgagtatggtggttgtactcagtcttgctcaatttttcccaaactcagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgccggttgggttaatttcggtcgtgacaagttggtatcagagcccccttaaccctaggacgagccgtagatcccaagccttagcaatattttcaaaataaaaatcctttcttatttgtgaaaaccctctagtccctctctgtcctgctgcttcatttatcgtcaaaattcgacctttaaaatgttgcttttctcttttgttttagtttgtagatggccggcagcatcaaccgtcgtggtctggacctgactggcttcgttttggagctgcggggcatgtgcgttgtcctggggtatccgcatggagtggactaccagggcaagcagctcccggagtaggagggtgacgatgcagagccccacgctgcttgggaggtcactgcagtgatcctcactggctcacccgagaggacttcattggcagtcaccgcgggtggagattctttctccgccgcttgccagaacgccgctctcctcgccatctgcactcttcaccagcgctacccggacgagttgcagcactcgccctaccgctaccaccctcgccgcggaggagcccgtgactacgccaccttccgggatgctagctcggagtatgacgctaccatcatgcacctggcgcgcatggtggaggcgtacgacgcggctcgtatcgacttccatcagatggtgcgtcgcgggttggtcgagaacaacatgaagatcttggagctgcgtcaggagaatctgcagctgaagaaggacctggacacagtggaggcgcagctgtgtcagctcaagatcgcccagggagaggtctgtcgccgcaagcgccgccgcgtctgccgcagcctgaagatcaccgcccgcaagagtacctctaggcccgagcttgttcgtcagtccctggcgtggacctgcttcgtcgagaccccttgtgccgagcccgcgcccgtggttcctcaggaggagggagcctccggtgttggcagcacggaggatgcgctgctgttcaccttccgccctggcccgtcgcagcagtagacgagcagttagtaggcttgcgcgtgtgttcttctcgtttgtttttctactagagtcgtgtggggcatggttatgccggtgtgtggtataactgtgtcggagcctgtctttattttatttgcttaagcaacttgaaccttaatgaaccaatttaatagcagtaataaattcaagaattatggtagtcgtgggtggttagttttaatagtcagctctctctatttgccggtcctgtgtgggattttcagatggtgacaaccaggagaagtgctgctaccggtgaaggcagtcaccccgaaggcagcaatcacaacaaccatggcaggccacctccacctcctcccctgcctccaccaccaccaccagacaccaactccatcctcacccaaatcctcgcccagcaggccaacatgatggccgctttccttcatcacatccaaaatccgccacaacataatgctccacctccaccaccacccccacaacactctaaactcgccgagttcctccgcatccgtccgcctaccttctctagctccaataaccccgtggatgcgttggattggttgcatgccgtggggaaaaagttagacaccgtgcggtgcaacaatgaggagaaagtcatcttcgccgcccaccaactgcaggggcccgcgtctctatggtgggaccattttcaggctacgcagccagaaggacagcctattacttgggcccgcttcaccgccgctttccggaggacccatgtgcctgccggagtcatggcccttaagagaagggaattccgagagttgaagcaaggcaaccgctctgtgatggagtatttgcatgagtttaataacctggcccgatacgccccggaggatgttcgtgaagatgaggaaaagcaggagaagttcttggcaggaatggaccctgagctgtccgtgcgtctggtctccggggactatccggatttccaacgtctggtggacaagagcatccgcttggaagccaagcacaaggaactagagtcgcacaagcgtcgcttggcgaatttccgcaatcaacagggggctaaccaaagggtccgctacaccaatccctatccagnnnnnnnnnnnnnnnnnnnnnnnnnnnnnnnnnnnnnnnnnnnnnnnnnnnnnnnnnaagaggttntacaagnnntcaaanggnnntcaatgcccg

SEQ ID NO: 89250 - DNA, 1167 bp, Oryza sativa
  unsure (1)..(1167): unsure at all n locations
tcgggggtcgggtaaaccacgtaactgcgaaggatgtgctgacgactcaagacgtcatcgttggtacgttcctcattcattctatccctgctaccattttgttcgactctggagcttcccactcctttatatctgtgccattcgtggggagatatcagttgggggtagaaaggcttaggaaccctctgctcatcaccacccctggaggggttatgacagcaaagtattatagccctgccgttcttatagaaatctagggaattccttttctctcggatctgattcttctggacaccaagaacttggatgtgatccttgggatgaattggttggctcaattccaaggagtagtggattgcgcaaggcgcactatcactctgtattgggggccggaacaaccggttgttttctttgcacccccaacctctgtcggcagttcagaacttcatcagataggactgtcagaaatctccatcgtcagagagttcggagatgtgtttccggaagaactacccggtatgccgcccaagcgagagattgagttccggatagatcttgctccaggaaccacttctctgtacaagcgaccctactgtatggcagcaaatgaactggccgaagtcaagaaacagttagaagagttaaaagaaaaggggtacatacggccgagcacttccccctggggtactcctgtgatttttgtggagaagaaagacaagacaaagaggatgtacgttgactatagagccctcaatgaagttaccctcaaaaacaagtaccctcttccccggatcgatgatctgttcgatcagcttaaaggtgccactgtatcctccaagattgatcttcgttccggatatcaccaattacgtattcgtgaagaagatatccctaagaccgcattcaccacgtgatacggactgtatgaattcacggtgatgtcgttcggtttaaccaatgctcctgccttcttcatgaacttaatgaacaaagtgttcatggaatacttggataagtttgttgtggttttcattgatgacattctgatgtactcacaatcaggggaagaccatcagcannnnnnnnnnnnnnnnnnnnnnnnnnnnnnnnnnnnnnnnnnnnnnnnnnnnnngctataggttctcaaaagggtatcaaaaggcctct

SEQ ID NO: 89251 - DNA, 727 bp, Oryza sativa
aaaccaagaggtcgagccgttggtgaccagcgaagaatttggcataacggaattcatttcggaccccggtctaactgtggatcagttgattggaggcgcaccaatcccgatggcggaagtggcatacaagtttgaactccgtaaaccgcttgtcacgcctgagcagctgcagtccctaccgacatagatgtacaaattccatgaatggttcatggaaatgagcgccaagggtaaagagatgttcagagcgaggatcagaaaccccgacttcttgcaaggagaagaagttctgtgcatccatttcaagaatgtcttcgaactatatcatctagacgccctcgacgtctctcttctgagcgcatggattttgtaagtatctttgagttcgatttgtttcgttcaataattagttccttgcatagatgtaaacaataataaattcctttcatcattgtagaatggagattcaaagggcccgacggtaggggctttacgatactgggttcatcgaccctcagaaaatcaacaccgaaatgatcgacaagtacgagaaagacatagaggacaatctcgtccatctcctgacgcagcagcatttcaagacgttcatactactgtcgaacaacacatagtgagtttttattgtcgttcgaacaaatttcattcccatacatataacatgtacattttcatatatatctcatctcacgcatattccagattccac

SEQ ID NO: 89252 - DNA, 897 bp, Oryza sativa
  unsure (1)..(897): unsure at all n locations
aatcaagccattccatagtgtccaggtgatgagaatatccaaaagtctagagttgtaaaaccacctaatgttgcctaattaaccagcgaagcatctacctaaaatcatactagtggtaccatgagtagagtgtccactagttggggttttgtttattctagggtgaacaaggaaataataccaataccaataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacagcaagaacaatgcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgaggggaggggcgcgcggcccgggtccacgggagtggggcccacgcgccagcctcacggtccacagtggaccgggcgcaccggggctcgcaccggccggtgccgtgggccccacgcgtcagccgcacccgagggcgcgggcggctgacggccgggccccacgcggcagccactcggcgcgcccgaggannnnnnnnnnnnnnnnnnnnnnnnnnnnnnnnnnnnnnnnnnnnnnnnnnnnnnagctaagtagtctcatccg

SEQ ID NO: 89253 - DNA, 1282 bp, Oryza sativa
  unsure (1)..(1282): unsure at all n locations
ccgcgcccatttataaatttgannnnnnnnnnnnnnnnnnnnnnnnnnnnnnnnnnnnnnnnnnnnnnnnnnnctaaagacgtgccgtagggggagccatctcctatgacccatgtaaaccatttttcttgatttcttcagccacctactgcgtgtatgttccatacagtcagagcatgccttctttcctttcacggtttgtccagaaagattacccagcgcgggataatcattaatggtgcagaataatagaactcgtagtgtgaaattctcctgaccatatgcatcccaagtttccacactctctttccacagaatctcaaggtcatcgataacaggctccaagaacacatcgatgtcattgccgggttgtctcggaccttggattaacaagcacaacataatatattttcttttaaagcataaccatggcgggaggttatagttcgcaatgagaactggccaagtgctgtgagtactactcatgtctccgaaaggattcatgccatccgtacaaaaacatatcctcatgtttctggggtcggcagcaaagtctttgtgttttcgatcgatattcctccattcaatcgaatccgctgggtgtctaagcataccatcattccttctctccgtggcgtgccaacgtactaactttgcttcattggggttggcaaatattctcttgaaacgatcaatgattggtagataccacacaaccttcgccggaccaccccgctttaacttctttccctcgcctgcgctcttctttcgcttgtatcgagaagccttgcagacaggacaagcatctaagtccgcgtattgcttgtggtacaatatgcaatatgtcgtctcgggcaatgtgttctcctaagtaaggaagcatgtccttcagtattcccaaaagttctgtaaaactcgtctgaccatccactactagccttcaacttcattaggtctaatgttgctgataatttggtgtgctttggcttgcatcctgcgtatagaggagtctccgagtcactgaccaacctgctgaacttcatggaatctctctcattcatagctgggtcatcaacgtcacgtaacatgtcttgcagcatatcacgggccacaataaccatttcaccgcccaatggagatgggacaacattgtatggctctttttatatccctttttaagactggttggacacattccgcttgagttgcaccattagtccccagaacttgtgtttcatgcattaaccaacatggggatttcttcatgaatccccgcggttta

SEQ ID NO: 89254 - DNA, 697 bp, Oryza sativa
  unsure (1)..(697): unsure at all n locations
ccggggtgaagggcaacgcggcgccgtcgagggaggatgncgatgacaccagccgctgccccggcaagccggcacaggcggctggaggcggtacagtggcggcaacgccactgttttgccggcgaggacgcgtctccggtggtttccccacgaaacggagggctgaccgggggagaggaggcggctgcgacgtcaacggaggagatggcgacgtcggtcggcgtaccggcgatgaacagcagccggccgaagacggaacagtggcggtaacgccactgttgccggcggggatgcacttccagaggtctccacgggcaacagagggcaggccggcgcagaggaggcggctgcgacgctggaggaggtgccggcacggccgaccggcgctcgggcaaggcggtaggggcggctggagggtggccggcatggaggaaagagaaggaggaggcagggagaggtggtgcagccacggggaggacacgggagggggctaaaacgagagaacggagcgagggggttccgttttatagcggagggaagcgagccgagcacgggaggagcagggaacggcggcggaaaaggcgcccggcggccatggaaggcggccatgaatggcgcagccgttccggtcaaaatagtggnnnnnnnnnnnnnnnnnnnnnnnnnnnnnnngtcagacgggagcgcaatcacgcat

SEQ ID NO: 89255 - DNA, 869 bp, Oryza sativa
  unsure (1)..(869): unsure at all n locations
ttgtgtannaaggactgacgtgctnnnnnnnnnnnnnnnnnnnnnnnnnnnnnnnnnnnnnnnnnnnnnaaatttaaagactttggaaaggacgcacgaaacatatggtttggtttaagtacagatggcatgaatccttttggagagatgagcagcggccatagcacttggcccgttacgatatgtatctacaacctcccccgttggctatgcatgaagaggaagtacataatgatgccgattataattcaaggccccaagcaacctggtaacgacattgatgtgtaccaaagaccactggtcgaagatcttaacctgttgtggaagaaggaaggtgtccccgtgtgggatgaggacaaacagaaggagtttaacctacgaactctgctgttcgtaaccatcaacgattggcctgcacttagcaacgtatccgggcagtccaacaaggggtacaaggcttgcactcactgtatggatgaaacagaaagtatgtatcttaagcactctaggaaggttgtgtacatgggtcatcgtcgattccttgcagcaaaccacccggtacggatgaaaggcaagcactttgaatataaggcggaccaccgtacgaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacatccggcacgcaatnnnnnnnnnnnnnnnnnnnnnnnnnnnnnnnnnnnnnnnnnnnnnngatatcaaaangtttatcaggttcaaattggactc

SEQ ID NO: 89256 - DNA, 1306 bp, Oryza sativa
  unsure (1)..(1306): unsure at all n locations
caatatggtcaaagacataagcaatgagtttgggaagaaaagaaaacgtagcaagacaaaagagaagggtaggtggaagaaaaaatccatattttggcggctaccttactggaaagatcttgatgtccgtcattgcattgatctcatgcatgtagaaaagaatgtgtgtgagagtttggttggcctgatgttgaatattcccgggaagacaaaggacgggttgaacgtgtgccttgatctacaggacatgaatattcgcagcgaactccagcccatacgagatgcagagacaggtaaagtgtacctccctccagcctgccacacactgtcgaaggatgagaagatcgcaatgttatcatgcttgaaggatattaaagttccatcaggctattcagcgaggataagtaagtatgttaaattggacgatctaaaacttgttggaatgaagtctcacgattgccacgtgctaatcacacaaatcttgccatttgctatcagaggcattctaccaccgaaagtgcgtcacacgatccaacgtctgtgcgccttcttcaatgcaattggatagaaggttatagatccagaagatctagatgggctgcagatcgatattgtaaataccctctgtcacctggagatgtttttcccactgtctttctttgatataatggttcatctccttgttcatctggtgaagcaaacaaaactatgtggcccggcttttctaaggaaaatgtggccgtttgaaaggtacatgggagttctaaagtcgtacgttcgtaacagagctaaacccgaggggagcatcattgaaggttacacgaccgaggaagctattgagttctgtgtcaattacatgtccgatgccgatcctatcggagttccagcgtctcgtcacgagggaaggttgtcaggtgttggcacaatcggaaggaaaagaattaggcccgatcaagcgtcgtacgcgtaggctcattacgctgtgctccaacatatggcagaagttggcccatactttgaggagcacttagcgaaaatccgagatgagaacttggggcgatctgatgcatggattaacagagaacataattctcggttcaacgaatggttcaagaatcgtgtgacaatgtccacggatgtcccaaatgagacagtacagttgttggggatgggaccatcttggaccatagacacatggcaaggatacgatataaatggatacacattttannnnnnnnnnnnnnnnnnnnnnnnnnnnnnnnnnnnnnnnnnnnnnnnnnnnnnnnnaangtgtcttcatcacgcg

SEQ ID NO: 89257 - DNA, 629 bp, Oryza sativa
  unsure (1)..(629): unsure at all n locations
aatggataaacgtcgacatctnnnnnnnnnnnnnnnnnnnnnnnnnnnnnnnnnnnnnnnnnnnnnccatctaggtcttctggatctataatcttctgaccgattgcattgaagaaggcacaaagccgttggatcgtgtgacggacttgtggtggtagaatgcctcttatagcaactggcaagatctgtgtgattagcacgtggtaatcgtgagacttcattccaaccagcttaagatcctccaatttaatgtacttacttattctcgtgcaatagcccgaaggaactttaatatctgccagacatgatagcattgcgatcttctcatccttcgacaatgtgtggcaagctggtgggaggtacactcttcccgtcttctcatctggaacaggctgaagttcactgcgaatgttcatctcctgtagatcgagacgcacattcaacccatcctttgtcttgccaggcatattcaacaatagccccagcaagctatcgcacacattcttctctacgtgcatcagatcaatgcaatgacggacctcaagatcttcccaataagggtagccccggcccaaaaaaaaaataattgtgggaatttttttttttttttccccctttttttttacccc

SEQ ID NO: 89258 - DNA, 873 bp, Oryza sativa
tatctttgaggatcccatgcatatctggatcattcttctgagcctcggggatttgatcgagcaaggtaggcttggcttccagcgtagccaagaatccacgaccaactatgcttaggttcagggcttccatctgttgattaagttcgggtggaatgccacggacgtcaagagtgttgcaatggctttttcgacttagagcgtcggcgaccacgttggccttaccaggatgatagtgaattcccacatcataatccttgatgagttctaaccatctcctctgccgaagattcagatccgacagagtgaagatgtatttcaaactcttatgatcggtatatatttcgcagcgattcccaatgagataatgccgccagatttttagagcatgaaccacagcggccaactccaaatcatgggtagggtagttgccttcatgaggccgaagctgccgggaggcataggctaccacatgaccttcctgcatgagcacgcaccccaatccttggcgcgaagcgtcacaatacaccatgaagtccttgcgagtatccggtaagattaacactggcgaggaaaccagcttttctttgagagtttggaacgctttctcgcattgcgggctccacacaaatttctcttctttcttcaacaactgtgtcatgggtcgagcgattttggagaagttcacgatgaacctccggtagtatcctgccaaacccaagaagctgcgaatttgagtgactgtctttggttgcttccaatcagtgacggcggtcactgtttcggggtccacagcgactcctttagcagatatcacgtgtcataagaatttgactcggacaaccagaactcacactgctaagcttggcatacaat

SEQ ID NO: 89259 - DNA, 1459 bp, Oryza sativa
actgatagtagcttcggatccaagctgatcgatggggaacccccaagatcatgttgattatgctgtgcaccatgctttgatcaatcagtctggaatattagtcaacacggggtcaaacatagtgaaaacaatggttgatggttcaatggctgagtatcaggctaaaggaccggtttatctaccaggagaggtgttcccaaattatcggccattaatcactgataatcagccagctgtccattcaattcctcttaatgcaccatcggctcagccgacggcgccagtatcggctcctgcacctgctgcaccaccatcggcaccgggccagttagttaatccccggttgttggtgagagaacaaccacagcatagtggatagaatgtgaatcggctaacacaagatcaggttgcggctatgttcttacctcctcaacctactgttgatccgacccagcagcagccgattcagcaaacaccaccaaggcagcagattgtgcaaccgattcaacaaacacccccaatacaacaggttgtacagccagttcagcagacgccaccaagacggcaggttttgcaaccaattcagcagacgccattaaggcaacaggtcattcagcagattcaacatcaaggcttgatgaatgcatcggctgggtttacaacacctggtagtcagcttgggcagcatgctgcaaatcaagttgtcccagagcacttggttcatcaggtacaaccagatcaaacggtgatacctcaagttgttcccgagcatttggtgcgcaatattcagccagattttcaaaattaccaggggggcaatttgaattatcagtatcagcctccatcaccgcaagttcaatatcagcaggaagcatcgtctcaaccccagtttgttcctcaatacaatcaattcgagcccatgtcacaacaacctcaaggagcacctcaacaacaaccatgggccgatatgattgcggatgtgatgaaggagaagtttgggcttaggccgaaagacgctggaaatttgtaccggtagccttaccctgaatggtttgagagagtccctctacctaatcagttcaaagttccagatttttcaaaattctcagggcaggatagtacgtcaacttatgaacatgttagccgatttttagctcagtgtggtgaagcatcggctgtggatgccttgagggttcggttgttccggttgtctttgtctggatcggctttcacttggttttttttctttgccatatggatcgattaacagttgggctgattaggagaagcattttcacagctatttctacagtggggtacatgagatgaaattgtctgatttaacagcaatcaagcaaagacatgatgagcctgtgcatgagtatattcagagattgagagatgaggaataagtgctacagcttgaagttgactgatgcccaattagccgatttggctt

SEQ ID NO: 89260 - DNA, 851 bp, Oryza sativa
  unsure (1)..(851): unsure at all n locations
tgaattngagcttnnnnnnnnnnnnnnnnnnnnnnnnnnnnnaagcaaatcgtctacttgcctcttgacttctgccaactcattggctgccattctataaggtctcttatggatcggaattgttcctagtactaaatctattctgaactctatatcccttttaggtggcataccaggtaaatcgtctgggaacacatcgggatactcccggactataggaatctcttccaaagtcatttggttcagacttgaccttaaagactcagaagacaatgcatgaacaattacaacttgaccatcattgctggtgagagttacttttctgttggcacagtctatcacacctttatatctggctaaccagtccatccctaggatgacatcaaggtctttggattctaacaggataagattggccagaaatgttacttcttgaatttctattctgacagaggggctacgttgcaaagagagtgcttgattacttggggtactaaccatcaaaggacgtctaagatcttctacttccatcccatgatttcccacaaaactcatagataaaaatgaatgtgtagcaccagaatcgaaaagcactgttgcaggaactgagttgacaaggaacgtacccaaaatcacatctggagcaccttgagcttctgcagcggcaacatgattgacacgggcctttaatgctggtgcggtagagttgctctgggcagggacaaccttcacgcgtcggggcttcggacacttgtcagagtaatgtcctgggtctccacagttgaagcacaccccgggcttgctgccttgctccctcttggcaggctggtgctgtgttggagctgcaacag

SEQ ID NO: 89261 - DNA, 2370 bp, Oryza sativa
  unsure (1)..(2370): unsure at all n locations
atgatatgtnnnnnnnnnnnnnnnnnnnnnnnnnnnnnnnnnnnnnaaatttttggcatacatccaacttcgatcaattgctacaaaaaaaaaacaaattagaggcacatattataagatcagtattgcaaaagtaagacgtgatgaaattgctcaattaatgatttatattactcatttgattgatccattttgatcacttttgggaatttaatttctgttttccttggaaaaaggacaaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaacgccgtcaaaaaagagtgtcatctgtgacgggcaataaacttatctccatcgggcctctagttggagcccgtcacagatgaccctcatctgtgacgggcttcttttagggcccgattgagatatggaaccctcatctcaatcgggcctcaactatagccccgcacagataagtgtcatccgtgatgagctttagttttatgccgatataccatggttgtgcgaccatatctcaatcgggcgaaacttcgggccggatgagaatacttccttgtgacgggctgcaaattccagtcttgttatgggccgtcacagatggaaagatctgtactagtgtataattaacatatgtaaataccacgtgcatgatttaaaacctttaaaaattctaataatcatatataactagcatatggatgatttcaatttgattaaaattctaataatcatacataattaacaaaaaaatctaataatcatatataactagcatatggatgatttcaatttgataaaaattctaataatcatacatatttaacatatgccatacaacaattgatttgtatggatattcagtacatccaatatagtttacatcgtgtacagaacaattacggcaatacatcagcggtgacggttgaccgcacgtactttctcctcactattgttccttccttgtgatcgctacgtgagtaaggggtgtcttcatttgataggaggatgctagggtcaattgtcactatgaaagggggttgcccatcaaactgatcgtaatcctcgtcagtcttgtcctctactccaacgatttttctttttcctgggagaaccacgtggcgcttcggctcgtcaggccctttgccctttttttctttgctagacatgtccttgacgtaaaaaacttgggttacatcattggcaaggacaaaaggttcgtccgagtatccaaccttgttaaggtcaaccgttgtcatcccactgtcatcaatcgttacgcctccaccagtcaacctaacccattggcaccggaacagagagaccttgagaggtccatagtcaagttcccatatgtcctcgatggcaccgtaaaatgtgccagttgtactatcgtgttccatggcatcgatacgaacagcactgttctggttcgtgctcttcatgtcttggaccctcgtgtagaatgtgtacccattgatttcatatccttggaatgtcgcgatcgagccagatggtcccctcgccaggaaggccagttgttggttaatcgtctcattacccatgagatattgtttcagccacgtggagaaagtatcaatgtgatgccttgtaatccatgcatcggacttaccgatgtttctggcgcgaactagagccaagtgctcctcgatgtagggagccaccaatgaagattgttgcagaaccgtgaaatgggctttatggaataaattgttgtctactgtcattattgctttccttccgagagtcctctttccccgtagtctcccttcatggcgtgattcaggtaccccgattgggcgaaggtcttcgataaattctacgcagaattcaatgatctcctctgttccataccccttggtgatgcttgcctctggacgagcacggttacgaacatacctcttcagaacgcccatgtacctctcgaaaggaaacatgttgtgtaggtacaaaggaccgaaaataccgatctctttgacaaggtgacaaagcagatgcgtcattatattgaaaaatgaaggtggaaatatcaactcaaagctgacaagacattgcaccacatcattgtgcagggcttctaatctatcaggatcgatgaccttctgcgaaattgagatcatgaaagcacatagctttgttattgttgcccggacattgtttgggaggggaaccgaattcctcnantctannggggcntgtggcccagcggagttgcattcaatnngggccgcatg

SEQ ID NO: 89262 - DNA, 1107 bp, Oryza sativa
  unsure (1)..(1107): unsure at all n locations
tgccccttataaatcactacgnctnnnnnnnnnnnnnnnnnnnnnnnnnnnnnnnnnctctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagccctgagcattcaggtgttgtttaacttaggtcctgtctctgtgacaaaccatgtatttattatgtccctacacatgcataggtgagtgaggatatgttaaacctgactcaaattnnnnnnnnnnnnnnnnnnnnnnnnnnnnnnnnnnnnnnnnnnnnnnnnnnnnnnnnngttagataaacaatgcgcgg

SEQ ID NO: 89263 - DNA, 1368 bp, Oryza sativa
  unsure (1)..(1368): unsure at all n locations
aaagattgacatgcagttcacaaaagagttttctcacgacatcagaaatgtgaggattgcactaagcactgatggcatgaacccgtttgataacatgagcagtcgtcatagcacatgggcggtggctgttattatctacaatatcccctcctgactctgtttgaagtgtaagtacatcatgatgccacttcagattcaagggcctaaacaacctgcaacgatattgatgtgtactttcaagccgatggtagaggatcttcatacactatgaacgaaaggcgtccgtatgagggatgcgtacaagcgagaacacttcacatgtcgggctattttgttagggacaataacagactacccagcacttggaaacacgtcgggccaaccggtgaaggacatgaaagcatgtaataggtgcatggcccaaacaggagccaagtggttgaatcactgtcggaagaccatgtacatgcgccatcggaggttcctcaggcgggatcacccgtaccgccgaaataaaaatgcttttgatgggacggtggaaacggatggacgtccaattttcagaaacggatgaactatggaagtgtactttatgtgtaatgcatttgaatatttgctattattatggattctattctatgttttctattatatgctcgatgacttgaggacaagaaactcttaaaatcatatgctcacctcatgttggaggtaaaatacaatcgcatttatatttttgcacttatgaattcttagatattgcagacttaggaatttttcaaattaatgttcacaatttagacataggaatttttggacttaaaaattttagacttacaatcttttgacttaggaattttaaactaggtatattttgagttaggatatatatgccaatgtttaggatttaaagacaggaatttttggatttacgaaatttgacttaggcctgtaggtttttatatattgtgatcaatggcttgtaggtttttatttgttgtgatgaatgtgaatgtgaatgtgaatgtgaaatgtggaatgtgaatgtgaaatgtggaatgtggaacgtggaatgtgaaagtgaaagtgaaagtgaaagtgaaatgtgattgtgaaatgtcaaatgtgaaatgtgaaatctgaaatgtgaaatgtgaaatgtgaattgtgaattgtgaatgtggaatgtggaaatgtggaatgtgcattgtgattgtgattgcgattgtgattgtgaaatgtggaatgtaaaatgtggaatgaggaatgtgaatgtcctgtatggatggggctgtagggatggggtcccgaattcccgagtcanaggagcntgtcaagnnggattgcatgcaattcaaggccgcccct

SEQ ID NO: 89264 - DNA, 689 bp, Oryza sativa
acatatctttgttatcgttgcccggacattgtctggaaggataccccttattacaactggtagcagttgtgtcatcaacacgtgacagtcatgagactttaggtttgtgaacttcttttccttcgtgcttattattcgcttgatattcgtggggtatccagacggtacctttatgctctccaagcattcaaacatactttccttctctgccatactaagagtgtagctggctggactcaagtaatggcttcctttctcctttggttccggctgaaggtcgccgcgttcttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaattgggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggttagccttatgttcgaagtgcttgcctttcttccgtaccggatggtttgctacaaggaatcgacgatgacccatgtaaacaaccttcctacagtgct

SEQ ID NO: 89265 - DNA, 1528 bp, Oryza sativa
ttcttagcctcgtacgttgtctggggcaatttgtttccctccggaagaatgttcttgacgagtttcaataaatcgccaaatgccttgtcactaaccccattttttgccttccattgcaagaactccagagtggtatccaactttttgtgcccctgctcgcaacctgggtataacgaagttctgtggtcctctaacatcttgtccaatttatgggcccccttttcactttcgcagtcctccttggcatcctgcaacatctgaccaagatcatccgcaacgtcgttaccatcagcatccctttcctcctcgcccgtttgatttccttcaaatccaacgtactgagcaaagtccggaatattgtcgtcttccacttcatcttcttccatttcaataccttgctctccgtgggatgtccaacaattatagcttggcataaaccccgactcaaacaagtggaaatgaatagtcctggatgcagaatactccttctgattcttacacttattgcatggacaacaaataaaacccctttgcctattagcttcggccactctcaaaaaatagtgcacgccgtcaataaactctttggaccgccggtcagcgtacatccattgccgatccatctacatgagtcgaaaaaaatcgtacacaaataattattcttacaataatgacagtcatacaataattataagataattacaaactgtttcaacagtcatacaataatgacacatctttattcatacaaaaatcataaaatattacaccaaataattcttatttactatttctaaagttttaaactaattttaatgtgttttacttcttttaattttcattttagtttgttttctagtattcaagattaactttcactatagttttccttctcaactattttataaaaccttctttatcaaatcaactaaatttgtatatattctttctaacccacacaaattttctctctcatcaacttacaactaaattttagagacaaaaaagtgtgcaaaacataactgcaaatgtaatatgacaaaaaaaacattggaggatgaagttgcaacttttttaggcacctccgatttgtatgtaattaccaaaataaattcactagaaattttggcatgacctaccctcttttttgaagaaattttgaagcttgctcggcaagctgaagaagaaagaagacatatatatataggggtgggactttaattccggttggtgttaccaaccggggctaaagatccccgagatctaccaaccgggactaaagttacgatcactaaagatcccggggggcctgacaggccctgacagcatttgaaccgggactaaagatggtgaccaacccgggactaaagatcaaatatgcccattacccttttgaaccgggactaaaaatcatctttagcctcggtttttattgcatccgggactattgtggaatttgtccgaccgacgaaagatggtttctccaccagtggatcaaagactccaagtagcctagtataatatttag

SEQ ID NO: 89266 - DNA, 3961 bp, Oryza sativa
  unsure (1)..(3961): unsure at all n locations
gtaggcctcctctctcttttctggtcgaagccaaattcagggagatgggcctcacagcccacgttcacgtttattttcttctcaaattgtttttttttatctatatgtactaactttattttcttctcaaatccggcctctacaccaacaaggctgtacacaaacacaggaggtccttcagtacaagtttgaactttacccaagatcacaactgaaagggaacactaaggctctaacccgaaacaaaacaacaacgaagtgcatcgaccaaaggacatacacggctgcaaacaagaaaagccagcaaactatacccctcaattattttcctcatgttccaacccttagcaaagaagtgcacaacggtagtctccaacagtttgcaaccttctttcatcaagatgctttctccctcttttaataaaacagactactgtctcattcaatatattttcctgaaaatgacatttaattaacgaagttgatttttatgccattgagacaatgccatttctagagatccacatcgcccaacatatagctgcaatccaaataaagagatttagtattttagcctagattaatccaaacctttgaactaaactccaaacaagttagcaaccttatgaggcggtttgaaccagaaaggtaatgaaaatgacacatttgaaacacatctaaccacatatatggcaatcaatgaaaagatgttgtatcgtttcatcttgattacaaaagagcacccaacatcgtcgccattccatctccgttttgctaggttatcctttgttaaataccactagaggattttaatttttaacggaattctcagcttccaaaagtggattgatgataaaaatgggatcttcagttgactgcttcttgtttctcttgttgcatctggcgctccatcacatttggcttcttttatagtaacagagaagggaaggaccagaacagaaaaatgaaaaaaaaaagcattgcaatgttatactttgccataccttttatctaaaaactctggctacaaaacatcgcgtggttcgctgatgggccggtctgtgttgcttcagcgatcagcaccgcaagtaaataaagagagccgccggaatggctcaacgactgatacaacacgagctgcatgaatgcacggcgtaactaatttggagccaaattagtcatgggattagctttccggccggatagaacatagtacagaaacgagggtaagcctcactacaccggattaggtcacctgtgatgggtcctaaccatcacctttgaagggccggtttgggcctagtcagagactaatggtcactgttgagtctcagtcacctttgatggtgcccgttagaggtatcaatcacctctgatgggcatgtatttcatgcccgttagaggtatcagtcacctctgatgggcatgtatttccgagcccgtcacaggtgatgatgaccacaccgcagtccgtggttgcaaccccacaggtgacttatctttgaggctgtgacgggtgcattatattcggcctgtcataggtatatcatctttgacggggtatagtatcaaagctgtcacagatgaggtcacctgtgatggattttgttatgacccatcagtgatgaggtgaaattcgaaaaaaaaaacaaattcagaatattagctagcctcaggatttactagccacgccctctgaaaaacagaaacatcacaaatatatgccaggcaccccaaatatcacatattccccattttagcacatatgcatcttaaaatttacatcattcacatatgcagttcaaatgccacatatttgcacaacacattcataccacattaaagccacaaacttgcacaatttcttgccttgcacatgaaaccgcaaacttaccaaagtttcttgtatcctattccttttgaacctccacaatgacctgtcattaaaaaaaaggagaaaacaattgaacggtacaaagtaattcgtagtagatcaatggaacactggagaaatcgtcggagcttcttgaagaagattgcgtggcttgagcggtgaaaatggaagtaacggtgtgaaattttttagggtggtggttgttatttgtaaacatgtgcttaatagtcgaaaggataacactagcaagttgcggactgaaagagataattccactgtgttatataacacatcggaattgggggagcatgtgttaacagtgaaatttggcaagatagactcggatttggagttggatatcgaaacggaatcaaaggagattgatttttgccaaaacagactacgcatcgacttgaaacagagtcggaatctggttgagccgatctggtgggaagccgatacagcctaacttgggctcggtttgggcctcaattgagataactatcattgccgtttagagatagatctcatctaaggcaattgtatctattaattaggatatttatcttggtttgggcctcaattgagataactcttttcttttactttccaacgagttcttgcttcaagtcggggtatcggctgcgatctctcgacaagtggtaacttgtcttgaaggcttgcgctatcggggctattatatcattttaatgtatcaatcattttattgtggtcatttttatcacatatcttagttaatatagtcttagtatctcaatttagtcatatcagttgattctcgttttagggtttttgtcggtattggcttaaatcgtcttactagattagattagctaaggttctaccatcccgaaaagttgttaactccttgattgttttgactttatgtttctctgcgtattttgtgatgcatcatccctagccgtgcttagaatcatagaaactaatccggagttaatcataattaaggatagtatcggagtttcagccgatcttacctaatatacatgacaatgcatgtttcatgatctgtttatgaatatttgccacttatatagatagattgatttatataaatgcatcaagttagattgatctctcttaaactttatatctggtgatcgattgttatttggtacgtttatatagattgatttctttatataagtctgtattagagtattagtcaatacattatttgtttttgctctaagtactggtctattggactattttttataatactggcttaaaatggatggcaaaaaccacaagagatggtattacaaccgttagggcatatttagggtttgcactttatctattcatctaaaagccacaaccgatttggtttaactgcatcggctgggtcctgacgatacgtcatcggctctatcggccgatcggctatcgntcatctaattatgttttctgttttatcttgctgcttgccgatctcctgcaaaagggcgtgatcgatagtcactcggttcatcctttttgcgcccaggagcttgaaacgacgaaccatatcctcctacactgtgtgttcatacgtcaagtctggcgcctcgtcctgtcttctggctggcgttggctcgccccttcccatggctgctctctttaggtctggtggccgtcttctagggcctgtctaccaaagtgtcttcgcaagggctttgacactctggtcctcctggtatcctggcagctgtggaaggagcggaaagccagtgtttttgattcgtccctttcgccggtctcggtggttctggagtccatcctttagaagaatcgtctttggtctcttgctagtgccgcttcatttggggacctgttgggaacatagggcagcagttactccaccacctctctccctctttataggagcagcattttcagcttgtttttcctcccttcgcggtcctttaccttgcatgcggcaagggtctatctgatttattgcgttgtgaaactaaaactctattttcttctaatatactgacgcatagtatttttgtgcattcatgaaaagaaatctgtttt

SEQ ID NO: 89267 - DNA, 590 bp, Oryza sativa
ataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagtgcatagcttgagt

SEQ ID NO: 89268 - DNA, 528 bp, Oryza sativa
aattaaactaactctgtgttgtacggcaacagtatgaacgtcttgtaatgctgcgcctttaggagatggacgagattgtcctctgtggcttgcggatattggtcgagcattgcgacgtttactttccgagggtcgatgaatccagtatcgaaaaccccccgccgtcgggccctttgaatctccattctacaatgataaaagggagtatattattttctatagtctacttatatacaaggacctaattaattaaaggagacgtagtaagaaatctaactgaacgatatacttacaaaatccagcaactcataatagagacgtcgagggcatccagctggtatagatcgtagattccctttgaaattgatccagagaatgtcatcctttaattaattaggtctttgttcttggcggcgtcaactttcgcctttttcggtggccttgtgtgggcaagccgtggaactttgggggcccttgactttaaagtgcccgaagaagagcttgcggaagagtccgtgcacgaaccta

SEQ ID NO: 89269 - DNA, 2015 bp, Oryza sativa
ctctgacatgcctcctcaagcacaacggattagtggaaattatggctacacaaaccgttgaagatagttctagaccttgaccaagacgaactcgcgtaggtaatttattgaaactcttgaattcagaatatgggaatgtagctctgggttgggggagtactcattttaggggggggtcgcaatggctttatacgtggtattcctatctattatttttgaaatttatagttcttccatttcagaaatgctcattttggtggaaagacggctttgttctacaaggacctatggtatacctccactctaggcatagaatttccaaccttttctcatatgcacaaaaagaggacatctcattcgaatccttcatgcaacatcaagagataacctcaaactttcacttccctatctccacacaagctctacgagaactgcaagaactcaatgaactaatggccacaatacaagtgagtactctagaagatacatggacttatatttggggcacaaatctgtatcaatccaagaaggtgaattctcttttctttgcaccgatacatccatctccttctctaacagtgatttggaagagcaaatgtacaataaagatcaaagtctctttttggctgcttttagtggaccatttaaacattagaggcatgatgcaaaggaagccttaaacctgcaaactggagttaaatttcctgtatgtgattcccatgttttggaagatgtaacatgttttaggagttctctcccgctcaattcatgatgggtgtgctattaggatcattcttttatttccatattcactaaattgttcaccttaacttatgttctactactcatttttcctcttctttcgttgaggaaaatgcaacaggataactgctcacgttgatttcattatcaactgtactaggtggtttggaaagataatgctcttctagtgaatactatcctgaacaaaactgcatcttccgtgcgatcaaaagaatgtcaatgaactcatttatctggcgtactcattcattagagtaacatctagatactaaggagagattgaaatacttgatcaatctcatcaagtcaataaacagagcgtatttgacttaacggtagctcagagctttcttgttccagcataattttgacttttgttgcatatgtcagagatattctagattcggcaaacttctagttcacggtgccagtcatcttccgttattaaaagtatgcgcaaattatattaaggtaaaatgcacaaatgctacaatataatggtacacataattcccacaaataattctaatgtattctatgcaattctatattttatcacttaaaatattaattaaaggtaataaatgcattacaaataattaaggcaaaatttgctataagacaccttaaaaacatgatctttgccagagtatactgtaggaatatgaatttacagtaacatgctcttagttttccagaaatacaaaggcctttatgcaaaatcagaagattttcctttctttttttcttacctttcttcctcttcccttttctttccccaccccacgatggcaccgcctgccatgtgcggcagttcggttgggcagcggcagcgaggtgtgaccgggcagtggcagtgcgacatgctgggctgcaaggccaggatcacgcgttggcaccaaggcgagcacgctacgctagcccgacagccaccgcatcgcagcgtgttgccttggtgcgtccacagtgcttgggaagtggcaatagtgagggcacactgccattcgatggcccaagggcggaggccctgtgcatgtgtggcggccgttcgtgggcgctgtggcctgacgtgcatgtggcaacagcggcggcgtaggcatggctcggcaagacggcaacctcagcacgggtgcgggatgcgcgattcggccccggcctcggtgcggaccccgggcacgatcgggcgtcgcggcgcaacagtggaggcacggacgcacggtggccagcgaggg

SEQ ID NO: 89270 - DNA, 5350 bp, Oryza sativa
cagtccctttgcatctcctgttattttagtgaagaaaaaggacaattcctggcgcttttgtgttgattaccacaggttgaatgatcttactgtcaaaaataagtttcccttacctgtggttgatgagttacttgatgagttggctggtaccacttacttttctaaattagatctgcgcagtgggtattatcagattaggagacaagaatctgatgagtataaaactgcctttaaaactcatcatggacattttcaatttcgtgtgattccctttggtctcaccaatgccccagctacctttcaatgtctcataaattcaatttttgcccattttctgcatagatttgtcttggttttcatggatgatatactggtgtattgcaagtcttgggctgatcaccttcatcacctacgttgtgttttacagttaccgcaacaacatcaactttgtgccaagttgtctaaatgttcttttgcagctccacagttggagtatttgtgacatattatctcagctgctggtgttgcaactgactctgaaaatattagagtaatgttgcagtggcctgtgccaactaatctcactaagctcagaggggtttttaggcctcactagttattattgcaaatttattaagcattatggtatcctggcaaaacctctgacaaccttactaaagaagaataccaagtttgtgtggttagataagtctcagcaagcatttgatgacctgaagcatactatgactactgctccagttcttgtgcttcctgattttaccaagcccttcactattgaaactgatgcttgttcttcaggcattggtgctgttctctgtcaagagggccatccagtggctttttacagtaaagcattgggagttaataatcagaaattatctatttatgaaaaagagttcttgactatcatgatggctgtggataagtggagaccatatttgttgggggccgttttgttatcaaaactgacatcagtcctgtgtcatttggatgatctgattttgggttctgagttgcaaaggaaggctatgaccaaattgattggtctgcagtatcgatttcagtaaaaagggggggggtctgaaaaccgatctgctgatgctctttctcgtgtgggccatttttttctatgtacattctatttcagtagttcagcctgtgtgggtgcaggaagtggttaactcctatgtggtggattcccaggctcaatccttgctcactgaattagctgttgcctcttctaatgcccagggttattccttgtctcatggtttgatcaggaagaagggcaggatttggctgggcactaattctgctttacacactaagatcatttctgccatccatgactcagctattgggggccattttggcattcaggccacatatcagagagtaaagaaattatttgtttggagggatctgaagcagtcagtggaagaatttgttcagcaatgcactgtttgtcagaaggccaaacatgaacattgctcttatcctaggttattacaacctttaccaattccttcaggggtttggcaggatatctctatggattttattgagagtcttcctgtgtctaaaggtagtgatgtcattttggtcgtggtggatcgatttactaagtatgcacattttttgccattgaaacacccattttctgcactgcaagtggctgaaagttatctgaatcgagtggcttctttgtatggcatgcccaaatctactgtgtctgatcgtgagaaaatcttcactagtcatttttggtagcatttgatcaagagatttggcattcctttgaatctgaccactgcgtatcatccccagtcagacagatagactgagtgggtaaaccagagcttggaaatgtacttacattgtgctgtggcttcagccccccactaaatggagttcctggcttcccttggctcagtactggtacaatactagttttcattcagcattgaaatgatctcaccacaaggctttatatgccagtgatcccacctatggtcttttgccttcagtacctgagcctgacgaagatggtgacactggtgctgctggtctactgcaagaacgtgctttgttttgatctatgttgcaacatcatctggctcgcgctcagaaccatatgaaacagttagtggatgcaaagcgcactgctcgttcttttcaagttggtactcttgatattacagccatatgctcagcgctggcattcatgtattttgggtcctttgaaatcttgcaggcaattggctcggtggcttacaaactgaagttacctgatgatagtctcattcatccggtgttccatgtgtcccagttaaagcaatttgttcctgacaacaaaccgatgtgctctcagttgcccacggctgctcaactggatattgccgatttcatcccttctgaagttttggatcggcgaatggtgaagaagcgcaatgctgccgtggtccagaacttagcgtgttggggttctcttcctgctgctttggccacctgggaggatgctgacgttgttcgcaccagatttctggacgctgtcccttggggacaagctccaattccagggggcaactgttatgcctatgccggatgagctactggcaacgaccgaaggaggtgtgtcgaactgatgcgaaaagacgtttttgagtggctatagcatattgagtctatgtactgatttctgacactggcttgtggggctaacggttgttgagtcgggtgtgtggtgtataaatcgccagcctgtaggcacgtgacatctatcgaaaaagagagaggaaaaatactacccgtcctctgcttctctctttctttctcttgctgtgttttcttcttcctccctactactcggtttctgtcagatctccggtgagcatcgaggaggtagaggccgcccccgacgccaacggcggcggcgaggaagccaatcggccccgcgtggaaggcgacggcgaaggtggatctcctcatccccccgcctccctccttccccacatgttttgcgcatagggttttccgtctcacgggatgatgcttatgtgttttctaattcattcggtgcttgaataatccgcgaagggtttatagtccgtttcatctgatcgtggtctctctttgaatcaggtgtcttgcagagcaacgagtcctccgcgaaggtcgatgagccggtagctacagagaacagtgacgctgctcctgctgaggcatctgtagatgctgtgaacggcaagattcctcctaccaaggttacttcttatgctggaaaggccgatgcctacatcaacttaggcttgatcgtggtcataaatgttcatgtagttgattccccaacatcctctggaaggtgttacattgacagaaagaactgtacgtattactgggaataagaagcagatagaagcggcaaaagatattattaagcaagctatgagtcaggtaatgtgattctgtgttttgcttttaactgttccttcatgctgtaaataactagtgatattagatgatgctgtgatcacacaatgattgtacaattcaatcatgctgtgaagaactgggtgatgcaatatgatgatgagatgctaaatttgtactttatgcatttccattctattcatgctgtgattattttttcgttgaaagtgaatttctgttacttgctctggaatcatggtgtgtattatcgaacctattgtctctagcatgaccttaccatcttcgtatgatatgattggtataattcaatatgtttttctgtgctccctgataatagaggtcttagaaatatagaaggtgttttttggttcttgttgagtaaacctgtgatttctttcaatcagcttaattaaatttgtgtcctcttatggtttgtgttgatgtcattttattgataccttctagaactggttccagcatttgttcatttcatttttaatagtttccataaacttgaaatgaatttcttttacacaaaaatgcttcaatgcaaatgcattttgttgaatgaaacacaattttactgcgtcaagggagtgctggttttttcctcgcttattacatcttaagtgtataaactaatgtctcttctacaatgggccttgtatgaagtatcgatcttgaaatatagcagtgcataattggactggaaggtaagttcttcttaattggtgataagttttagtgtcttttttgccaagtcaatgagatgccacatcctcgagagtatcatgtacatattaatacttaatttatacataataatttgtttataatctttcatgagttataatctcctcgtggtcaattatttttttgtggtaatatttgtcatcttccacataattcagtatcttgccttgcttccttttcaatggtgaaatttattccatgtccatgaattttatggtttttgcgttatcttaaattacaaatgatgcatgtttagtttcccatgaaaatgttgttcattcatggattaacaatatggaaacatggtgtgcatgatcatatatgtcaactatgaatgaagttagaataaatgatttgactctgcaatggatatcttttgaggatctgggagatatgttcacgttgacataaaaagatattctagtctcggtggcttgatagttcttcatagttcgtctagaagcagaacttaccttcgtgtatgatagtgtggttggaattcagtacttcatcgttaaaactttggtgctgtcacatgatcaatgaacaattactgtggtactagtatcaatctttagtcggttagtcttttgagttttggtaactgcttactgctagattagatcttattatgtttcctatataagaagtcagaactgactcaccaggttcctctcgcttccagtttccatgatttattttgtttgaaggtgccaatttggagttggatgaagggtaggtctgatgcttgaagggagtaggtttgaagttgaaccctaagataaaaccgacctccccagatgtaataagtaattagcataatctatttgcagtaacctagtcgaatttatgaattgcttgtgaactactacatgagtataaaaattagcagcgcgaatgaaatatgaccatgtatgtgcctataatcgccatggtgattaagaagtaataaaacattcaagccatccatgggcgatagtctactacagttgtacacagccgcatcagtaatcaaattagagatcagattgctgctacagacgcaatcgagcatcttaaaacaacctaaatggatcaatcgatactaccgaatcgaataaggaaaatcaacggcttattcgcggat

SEQ ID NO: 89271 - DNA, 7048 bp, Oryza sativa
atcggcttgagggaagaaaaggacagggaggggaagggaagggccccggccggggggacctcgcctgcgccgttgactcccttcggccagccggcaagacgggcggcggcgtgttgggccggtggcgacggcggatcaggtggtggcgagatgggcgcgcgaggggagcggcggcggcggaatgcgcgagggggagaggaatgggagaaaaaaggttagggttaaggctgtgcacgaatctcaaagcatatccaatggtccaaaatttgaaagattggaggtgggatattctatcaacagatgtataaacagtccctattttttatttaggatgatcatattattacatgattttaaaatttgtgggtgtggaaatatatatggccactctgtttctcccatcatcttaataaattttggtaaaaacaagaaatgtatgtggccagattttttattgcctgtccacaggattcatctgttgaattttaatataatggtgaatttgttataattacaccatacaaagttataatttgatgggaaactatcattggagatcgttttcactgattttttgttatgtctttctcaggagagtatgttggtcttactggtgtaaggttggatgctgctgaaatgcttgcttgtggcctagcaactcattttgtaccttcagatgtaggtctgccagtggcttttgaattttatgttcagtgtgggaccacatatttgttcgttttatgtttggaagtcaactgttataacatgtcctacacacttgacttgttccaagtgtgattatagataacccgagtattgctggttttctaattcctactagtacactcactcttgcagaggctgtctttgctagaagaatcacttaaaaaggttgatacatctgatccatttgctatatgtggaattatcgatcaatattcgcaacaaccatctctgaaagaaaaaagcgctctgaataggtaagcgtgcaattgtccagacattaccttttcatgcacgtcaagcttattctacttcctttgtgtaccctgtaaaaatgacgtatcctggacaggtgggatattctggttcacaccaagtaatcttgtcgtacaaatcctttttggcatgttaaatttagattgattaatctacagtttttaagttactagtagctacataaagttccatagttataccatcaatataaatttcatgcaggaaaaactcctcatcctgggggcgtgtttgaccaatttatcctctccaaacaactttattttgggtccaagcctcagcccccagatagatagactagtccttttgaaataatattagcttgtaatgaagggcaggtggagaaatgtaaggaattggaatgggggagatataggaaagcaacagcatgcacttcccacatcttgtgtcttctttcaatagatggatgggcttcaacttatcaaaaagcttggtaatggttgtctggcctggctttaaataagccgttccctatgccctaacggcctaacctgttacccgtgtgttttctatattctcctcatctttgaactcatttttgggtattgcttttcttaatcttgtttgaaggccaaaaaggcaattgtcagtgcattgtaacttggaaggacttattttagtttgtcaggagattccatttgttcctctttcatttcaaggttttgttttctcatttcattctcaggtcaacttttattgcctaatccatatctgctacttccgtcatatgattgcaggctagaaatcatcaacaaatgcttttccaaaaaaacagtagaagaaatcatagcctctcttgtgagttatgctaagtcctcatttgctttctatggactctccagttctgttgtgctaaatttgatgtgtatcatgttaggaacaagaggctccaaatgttgctgatgaatggattgcttctgcaatccagtccatgaggaaggcttctcctactagtatgaaaatatccttgagatcggtatcctctcaaacatttccaaagcatacgtctttatgttactcaagtcattctatcttggtgccttctgatgcaaattattgtagtgtaaggcactactatttatttagacccatcaatcctttatatggtttcatatgaccagtatttatattgctcaagcgcatacttcagatagctttatgaactgaaccctactcttttgtcttggcagttggcacaacagatcagccctatagccaaaaaaacaaaccttctaagattatagcttttgcatagtcaaattgcatgtatgggcataccagttctaaaagctttgtaaatgtctttgaaactagtcgttggagggaagacaaggctcgttcactccacagaagagtacatgtgctagaaaaggcagccagcttaaaaacaccaactactttcttaagccttatttagtttggttgcctacgctgatctccggcgtgctatgcaacaccccctgcttgcttctttctgttcgacttggagcttgcagcctccctacccttgcttatgacctattcttaatagaaccgatctgattttcactacaagaggaattccgtgcttctgccggatcctccctatctcctgatcaagcttgtgttggtaaatactccctccgttttttaatagatgacgctgttgacttttaaacacatgtttgatcattcgtcttatttaaaaattttatgcaaatgtataagatacaaatcatgcttaaattacgttgagtgataaaacaactcacaacaaaataaattataattacgaatggtcaaacgtctgacaaaaagtcaacggcgtcatctattaaaaaacataatgtagtactccctccgtcccataatataggggattttgagtttttgcttgtaacgtttgactactcgtcttatttaattttttaaaaaaatattatttattttatttgtgacttactttattatccacagtactttaagcgcaacttttcatttttgatatttgcaaaaaaattttgaataagacgagtggtcaaacgttgcaagcaaaaactcaaaagccctcatattgtgggacggagggagtattgtttagtatggcctatagtagtacactgtttgggacagagttagtgcccttctcacaacatcccgtctggcggaaactatggagggggtggctagcgcgcgcgtgggcaccaggaaagtagctggcgagcattccccccttccctttagtcttaactacctatattagttaatatacttaacagtaatgatagtaattaggaaagattcgggagattttttttactaacagattaaaaaaaatttaagttagatttgaaaactttcgatttaagttttaaattttaaagtcaaattttaaaaactttcaactcatatttgaaaactttcaacttgagatttgaaaactttcaactcagattcgaaactttcaactcaagaatcgagattcgaaaactttcaagttcggatttgaaaattttgaaaactttcaatttgagatttgaaaactttcaactcgagattcaaaaacttccaaatgcagatttgaaaattttgaaaactttcaactcgagatttgaaaactttcaaatcgagatttgaaaactttcaagttcagatttgaaaactttcaaactcaaaatatgctaaagataaaaaaaaatcagaaaaaagtgagaaaaaaaaggaaaaaaagggtaaaaaaaacgaaaaaaaatcgtagcggaggcgcgcgcaccggcgcagcggcgctgttccttcttggccggaaacgcgcgccgccggcgcgctcgctacaactagcggaacaaagcagttagatggttcactttgtataaccactacaattttgacagaaaatagtgttatggttagtttctagccttttaagatcatgtgacctatcttttgggagttctggtctttttcaccaggccgacaacgaaggaagccctgaccaattttattaagatcaagaggagtaaagtattgtttacaacaaacatggttgtttagggatcaccctaacacaggaacacaacttaaaagctcagaattggccctaagtccgggagaggcacagaattggttgctgccacaacagggcagccctctatcggcgcacttcagtgatcaacattcctcccaagcatgcatcacgctaagtccattcttctatgatgcagcagattacctcagaggccgatttgctggcaccgtcaaacacctgagcgttccgttctttccacattatccaagagattagaattactactgcgtcaaatgggagttccaatctcaccatgagcttcgaggtgtcaaacctccagctatcactacctactaaggtctaaagtggagcttagtctctaagaaaagtttgttttacacctaacattcagtagggaaggtctttgttttactgtagtatatgtagttcgcgagacgctagccatctgtgcccccattatgttcttagcttgttgtatttactgtgagttcagataagagaaggccgaacacaacttgttggtgaatgcttacgtcgagaatatagaatggtttgccatgtgatgcgtggtgacttcagtagagacttctttgaggtaaatatctatctacatctccccatgacatgttcacttaagatgaacatactttggacgattcaattcctatttgcagggatgcagggctatattgttggatagagatcgaaacccaaaggtcagcttaacatcctgtttgtcagaaaattcgttcttcacatattgtctaatctggcatgggcatagcattaaatctaaccctgacatctttgctaattgcagtggatgcctccaaggttggaagaggtgcacgacgaggtggtcgaaaaatatttttccaaagtcgatgatccagagtgggaagatttggacctacctcctagacgttcccatggaaggaggcttgttcccaagctttgactgaatgaagcctctggtgaaaaactgaagcctttgttggtgcttcttaataacaaacagatcgtccccaatttgagggatatgtggagacaagcgatgaagtttataataaagctgaaacatataatactataggttaacaattttattagtagcaatttagagaagtccatctcatagtctcatgcgatgcttatattggtatcgctattgtgctttttcaaggtgtgaaggtacgcttcaagccaaagcccaactgcataacggcggcccatatgataccggtatcaggctatcctattaggctttgaagctatcttctgcttgtagattctaggtaatcttttatatatattgtataaaagaaattcataagtttgcactgtgttgttttttaagtaaggcctcgaaaaggtagatccctaatatcgagtgtgtcttgtaatgcacttgaactgattgcatttcgttgatgaaatgggaaaggtccactctctttgtccaaaataaataaatctatatctatatctatctatacctaataaaaaaattcgtaaggcttccggtaatttttcatctgtcacctatcgctcgcgtcagtacaatcgtgcgcgatgcggtaatcagcttccccgttcaaacaaaatcgaagacagagcggataccatgcttcttcttattgtatttctctgaaaggcaaggggttttctataaaaaaaacataacaggcatttaggcagggtaagggtcagatcaaaattttatacatggacaagaagttttttgcaaaatacctaagatgcgcgtggcatgcatgcattcttacgtgttcctagagagaaggaatttatccatttcatgtttcgagctctcaaaaaatggcgtggaaacagatagaaactcttgaatggaaattgaaaagaaatgtagccccagttccttcggaaatggtaagatctttgacgcaagaagaaggggcgacccatatcatcttgacttggttctgcttcccctctttttttaagaatacggctaaatcggagatgggcggtgagacaaaccggacactaggcagatcacatgcatggggaacagggatttgaccgaagaaactgctcagtggcagtctatacgcccaattgaggagcctctccccgcagtgttttacgtgtcgcacggaaagagcaaaaaaaaaaatcaaaaaacgagaaaaatggtacggtcaggctggttattgattgatgatttgtacgggaaaagtacacgcaaggtccctcaacttgttagccagatacaaaatcgtccctcaaccacaaaaccggacatccggcgtcccccaacttacaaaaccagtcacaaaaggtctctcggcggttttgaccccggttttgtcccacgtggcggctaactcagcgtgagacccacgtgggccccacatgttagtaagccatgtcatcacctctctctatctttcctcccccttcctctctctctctttctctctcttacttatctcctctcgacaggctggacgggccgggcggtgggtggggatgtcgccagggtgaggcgggagaggaggtccgacgaccgccgaccggcgacgcggtggcggcgacacgggagaaggggagggcggcggcagcccagcgcggtcgctgcggccaacagacatgcatggtacgggcggcgcgaagggcgacagcggtgcgtggttgtagacgaagccgaggaagacggtgtcgacgtctcccccaggcttagccaccggggaaggagccgggcagccgtcgagggcatcgcggctttggtcctcgagcgccgtcatggcgtcgccgtcgtcgccgcgttcctcccgtctcgccgccaccgccaagccgacgccgacgcgttcctcatgcctcgtcgccaccgcccagccaacgagctcgccggtctccccgcgcctccgctggctgcgcgtgtggctccagcttggccgctgcggtcgcccgccgctcctcctcgtcggcgagcacggagaggaa

SEQ ID NO: 89272 - DNA, 731 bp, Oryza sativa
  unsure (1)..(731): unsure at all n locations
agcggtnnnattangatctgctcctcacctcnnnnnnnnnnnnnnnnnnnnnnnnnnnnnnnnnnatatatatataaaacatgtgtactaccttcatcttaagagattttgcccatatatatatctacataagcaaaatcttttgtatttagagacaaaggtagtacaatatatctcatccataatacacaaacagattgtacagcaagatcaataaactgaatgaagcttactcgtattcatggttagctttgacatgttcagtcaaggcatctagaagagattctctagtcttgattatgagtaactcttcagcatcagtttgcacctgcaagaaggcagattattgatcactaaatcctaggtctgctaaggagcaggaaatacatcatccgaaggaatgataaaccactgaattacaaagatgagaactattaataatctattcagtctataggtaaatttccacaacgcacctttccctcccaccaataaacagattcaatgcctgaaaaatgtacagaacttcagtataattcagtataaacgataatatgaaacaagctaattgcgaatcttggcacagcacctgttgcctaacagcataaggaagggcagcgcaacaatcattggacaaccaaagcaccattatatttcgtgattcaacagagttcttggttcagtccaaagtaagggtaagcaaaagcttaaaagggtttgtttccacatat

SEQ ID NO: 89273 - DNA, 779 bp, Oryza sativa
  unsure (1)..(779): unsure at all n locations
ggccggggaaaggggaaaggggnaggaaagccgcccacggnaaagagnnaagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctgaaatttccctaattgatttgccggtaagttacgttcttcattttggcgtgtttaattagtataaaatttatcataataaacataaaattctagtttatcgtgcttctaattgagttgttcagttgaggagttgagattgaggtcatggctttccaatttcggattttcggtcagctcttttttcttggatatactccatatacacaacagtgatagatgtgtatattttttctcatcatcggctctttcaatcttaaaacagtttgtctttggttatatagattcgctagtggtgtctgtgtaaaatctttcatcctacacagtnnntgcttgctttggtttcttgat

SEQ ID NO: 89274 - DNA, 1523 bp, Oryza sativa
  unsure (1)..(1523): unsure at all n locations
ggcgccttgaattcgtaaccnnnnnnnnnnnnnnnnnnnnnnnnnnnnnnnnnnnnnnnnnnnnnnnnnnnnnagatctttaggatttatgaacaagttattgttcacgttatcagatgaactttgtgtattctgagaactgagtgttctttcttgtttcaggcaaataatggcaacttctctgtcatggagggagggagtaggaaacaacctttctccaaagttccttctttgggtggtttgttggaactgttggatcagtgagcctataattcgagccaactatcttcgagtgagtacagttgacatgagcatcgaatgcgatctcgccttatctttcttttagtacctcgttgctgaccatcccctttgacagatacactgatgtatggacaatgctaggctcagtcagtagtcagtggttgggttgctgctttcttcaagtttcctgccgccctgatgctcgtcttgcacggagatattcagatttactgtgtattttggtgaatggtaaatcataatttgccctgtaatgttgttgctgtacatgtcagactagcctggattatttcactcaatttgtgctagtgagaaccacttgctacgtatggtagattgataataaagagattgtgctgagtccatgcatctaaaactcggatactttttttttttactgaaaacagttggagagacttctgctgcgctatattaatagatatataataaaactcagatacttctcccttgaattattagttcgtttctgcatatatttaagcttaaaccaaacatctaaactattaaaatatcttccatcagattgagttgtatgaattctcttaccaatgcaatcccaaatgtgattaatgaggaaaagtttttttttcctctttctgaataaacccgagttcatactgtacaaagttcagctgtattgggcgttcagtccagcaaccggattcaaaagtcctgcttaagatatcatctgatcttccgcaaccagtctcaccaagattatgtaactaattcatagtctttaatctcttcgttccaaaataaataaatttaatacttaattctttatttcaaaataaataaatctaatacgagatatgacaatcctatccttttgagtagctgaatgtgttgtaagatttggaggctgtgttcagacctttggttcttttttcttttgtttggattgccgctgaggctgaacctatgatcatttctagtaaaagaaatgggggttttgagtcttgctcaaaagaaaaaagatatgacacattctattatcatgaatctacagtaaccactaagaaaaacatcatgttaaacattaaggttccgttcttttctccaacaagagttggataaagattaagattttcgtggcacgcttttttaaactgttaaaaggtgtgtttcgtgcgaaaaactttttatataaaaattactctaaaatatcatattaatctatttttcaagttggataattaaaactcaataggcatacgcta

SEQ ID NO: 89275 - DNA, 705 bp, Oryza sativa
  unsure (1)..(705): unsure at all n locations
cggtccttgtgatcgtnnnnnnnnnnnnnnnnnnnnnnnnnnnnnnnnnnnnnnnnnnnnnnnnnnnnnnnnnnagctttcttagtcggagacctggttttgaggaaaattcaaactacacgagatcggcataagctatctcccttatgggaaggaccattcataatttctgaagttactcggccagattcttatcgactcatgtgtgaagacggtactcatgttgacaactcttggaatattgagcatcttcgtcgtttttatgcttaggcattacttttgtatcttcctctttgactactaacatcaagttgttccttgagttaccagtcgggggctactataataataatggagtgtgatttttatcaattcaatttgcttacttgatttatcattggcttgtttgattttttagcttagccaatgaggactgaaagtttttaacaacttttgcgggttctaggctcaataaggtttgataaaaacttttaagaaatctagagctgagtttaaatcatcaagcacagcataaattcatcagtattgtacaaattgtgcctccatcatcatcatcattatcatcagaatacacaatcaatcagattcagttttttaatcattagagttatcagacccagtcggcttaagatcgttgtcctgtaacctctcaactacatcagcggctatctttgtcgcagcttt

SEQ ID NO: 89276 - DNA, 1630 bp, Oryza sativa
  unsure (1)..(1630): unsure at all n locations
cgattgtctctatcgggggtctgttaaacattgctcaggctcggcaanntgtttccagtcgggggctcgtgctggcctctacatatcgggtgctggttgattatcactcgggcgaccttcggcggtcggcctggtttctgttgaaggactagtctccgcgccattcggctcagggtcttttccgaaaggatctatatcagatggcttcctgcaagtttgagatatgctatcagtactacttcaatagtgagtgactggcgatacaaaggaaattgctaaacgacttgtacctagatgatttcctgatttttggtatgggacgactggatgtcttcttctttggattggcttgccttggctgtttttcggtcacccctttgttgccggcatcatcaccttcatcatcgctcaggaccaatttcctcttacgggagtctgactggttagtcgatttcgaggtgtttggttgagtatcggaccgaattttttgtactccactcgcctgactagtctgccgacggggcgagcgatgttgagcaattggaggatccgacttcatcaaggcaaattcctgggcatgatattccaagctttcaattaactttgcagaagataaaagcatgcttttgagaagggctgagatgtttgatacatacccgcggaggagggttgaaggcgttgtatggcaccactggcaacaagtgcgaataactgaccacgatagcattcgagaagattttgtacattctctccttcatgactttaaactcaagagaatctagatcttcacggttagggtcatgcttgccgtcaaactcaaaggttgtgcgggatctctctttaattggcgctagtcggcttttaataaaatgccgggtgatctgctctccttgcagaccttgctctttgagcttcagcatgcgatcgatcagggcaagtgcttgggccacctcatctcccatgggaagcgagttccaggtgtcttgatatactggaggtagacaagaatactcgggaagcgctggctcgggattttgcacatagaaccaatttgcatgccaacccttattcgaagttttgaagggcatggaaaagtatttttggctcaaggttccccttagttggaaaccggctcccccgacaacacatggtttgctcttgtttggctgaggcttgaggaagaagatgcgacggaacagggaaaaatgcggtcttatacccaggaaagcctcgcaagcatggataaaattggcaatgtggactatggaattggggtttaggtgatgcaaactaatcccataaaattccaaaatcccccggaagaatcttgaggttggaagagaaaatcttccatagaagaaatgagaaaataccacgacctcatgtgtgtcaggggttggaaatgtttcgccgcacgccggacgccacccaatgatctcctttgccggaagaacgccgtgcgccaccatctccttcaagttttcctctgtcacatcagagggcacccactgactttcaaagctttctctctcctctgccatggatnnnnnnnnnnnnnnnnnnnnnnnnnnnnnnnnnnnnnnnnnnnnnnnnnnnnnagctgtattcgattcaatnnnnnncacactct

SEQ ID NO: 89277 - DNA, 713 bp, Oryza sativa
  unsure (1)..(713): unsure at all n locations
ccgtgncctgatanatcgtnnnnnnnnnnnnnnnnnnnnnnnnnnnnnnnnnnnnnnnnnnnnnnnnnnnnnnnnnnaataggaaagcgtgctcatcacctttcttcaaaataataaagatatctttgcgtggaaaccatctgatatgcctggtattcctagagaggtgattgagcactctttacatgttaaggaagatgctaaacctatcgagcaacgacttcgccatttcgcacaggataggaaggatgcgatcaaggaggaattgaccaagctgttagcagcaggcttcatcaaggaagtcctacatcctgactggctggccaatccagtcctggttcggaagaaaacggggcaatggcgcatgtgtgttgattacaccgacctcaataaatcttgtcccaaagatccctttgggttacctcgcattgaccaggtagttgattcaacggctggctgcgagttactcagttttttggattgctactcaggatatcatcagatccgactaaaggagtccgactgcttgaagacttcgttcatcacgcccttcggggcctactgctacatcgccatgccttttggattaaagaatgcaggagcacttatcaacgcatgatacagagatgcttttcaactcagaatggtcgcaacgtttgagcttatgttgatgatgtagntgtcaagaccaagcngaaggatgattttgttac

SEQ ID NO: 89278 - DNA, 742 bp, Oryza sativa
  unsure (1)..(742): unsure at all n locations
tggccgttgccccgcccgcccgcaccgcngtggttggccggccgtcaggtaggttcccaaagctatcaccagtgctatagtatacttcctgtgtccctaaatatttgacgtagttgattttttagcacatgtttaactatttatcttatccaaaaacttttgtgaaatatataaaactatatgtatacataaaggtatatttaacaatgaatcggatgattagaaaagaattaataattatttaattttttttaataagacgaacggtcaaatatgttttaaaagtcaacggcgtcaaatgtttagcgacggagcgagtaagaattttggtaaaagaatcggagatcattcagttcactgatggaagctgccattgcccattgcgtgcaggggtggctcagctgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatggggta

SEQ ID NO: 89279 - DNA, 866 bp, Oryza sativa
  unsure (1)..(866): unsure at all n locations
cggtgcattatagattctcagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgggttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttaggcagcctcttatagcctaaagtctttgagtgactagatgacatatcatgtaagttgctgataggtttcagtttttcgcgtctaggtctcgatattgtacttttcctcttactcgacttaaccagtacccacccagcttctcaaccggattataccatgcacctttaaaccaacatcacttgcaattgaacggtgggtgttactccgtagattgctcgcaagggccgnttgaaaatggtcattaagctttttttgacacatgctttgaagacggg

SEQ ID NO: 89280 - DNA, 1393 bp, Oryza sativa
  unsure (1)..(1393): unsure at all n locations
cccatcaaaagaagaattgggctgcgattcacattgggctgtggggccaatcactccctccggggtgctcaacatgggaaaatagtcntaggcctcaagctctcccaccaatgtgaaaatagtctggtcacctacaagtttcttgtaaccctttcaaatctctgtttcgtgtatttagtggagagtcagaagctagacctcattttgagttttgatgtcagagaaccagagttcatctacttaaatacagggattgaattgtaactggttataaacatgtttttcaagatataagagaccatattggatcgaaactataagcattttctccacttgaacttctccggttaggcacttaagtaattaccaatgtacttttcaaaggaacatggcaggccaaacatagggctataggagtaaataaagaacccatagtttagcctaagcacatgcctatcatctaaatctaattgctttgacttcaaatgtgctgtttctgctaaaatatccattttgagctctgaagttgatccagtgaaaggtttgatcagataggaagaaaataaccagtcaatagaataaataattcaactcaaccaataagcacttcaaggagacagatccaacacaacattaaatgaggagagattctgtccatatatgatactcctacaaaaatatttgtacaaaaagaactccaaacaagagatcatacgagttgattaatagtacatccaagtcaagtaagaaaaacttgtgctgcagtaaagcaagaagatgctgcaagctaaagcaactaatacttggcataaaaaaaaggcagagattaggcaatgactgtgcattaaatattttgaactaccaagcatgtagctcaaggatgattaattacctagtggcctctaataccatgttcctgagctttcttttaggagcaccttctacagtcaaaacctgtgaaaatcaccactgtatcaatacgtaaaatatcagtggaggagagtttcataaggaagcaatagaggacaaagccataaggcaaaaggtcctaactcctttacctgggaaattatataggttgcatagttccaatggaatgagaagtagccaagtatacatttgtcgagttcctcgatgaactttacaatcagagtctcgggatcctggctgttttggaagaacgcgaatatgttttcttcgtaacccttgttcttcctcagataatcataggccagcgtacataggtgggggcattcatccacatggtcaaacccaatttgcctagctgaaaattgccacatatttgtgagnnnnnnnnnnnnnnnnnnnnnnnnnnnnnnnnnnnnnnnnnnnnnnnnnnnnnnnnnnnnnngttntacaaatcaaaacacct

SEQ ID NO: 89281 - DNA, 711 bp, Oryza sativa
  unsure (1)..(711): unsure at all n locations
ccgtgcatgagttctcacttgaacccgnccnnnnnnnnnnnnnnnnnnnnnnnnnnnnnnnnnnnnnnnnnnnnnnnnatagcagaggaaataatttgtcagacagtaagaaccgcatgacaccaaataggtaggtgaactctagtttctaaggcttgcattgtgatgctagtaaaattggcatctgctctaactggaactatctgcagagggaaaaatcagcgtaacaagggcataagcattatcagcttttctgaggaaggtgagggtattccctcgagttctactggtggttcggctcgttgtagttctagttgcggcacatctgcaaagttggaccaagataccgttctactcaccttgaaggataaactccgtaagctggggcaacgtctacatgaggtgatacatcttcttgaaaagttaactgcctttgttttgttgtgatatgtgaagtccagctgctctgttttggtcatatgcacgaccttccacggattatattatgagcattgtttttaaatgggatgagtgtcacatatgttgattgtatggaatatttgttttcgacccattacccttgtgcaattcatatttaaaatttattacaaaaggtaaacaatataagtatgtcttccatatttcatgcctatggctaatgactggagtctatgaatttaatctcaatttttcgtcagacaaacagctctt

SEQ ID NO: 89282 - DNA, 742 bp, Oryza sativa
  unsure (1)..(742): unsure at all n locations
cgatgaccactacattgtgtaagatcgtaaagagattttcccacctnaaaagctagcaatgagggtaaacacatgggtgtccttcagctgttcacagtccactaccatttccttaggtatacggatctcgcaggcaccccgggtccatcgggccttcacatactgtgtcccttggaccagagatattgaactagccagtctctgataccaattgaaggatcgtaaaaggtttttctcatcctaaaaactagccaatgagatgagaggtccccccacttatatattagagcaattttatgtaggatcgaatcacaataactaagccaaccagaggggggtgaatggttggtatacccaaaaaccgaaaacttttagcggaaataaaagttactctcgaattcgacggaagtcggtctgaccgagattgatatgccggtctgaccgctcggatgccgccggtctgaccgctcggatgccgccagtctgaccggtatagatcaaccggtctgaccgccgaagtcgcctgccgcacttgctacctccgccagtctgaccgccttgctcccgccggtctgaccgccgtcttgccgtcggtatatcgccggttggaccgccgaaactcagtgaaacacaaatcgaagaactcttaaagtgcatgacgactttattgattctatctgtgtttacaaagtgcaccaacagcactccttacaaaaatttcaactaaaggggtaccgaattc

SEQ ID NO: 89283 - DNA, 1030 bp, Oryza sativa
  unsure (1)..(1030): unsure at all n locations
gggcggtnnntnnnnattgaatactactccnnnnnnnnnnnnnnnnnnnnnnnnnnnnnnnnnnnnnnnnnnnnnnnnnnnnnnnnnataaaactaaggtctataaagaatatgacctgtttcttctttgcacgcttatctttttcattagcaccacccccacgcttccccttcatctcatttccaagaagccatgcctcttcctcctcctctcgaattaactcttcttgtctcttcaaagcaacagcttcttggtacgcaacttcaattccactgacaaataaagagcacagtaggactattaggtagctaacaatttgtctaaaaatctattctgttttaagttagaaaaatgtatatgcattagcttaatgcaaaattcgtacacgcagctttctaaaatttcggtagtttgtctgttagagaagtcttcgaattttagaggtcaaataatttcattcaaatgcccaaggctcaacataaaccacccacaaagcctagggatcgactattggtactggccaacactacatcggtaaccaaaagaaaatcagcctaaataattctttttacctgaatatatgagatagcacaaatgtttcaagtatcttccgaccaagctcagttaggcgtctttcctcgcgctccatggaaattttgttaacctcaccagaagcaccatcctatgacagtgagaatagtaagacagactgcaaatccagtagaaaaacctctactctgcaataaaccgatcaccaaacaactatgcacagatacaatacaagaaactcacaacaaaaaatattcccaatataatatatctaggagcataaagatttatactgagattattaaacagggaaaaaaatcatgcttcaatcatcaaagccccccctaccttcatgcgactatgggaacatttgtcatcctttggagacacaggttgacaaggcagtggttctaaggctggggtaccgaattcctcaagtggnnggtggcanntgctcgtacntttcatnttcagtgcaca

SEQ ID NO: 89284 - DNA, 706 bp, Oryza sativa
  unsure (1)..(706): unsure at all n locations
acgtgaacccattaagagccctgacaaaacaccnnnnnnnnnnnnnnnnnnnnnnnnnnnnnntctagacatccgatgcctagtacttgggtcaattgctgaccagaaagcacaaaaactgaaaatccaataaagatctcatttcaataggcagtaattaaagaaaaaatactttgctttttattgcagcatattatattggaatagctgctagtcaaacctggaccatctcattttgtcctcaatcagcttgctaagtttatttcttcgttcctcaacaaaacggcggtatattgactcgatgtttgtcgtataaacacggagcaattctcttcgataagggcgatcgaggcaacgaaatggtttgtccaccttctcccttacatattaaatacagcagtatgatgttacatgatagtttgtagtcaattcatatcaacaagaaacagaagtaggcaaactatctaatgtatacaagtgatcttgctggtctgtatgagctacaaaacgctaggaaattagagcaaaaaaatgagaaactggaatagattaaataaattcccaccatgggaacatcacagtagaatcaaaaggaatgcaattgaataaagaaacaatgctttgagataaattggcagactacctgtagaaaattcaaaaatattggttccgcgattaggacatgaagcaataaagacagacatgc

SEQ ID NO: 89285 - DNA, 1597 bp, Oryza sativa
  unsure (1)..(1597): unsure at all n locations
ttgtgaagtagcgtgaaaagagatggtaaatgaatctggattccttgttgatagagcaaatattaattcaaaatttgagtttgtagaggaaagtcaagatgacacttgaaggcagcatggaaagagaagaaataatggattaacacatattaagcatggtattaggcgtacatgtcaatacttttccggtggacattccgttttgcctattggaatgaaacattttgcactggacccatggaccataccagtgtagattgattgattttaattaaaaatgtaccggcaggcatacagctatcttttttgtacatattggagtatacacaacatttatctagccatgactgtgtttgcaaacatattttggtgcgagttaaaaatagagaaacaagtacgaagctatgataaaggagcattacaagaaatcatgattgtctgcatatcacaattctctatattgcaggttgcctcctagctgtgtagtagttgttcacaagattaatacaagaactgcggttctgtgcaattagtaatgttggtttgcagcatgcgattctcctgctattcaggttgaagcacaggtacctaaatgcctagaagcgcaaattccagccagaatttaaatgcgaacatgaacagcataacagatgaaataggattattgactgtattatgttttttttcgaagaaacagaatgttccgggaattctggatgaaacaagattgtatatttaagtattgccctcgttaattatgttccgggaatggaggtagcaacgtatggggtaagtattgccctcattaattatttcttaaattgtctgcttctccggtcaacgcacacttgagtacagagtagctggattaaaattgtgaaatggagggtgctaaccagaagcaacttcagttgacaattcacggatttccataaatgacctgactggacgctatgcattaaggctacaaaaccgtctcatttatgagagcacacgtgtatactgtcttctggactctgaagctactctgcaacgaggaccatttccagtttctgatcgagatcttttgtgaagtctgggctggcagctgtaaggtagatgaccctaacacttgcaactgaacaagacgcatcatgcatacaggtgctacgtcaactaactactcgagaatttgtgctattttctccaagtccgaaccaatcatgttaagctcaaatggcgttgcaacgacacggaccaaataatttagtcattattaacacgcgtaacgcgaagcaagtgcatttactcaccaggatcatcgtcatcaccgtcagtgtcccaaaagggcggggacgtcgaagggctctcgctctccacctgctcgcaggaccgccactcggacaacgactcgccagacaggctacgatcctcgtccctcatcccagccgtgctcgcagcagaatcatcagttgctgcagcacaagccatccaggaaatcttccactgcttcaagcaaccttatccgcagctgcannnnnnnnnnnnnnnnnnnnnnnnnnnnnnnnnnnnnnnnnnnnnnnnnnnnnggccagagaatactcatttncaaagacag

SEQ ID NO: 89286 - DNA, 1344 bp, Oryza sativa
  unsure (1)..(1344): unsure at all n locations
gcgcccttganatgagaacttgnnnnnnnnnnnnnnnnnnnnnnnnnnnnnnnnnnnnnnnnnnnnnnnnnnnnnnnnnnntcgggaagagaccaggtttccgccccgttcgtaccccaaacttggccgagatctaccccaagatcatctcaaccgagttggccccaaaccactcggacgagatccaatctactccaacacgacccgatgaagacaatagagcctatccgccaatcctgatgaaactcctcaacgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccggtacgactaccgcaacctcgacgacttcgacgaaggctatgaagataactacacgccccctctacttcggcattttcatgggcgacaacgagacggaaaaacagcgtcaagcccgagaagaagaagaaccacgcgtgcgacaggaagccaaacgtcgcgactggaggaggagcgcaagcacaagagcgagaacggttggagcgtgagcaacaagagcgcgagcgagctgcaaatgatgcttgggaggccgggcgacgagcacgagaactcatcgggcaacaagatgtcgaggggacggcggtttttcgcaccccccaacagaacgtggttgcagcgatcaccctcctcgacaccctcctcaaggaagacgcactcaatcaggccaatcacgtcgtcaacatcttgaaccagaccaagaccatgatcgcagcttcggtcccggttaactccgcgagtgtccgcacgccaactggcagccgagttccgcctcttcaatctcaagactatcaccaaccgagcctcagcgtcgtcggcgccggaaccagtcgtaggagcagggatcacgacgagcaatccgttcactcgcctcctgaccgacacagggagcgtcgagctgaatgtccccgctccccacatcgcaggcgtcccatcgatcttcgcgaaactatcaatcagcgccgtgcggcaagaggctacatcccccaccattcaccagatcgttacgacgacgacgtggatggagttgctgncttcacaagcgacctgcgtcgagtggatttggccagccgcttcaagccgactggaatcgagaagtatgacggcaccactaaccctgagacttggctcaccgtctacagtctcgcaattcgcgcagcg

SEQ ID NO: 89287 - DNA, 1070 bp, Oryza sativa
  unsure (1)..(1070): unsure at all n locations
caagcgtaagcccgaggnacttgtggcaaccantacaccatcctcccgacaatgttcgcgcgtcaacactttggacaagatcatgaactctcaatgtccgcatcatccaatttccaaccatgcggccaaagactgcttcgtttacaaacagttcgcagagcaatacgccaagaacgcacgcaagtcgacttacagagatcaaagcacatcaaagaagaaggatgatgaagatgatgccccgactggtttccaagacccccgcaaggagctcaaccatatctttggcggacccctggcttatgaatccaagccaaagcaaaagctgactgaacgggagatcaatgctgttcagcccgacacgccccaatatcttcggtggtcagaaacaactatcaagtttgaccgctcggatcaccctgaccgagtggtccacccagggcggtaccccctggtactagacccagtggtttgcaacatcaagctccgaagatccctgatcgatggtggcactgcactcaatatccttttcgccaagactctggacgacatgcaaatccctcgcacggaattgaagccaagtaatgcgcccttccacggagtcatccccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaatccgactggctgcgtccactgcaaccgaaggagaagtgtctgcaaccaagatgtcaaaaggcggagaaggcgacgccaagaccgagaagattcctctagatccctctgaccctactaagactgctgtaataggcgctaagttagattataaatggggta

SEQ ID NO: 89288 - DNA, 737 bp, Oryza sativa
gaaaccctgacaccacccagaggacctatggcgtgaatcaaggcagcttgctggaaatatttagcataacctaagagccggttttgcgagctccaaagcctcaaactttgagttaagtggttcatcaaaaggtaactctcatcctaatctgatttgtttcatgctgctattcatgtgcgattaaccagtggaaagcaatatagtgaaagctgccaagatatccaagctagaaaggcgaatccaggctctggagaaagacaaggtcgaactggcaaaacagagggactcggctctgaaagatgtcgaaggtacttgtagctgaaacttcaaaaaccactctcatcttcatgcccagtcattgatgtgaatttatttgtacagatcgcaaaatcaaatcccaggctcaattcgacatcttggttaacaaaatcaagaagcttgaaggagctagagatgaagtcgccaatgccgctacgccactcgtccaggccatgtttttcaataacaatggtccgagttcaattgatgctgtcgaaatcttcgacaagcttagaactgctccggatacatattttaagaacatcaaagaagctggaagtatgggggcaagtctagagttggcgatgaccaagtccttgtacccgaagattcaccttgatgttgttgacggcttcgcagacgggacaagtgaggaagccgcccttgacctcatcagtgatgcgcaaaaagctggggta

SEQ ID NO: 89289 - DNA, 727 bp, Oryza sativa
  unsure (1)..(727): unsure at all n locations
gactaggactattaccataacattgctactgggagtgttatagcttatgttacattttagatattttgtacatagacccaaccaccattccaccaccactgtgctcacaaaaagcatttctgacaatactattttcatgtcttggactttcagattgctaagatcgttgaagttgcaccaatcagagtatatgaagttgctacattttacacaatgtttaaccggactaaggtatctttgcatgacttagtattttgtacttgttaatccctccactagcatcttttcaccctattttgccatgtaggtgggtaaatatcaccttttggtgtgtggaaccacaccttgcatgattcgtggttcacgtgaaattgaagaagccttgttagaacatcttggagttaaacggaatggtttgtattattcacataacttatcctatcaactaagaataacacttcctgatttgttaccacaaacggtcttcgagcatgtgtttctcttgctatctctgtgatagcattaacatttttctttcatttgcagaggtgaccagtgatggtttattttctgttggagaaatggagtgcatggtcccttcgagatctataattttctgtcattttggatgcttgcaaataggtgttctagttgagttaagtgtttaactatggggggaaaattctcgatatanagaggtgtntgtacagctcttacggntcaactt

SEQ ID NO: 89290 - DNA, 1001 bp, Oryza sativa
  unsure (1)..(1001): unsure at all n locations
aattcggtaccccgaaattactagagaaagacattctggcaagttatatcttagtcagaaaggttatattgaaaaagttcttcgtcggttcaatatgcatgatgcaaaaccagtgagtactcctttagctgcacatttcagattatcttcagatttatgtccacagtcagattatgatattgagtacatgtctagagttccttatttaagtgtagttggttcacttatgtatgctatggtatgttctcgtcttgacttatcacatgcattgagtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattgatgtgagatatcactttattcgaggtgtgattgctgaaggtgatgtcaaagtatgcaagataagtactcatgataacccagctgatatgatgacaaagccagttcctactactaagtttgagctttgctcaagcttggtgggtgttacagtatagtcctagagactatttggcgcgcggtgattttacctacatgaggtatttttggtgnnnnnnnnnnnnnnnnnnnnnnnnnnnnnnnnnnnnnnnnnnnnnnnnnnnnnnnnnnaaagtgtcttcaaatcaaaannnnnctcgccca

SEQ ID NO: 89291 - DNA, 749 bp, Oryza sativa
  unsure (1)..(749): unsure at all n locations
cgaggaattcggcaccccgtgactgcaaattgcaaaaggtatagaaatcaactaggaatgcgaaggaaggtaaaaaagaagaatcaaagcattcagtagaaacaagaacacaatgttatgagttagcaaccgaggtatacctgaagtcctaacattttcccaattactcctaacgcttcttgtgtgtccttgttctctttgcaaaggtgaaacctggtcagcacaccagaatgacaactccggttataacgctaattaacagcaaaattagacgaagcaaaaacataatatttcttatacaaatttatacacatagattagatgttttttattaagtttagccaagtaaaatacacagcaagtcagatgaacacattcgagtacaaaggccagctaaagataccaggccaatagaaactatcaattcaagctgaattccaccaccttaggaacttcccaacatgatttggccagctagttgatcctctgctatcaaatggcctgtcatctctccaatcagaaccacccatgttcttcctcttccttcccctcccaccaccacttnttccaccggcaccccgnccttccctagctcctgatcccagccgcaccctaatgcatctctgaaactcatcattgtgttcgaacgcgtcgggggaccaaaaaantgaaggtcttctttagaaaatatggcccttcttcagcccaaaaaaaccccccaaatacaccattttcaccaattttacccc

SEQ ID NO: 89292 - DNA, 517 bp, Oryza sativa
tgagagcgaggaggggtgagagggtgaggtgcggctactcctccagggacggcaaggaggcgacgcccgccgccgccgtgaaaggcgcgacgtcgatgctcgcggcggcggtgacggcgtcgtcgtcgtcggcgccggcggcgatggcgctggtggacgagcggatgtcgacggaggggaccgggctgagcctggggctgagcaacaacctgctggggtggatcctcctcggcgtgttcggcctcatctggtcgctctacaccgtctacacctccacgctcgacgacgacgacgagtccggcggcctctccctctgaggccttgttcggttaatccgagaaagagattggagaggggattgagagaataattctacactataataggagtaaaataaatcctctctaaatcctccgctcgcgcgttactcgacacgaggcggcagttaattattttgcattcttagttggtgtagagaccaattgaagttaccacttcgatgagtccgtctactgat

SEQ ID NO: 89293 - DNA, 1174 bp, Oryza sativa
  unsure (1)..(1174): unsure at all n locations
tgtggtgcntcnnctttgatactgatacgctnnnnnnnnnnnnnnnnnnnnnnnnnnnnnnnnnnnnnnnnnnnnnnnnnnnnnnnctccggccatggccgccgacgctcgtccagtctaagcgggtggtgacgacgtgccacaccaggatctggtcggtgagcttggggaacgcgcacgcccactccagctgcggcgtcaggccgtgcctccgcagcgtggagacgccattggtgaagtggccgtagctcgccttgagcgacacgagcaccggtcgtcggacctcctgcggcaggcgctttctccggccgcgcttatgcccctggcgccgcggctccaccaagtagagcgtagccacgacaggatgttccatggccggtggccgaaccgcttgaggagcacgtactggccgaccttgtcgtaccagtacctcgtcgtcggcggcgtgatgctctctttccacaaaaggtggccgggccgcttgtccgtccacggttggtcgtcgcgcacgcaggggtacaccgtcttgacgtacttccagttgctggagaagccggccaccgcctggcagagctcgaggccggcggtgatcacgacgatcagcaccgtgacggagcggtcgaggccgcgcacgccgatgcggaggcggtggtagcccgggccgagcgtgccgaagaacgccgtccacatggtgatcccggccacggcggcggcgatgcagacgtaggtcctggcgccgacgagcacgacgttgcgggtgtagaactcgtcgtagaggaacgcgagctccgcctcgacgacgcggaacgcggcgtcgggccccgtgacggccggccggatgaggccgccgcagacgaggtcccgcgccctcggcgagccggccttcgccgggacgaagccgtagaaccgccgcttcagcagcttgaacagcgcgaacgcgaggcagaagtccctcgccatgtccttctccacgccgctgtacccgggctcgtcgtcgatccaccggtacacgcggtcgatggtgaccaccgacttgccgtcgctctgcctcaccatgtcgtcgcgggtcgcccgcaccatggtgtcctcgccgtggaaatgtacctgtagcccttcatcgtcgtcgggttcggcggctcgccgttgccgacaccgcgagcgacttcttgcgttc

SEQ ID NO: 89294 - DNA, 933 bp, Oryza sativa
  unsure (1)..(933): unsure at all n locations
attgttgcttcggcgtgcacggttggcttattatccggcctttgttgggggtttaggtcttcaccgaccggcttgccttcgccgccgccgattggtggttccgcctgcacggctggcctttatgccgccgttgttgggcgtatacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggctgccttgtccgccgccgactggtgctttcgcctgcacggctggcctttatgccgccgttgttgggcgtctacgtcttcaccgactggcttgccttcgccgctgccgactggtgtttccgcctgcacggctggcctttatgccgccattgttgggcgtctacgtcttcaccgaccggcttgccttcgccgccgccgactggtgtttccgcctgcacggctggcctttatgccgncgttgtt

SEQ ID NO: 89295 - DNA, 1064 bp, Oryza sativa
aacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcag

SEQ ID NO: 89296 - DNA, 5465 bp, Oryza sativa
agccgacctcgtcgtcgtcgtcgtagtcgctctcgtcttcaaaaatacgaccatcctccccctgaacctgtgacagtgtccctgcaatttcaggtctagtgccaggactagcctcatcaaaagaaacttcgcaagtctcaataattttgttagtccctaaaataagtacacgatagccacgagtgtgtgcggggtaaccaagaaacaatccatcggtagagcgtgcctcaaacttatccaaatttccagatttcaagacaaagcacttgcaaccaaaaacacgcaaatgtgaaactttgggttgatgtccaaatcgaagttcataagaagtttttccaagtttagatcgcaagaaaactcgatttgaaatatagcaagcagtgttaatagcctcagcccaaaattttctaggagttttgtattcatccaacatcgttctagccatctcaaccaaaacacgattttttctttcaacaacaccgttttgttgaggaacacgaggagaagaaaattcatgttcaagacctctttcgttgcaaaattgttcaaatgaagcattattaaactcaccaccattatcacttcgaattcttttcaaagaaccaggaaattcaagctccaatcgtagaaacaaaccacgaaaatgttgaaaagcttcgtccttagttgccataaagaaaacccaagaatatcgagaaaaattgtcaacaataaccaacacataccactttcctccaatagattgcactctagctggaccaacagtgtccatatgtaatagctgtcccggtgcatccgtcatcacagaaacaataggagcatgtgaagtagaaaccatcttagcatgacgacactgtgtacagaccaaatcatgatctttcttaagtttaggcaaaccacgaataagatccaaaccacttaacctagtgagatgatcaaaaccaacatgtccaagtctacgatgccaaaacatcacatctttatcaaatttagcaaccaaacatattatcacaggtgaaacagcaaaaagtcatgacaacccactcaaataagccgattgcaccaggacattgaaaggctgttttatgtatatcttcctcagccataaagatctgattataacctgcattcccatccataaaactcaaaatcttgttttctgatgcggcatcaaccagttgatcggctactggcattggatattcgtcctttggtgttgctttatttaaattacgaaaatcaatacacaccctgaccttgccattcttcttaataactggaactatgctagatacccactctgcatatcggcatggacgaataaatccagcgtcatataatctcttaatctcagccttaacaggttcgagcatatcggctttacatctcctcggaggttgctgatgtggcctaaatcctggtttaaaaggtaaccgatgttcaacgatcgatcggctgagtccgggcatctcatagtattcccaagcaaagcaatctctaaactcttttaagagctctattaacttggttctgaattccgaagacaaacctttgctaataaatgtcggcctcggccgatcacccagacctatatcaatttcttccaaatcatcggccgacataaaaccttggccctgcttatcgtcgagatcatctactgtatccttagcacaggcctctgaaccctccacaacgccctcaaagtaatagcttgggttctccatcttcaatcggctgtatatcagaatcggatacttttagaaaatctccatcccaaacttttccagataaacaatcaaggccatccatctcccaaagagctaaatcagcattggcaacattaactgacctgtcggctggcacaacctctatcttgtcaccttgccactgaatcaagcactgatgcatagttgaagggatacaacaattggcatgaatccaatctctcccaagcaataaactatatgaacccttcccatcaatgacaaaaaacgtggtaggaatagtcttgttgccgaccgtcaactccacatttaaaacacctttggtctctgatggattactgccaaaatctttgagcaccatatttgtcttgatgagatcctcggcgttcctacccagcttcctgaatgtagcataaggcatcaaattcaccgcagccccaccatcaaccatcattttagacatcggcttcccattgatgtagccatttacatacaatggcttaagatgccgattctccgttccctcaggcttctcaaataccgcctgctctgatgatagggctagcttagctgattcttctcccacttcatcgacatcggcctagctgatcccgaactcggctggcagcgtaaagaccatattgattagtgctgtaacaacgctctttccttttgccaacctctttgcttcatcagctgtagcatcatcagctgcaggagcttggctcttaacacgccacacctgctttggttttggtttcctcagccgatggttgatttcctcttcaacctcctggaaacgttccctgctcctcaatctctagaccctccttttctgattcttcgtaaaaataccagaaggacaccattgattcttcctagtcgactcatcttcttgattatgatcttgactcatcggacccaacctttgatggacgggaagtcttgtctgtctaggccgatcacccctactatgtggtcggcttgagctttcaatgatgtcgctacacccaggacaatttttgatggatggcaacctcattctttcgttccagcagaatctgaagaactcgcaatcccaatgaggatcaaaaccattgtcgttctcttcataacgtctcccctgctgcttatcatacctcctttgatatttattaataatcttagccgaatgtacttggaaacccttcgcacgagatccatcggctgcttgacttgctgtatgcaccatattgacaggaaaaggattcccatcgaccttcatcggcttcttggaatcgtcaaacttaatttttcctccttcgatggccacctggatttgctgtctaaagaccttgcaatcgttggtagaatgagatccagaattatgccacttgcaatatctcttcttgcctaattcctcagccgatgggatcgtatgaccagcaggaagctgaatctgcttttctcggagtagcaaatcgaagatcttgtcggctttagtgatatcaaaatcatattttttctcctttccaggactcttcacccattgacacggtataacctttttgctcctcacccattcggctgcagctatctcagaatcatcatcttcatcgtccgattcatacatatactggcagacatgattaaccttcttagagctccttctgacatcagccgacctatgctcatgcaaggttaccttttgtatcagatgtgataagctatcgaagtcttcggatgagaatttttccctgatcggagggatcataccctggaaggccaaatcggctaactgggcatcggtcaagcttaagctgaaacacttgttcctcatctctctaaacctctgaatatattcatgcacgggttcatcataccgctgtttgattgctgttaagtcggacaacttcatctcgtgaaccccgctgtagaaataactatggaactgcttctccaaatcggcccaactattgaccgatccatacggcaaagatgagaaccaagtaaaagctgacccggacaaagacaatcggaacatcctaaccctcaaggcatctacagccgatgcttctccatactgggcaagatatcggctaatgtgctcataggttgacacgccctcttgtcctgaaaatttagagaaatccggaattttaaaccgattaggaagaggaaccctttcaaaccactctggataaggctgccgatacaagcttccagtctctttaagtttgagcccgaattgtttcctcattacatcggcaatcacatcggcccattgtcgctgctgagctgccccttgtggttgctgctgcatggattcaaactgaccaaactggggagcgaactgctgctgagccgatcctcctggctgatattgggcttgtatagctgaaggctggtatcgataacttaagttacccccttggtagtcgtgcagatccgactgaatattgcgtgccaagtgctcggggaccatctgaggtatcacagtgccatctggttgtatatggtgaactaaatgttctggagtagcttggttcccaaatggctgcacaagttgcccccaaggtgctgcgaacccagccgatgcattagccgaccccaggtgctgaattggctgatgccgtaccggagtctgctgaatcagctgaagccgttgcctcggcggtgtttgttgattcgactgaaaatgctgttgcggcaatgacgcttgctgaaccggctgcgcgacctgttgttgaactggttgtaccatcggttgaactggtggcgcaacttgttgctgaaccggctgcactgtcggctggactggcggtgcctgctgaatcggctgctgttgtactgaattaacaacgggtggtggcaggaacatagcagcaacctggtcttgagttggctgattcgtgatctgttcagcaggctgtgggtactccctcattagtaatctgggattcatcagctgagccgccgcagtagccgatgcagcaggtacagatgttgatgccgacgctgttggttgggctatcggcgcgacagatggagccgcctgcacaactggctgagcatcggtgatcaaggtccggtaatttggaaaaactcctcctggcaagtaaaccgggctgtagcttgatgctcagctatcgagccatcggctattgccttcaccatgttcgataacatattggctaacaccccagactggttaattaaagcatggtgcaccgcgtaatcaatccgatcttgaaagttgttaaaagaatcctgaagaccttgactgaaatttcctcctggtagttcttggtaaacacgatttggagttccatgcacctctggaagattatcaccttgatttcctgcagaaccttcggtagcccctttgacactcggctgagccgagccatctgggtctcgcttaacatccccatctttagatgaaccgatcccagggatgtcggcaactagcttcaacttgtacttctgaacgagtgaccccttgcgggtctgcatgtaggagctctgatactgatcccgtgcttgttgcatcattgcttcgaagtcctgcttctgctctggtgtgaacttctcggggtcaaccggcaggacattgtcatcaataatgtcggtcagccctggctttggcggtttgcctttgccggagcctgggcttggcggtgctgttttttcggccatgaggaagatataacgtctgactcctaatcaggtcccaccaggcgtgccaaaagcgtgttgaca

SEQ ID NO: 89297 - DNA, 625 bp, Oryza sativa
  unsure (1)..(625): unsure at all n locations
ccccccgncgttaagacactttgatatacaatcaatagcagccatagcatccccgggggaacctttcgggattccaacctatccgttttcaaacccttttgaataaacattatttaagaaaggcaagggtattgtttttgggagaacggaataaggcttatatacaaagggatagaacaataggttcaggttgttcctttcaatatctccctgtgtactgttgttggaaacaggattgaaaattctagactaccaataggcctactttgcagcaacagtcatcattgtactgaatgctttgaaaaaaagaacaccttaccatgcagatcaaatagagttgtccatatactcacatacggtttgtatgaatgtgcggttgtgccctgtttggactcctcatctgaaggtttttgttcttctcaagagataaaagttcttccataggcagcaaaccatagacgccgagaacagtgttattcttaacaacaaaactaaaacaagaaaatacaaaaatacacgactaatctcttctgttccacatatagaagaaccagaaaaacaaaactatttaagcattttaattattgaaagaatactatttaagtggatagcttcaggactataa

SEQ ID NO: 89298 - DNA, 633 bp, Oryza sativa
  unsure (1)..(633): unsure at all n locations
tgtggtgctgaagttgcaggtgtactactccaaccatcaagagtacttaaattaagtcttggtgtttatgattaaataaatatatatatcgataaacagtttatttttacctttcattgaagccaaaaattcatcaccctgtatatggaatttggtaagactttttccagagagtttttcccacatcgcgatcaactcgttctaagtgaggcagttatcttgtggtcttatgtatattgtcttgttcaaggtgcggggatcatcgattgatttgattgtatatgttcccacatcatcttcatacacaaaaaacactgcatataacattgcagcttaattggttagtatagttgaaattctaaactgagtgtaatattactaaagaatggttttcaatagccctaacttagttcttatggtttcatcaaataatgagtagtgaaaaggatggtgattaatgctttattatttttcacagaaaatcatgccaaaaaaatcttaataggacatgatattttcactagctagctacagatgaaaaacataattatttacaatannnnnnnnnnnnnnnnnnnnnnnnnnnnnnnnnnnnnnnnnnnnngcgatatcgaaatcaaggggggggggggg

SEQ ID NO: 89299 - DNA, 611 bp, Oryza sativa
  unsure (1)..(611): unsure at all n locations
cccgcccnnnatgatanactctttnnnnnnnnnnnnnnnnnnnnnnnnnnnnnnnnnnnnnnnnnnnnnnnnnnnnnnnnnnattacagtgtgaatcaaattaggaggttgaagctaagtggttttgttcaagttaaagtttttctataaaataatctaccaaaaagatatatatttgatttgcagatatgcattgaaaattacacatttgcttggcagttatactgttagtccttatgaattgtttagttatttaagatgaaagggaaaatcattttatatcacaaatttggattacagacctgttttctgttgtttgatccctccaggaaaaccagctgccattcaatatggcactggttcagttgatgggtttttcaacgaggatagtgttacagtaggtgatctggttgtgaaagatcaggtatgcactatatatctcagtcactgactatctctgatcatatactccaaaatattttagcactgttgcttcaccgctttaggaattgcttcaccgctttaggaattcattgaagttataaaggagccaagccatatactttcatggttgcaaaattcgatgacattcttggtctcggatttcagaa

SEQ ID NO: 89300 - DNA, 16142 bp, Oryza sativa
  unsure (1)..(16142): unsure at all n locations
agcggntttgttgtgatacaacnnnnnnnnnnnnnnnnnnnnnnnnnnnnnnnnnnnnnnnnnnnnnnnnnnnnnnnnnnnnnntgagaacgagcgaacgaacgtgaacgataacgtgaacgagcgaacgaacgtgaacgtgaaatgcaattataggcagatgaatgaacgtgaacgaacaaacgtaggtgaatgaaacgtgaccttaacgagaacgcgaacgtgaacgatatcgtgaacgaaacgtgaacgtcaaatgcaatatatgttacttcgcgtttatcctaatacatctttttgtatcttgcagaaaagacgttgtcagagtcatctctcaagccggagtggtagagctagccctcgaaggaattcgcgcaggcaagtgacgtaattatatatatgattgttatatttgtaatgcaattaagattattagatttgtaattagacttagcatataagattgtgtagtgttctaatatacgacagttacacttagcatacatgactatttgagttttagtataagattatttaagttttaatacaagattattatatttgtaattagacttagtatataattattgactagctagggtcctataatatatgtcacctagacttagcatatatcactatttgagttttagtataagattattagatttgtaattagacttagcatgtaagattgtgtagggttctaatatacgacagttacacttagcatacatgactattttagtcttagcatataaaattatttgagttttgatataagattattatatttgtaattagacttagtatataattattgactagctagggtcctataatatacgtcatctagacttagcatatatcactatttgagttttagtataagattattagatttgtaattagacttagcatgtaagattgtgtagggttctaatatacgacagttacacttagcatacatgactattttagtcttagcatataagattatttgagttttaatataagattgttaaaacataaatgtctcatgacttagcagatgtttcctgtatgaacagatggctaatcgcgatgaggaacaaatattgtacgatacaatcgcggagggaagtagccagtactggaacgaagaagaggggaacgaggatccaaaccagtatttgaacgaggaagggaacgtggagagggatgcagaggggaaccaggaggggcacgtggaaagggatgtggaggggaaccaggaggagaaggctagtggaagtcaaccctccgttggacagaagagggcacgcgggtaacgaggtaccacgaagaagcttgagggtcggcacatcataacggaagtggaagaagatggacgacctagtgccccggcagaagccgccaagaactatgtatgtcacagtggttgggttgtgcgggataacgtgcctgtcagtacggtgtactggcaaagaacaagggcacgcagagatcatgagagctttgtcccagattcgaagaaagagatgctgtggaccacaatgctcgagacattcacccttcccgcgggtagagaggacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgataatggaaagaaacaaagaaaatgccgccaagaagaagtaccatcaccacttggggtcaggcggctatagcgttgcgatgccgaagtgggaggagatggaggcaagcttgcttgagaggggtatcgaaccggccaccgctaattagccggaacgatcgaagttctggtactatgctcacggtggaacgctcaacccagctgatggcccactggtcttcggcgatcagatacaagaggctgcgcgttgactagcagacgcagtggaagcctcttcttagggcacgttccgaccggacagagagagggacgagctgtcactcgccctgcagactccagagcatccaggacgaacacgagcgaaaggggtgattccttggaagattaggttcaaggaggacatccacacgtacaggagtcggatgaggagcaagagagataccaaggtgaagattgcagatctagagttcagggtatcgagctacgagcgcagcatgcaagaggaggtggcaaggaaggttgatgaacgcatggccgcacatcggtcccatgatccccagccgaccattcctcctgcaatggtgagcccgtcaggaaaccgtagcagctgcgcctcaatggggcaggtaggatcacagagtatggacgccatacaaacccaggacgaatccacttgccccgttgatgacatcattcagtggacaccatgtgagctgcatattcctttcaagaacttatcaataaaggtaagctcgtagtttatatattttagatttggccattccgctagttgctgcttatatatgttgattactaataaataacctctcaccacatgaaggtggcgtcgggcatggccatcccaatggacctttcaggtacttaccactgcaggccgattccagcaggatactccaaggtcgaagttgagttggtcgaaggcgcgtacgaggacctcgcgctggattaccctggaggagacggtgagacgcatctacgagacacaagccatgccattattctatggcgcaggcggtacatcatcctccctgggcgacaagcggcgtctcatgcaccatctcctccggctctgccatctcctcctcaggcttcagcaccgtctccacctcaggctcctacaccgactcctcctcaggctcctgcaccgtctccaccttaggctcctgcaccgactcctcctcatgctccagcaccgtctccaccttaggctcctgcaccgactcctccgcaagctcctcttccggcaccttcaaagtcaagggccccccaagctccaccgcttgcccacacaagggcaacgaagaaggcgaaagttgacgccgccaagaacaaagacctaattaattaaaggatgacattctctggatcaatttcaagggaatctacgaactataccagctggatgccctcgacgtctctattatgagttgctggattttgtaagtatatcgttcagttagatttcttactacgtctcctttaattaattaggtccttgtatataagtagactatagaaaataatatactcccttttatcattgtagaatggagattcaaagggcccgacggcggggggttttcgatactggattcatcgaccctcggaaagtaaacgtcgcaatgctcgaccaatatccgcaagccacagaggacaatctcgtccatctcctaaaggcgcagcattacaagacgttcatactgttgccgtacaacacagagttagtttaattttactgtcttcctataccaaatttcattcccgtatgaacttgctaagtgtttcatatgtaatgcatcccacgcacattgtagattccactgggtgcttttactcttcgacctgtcggcctgcaccgtcaatgtatatgactcaatggataaaaaagagtctacgtttgacaaggttttcgaacttatagacaggtactgtcataagttcctctgttaattaagaaaatcttgttatgttaattgctactacgaatcatagctttaaactccatgtagggcttggtatcggttccgtcatttggtccgcggcaactggagagaaagacttaggcggaagttcaaattttctgtgagtacacatgctctacatttatatttctccgattcaaatacatacaagtgtatattaattagatctctcgtcgtttgtcatttatttgtagtgcgcaaagcaaaagcagttcaaagcacttaggtattaacattaaccactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgaattattataactaggtatatactcacaatttgaaaattttgaaaaatttgagtgattttgtgcatttgataccatggtgccgggcaccatggtgccctatatgagtgtctatatatatatatatatatatatatatatatatatatatatatagacacacacacacatacatacatatgcatttgcaaaacatatatatgtataaatacatatatattatgcatgtacatatgtattgaaacatatataaatataatatatatatatatatatatatatatatatatatatatatatatgcatatattatatatgcatatatatgtattgaaacatatatatgcatggtttatatatatatatatatatatatatataaaccatacagtaatagggccatacaaaaaaaaaggttagctcgatctttagtcccggttgatgttatcaaccgggactaaagatcgatctttagtcccgattatttcacccgggactaaagatagcgatctttagtttcggattggtagtcccagtttagaaaccaggactaaagagaagttacgaaccgggactacaaagggtttctccaccagtgaatatcgcgtccttgtcactgggcataggagcgctgcctatgatcagcacgggtaagtacaaatttatactcgcattaaaacattgacatgtgctcatacatgcataaatataaattgttctgcctatgtatatatcataggagtatatgatacaccaggtacaggggatatacattatttttcctttttaaatttcccactaacagtaacagattgtcttttattttcctttgtaacaaatatgcatgtcttggacacttgtttttggggcggggtcatgctcattttatctgcaggtttgtccatgggaagtcaggaaagtatcatagcttgtgatctgtgcggctgcatcctgggacaggttttgaagtttgctcttggacccattgcgatgaccattgcatccaaaattgttggccttcacggcaacaaactccgggctgccatcatacaggtatctaattacaatgttatttgtagtcagacgtttagagaccaaacgcaactttctcacgacacatttccatattaccttccaactacgctctttaatctttttcttttcttgcttcgatgatggaaatccaacccttcttaattacctgcttgaatattcagaaagcgagcgcggttgataatggttgaaagtagcttttctttaccatggcaagacgattgataattgttaatctttttttccctgagattgataacttttaatcttgatcacttcctagcttagatttactcaaatagttaagttcacaatggtcagatttttaaaagaacataatggccagttttttctgtgttcaaacataatggtcagagactcagagttaatcttagctttacccaaattggaacgtttcggactctcctatgttagctcgccattgtaatcctgttctacgcaaggaaaactgatgatctcttgatctgtgcaaacattttgcaggctgctgtaccacaagccatttcatcattcatatttgcaaaagaatacgggctgcatcctgagattattatcaccgcgtaagatcttccaactgatttactaattaagtgagaaagtatatactccctctgtttctaaatatttgacgccgttgacttttttaaatatgtttgatcattcgtcttatttaaaaaaattaagcaattattaattttttttcatatcatttgattcatggttaaatatactttcacgtatacatatagttttacatattgcataattctttttaataagacgaatggtcaaacatatgctaaaaagacaacggtatcaaacatttagaaacggagagagtcctcgtttcgacgttaccatcctaactgcttaattaattcaatctgcagggtgattatcgggatgcttctcgctgtgctgttcctacctctatactacgtaatcttacggcttactacataaggcaaaatctcctgcctttccttaaaaaaattcttatggcttactctatctagacattcagatgacagcagggagtatagatacagaaggaaaagagagataccatgtagtgggtgaaatgcgtagacagtgtatacgtactgtatgattgtaatttgtaagaaaaatagagctacttcctccgtccctaaaaaacgaatctaatacatgtgacatattctagtacaatgaatttggacggatgtatgtacagattcgtaatattaggatatgtcacattcagtactaggttgattttttataggatagagggagtacgtgtgaaatgtgtggacagcgaataagtacggaatgattgttgtaacggtttgctttaagcgaatatacagatttgaatgattttttcctcaattttgatgcaagccatttgcgagcgcgcgcacacacagatagcgttggctctgtgatgaattctcgaataatactccctagctcagttttatgatataagtcaaactgttttaagtttgtctaagtttatagtcaaatatagtaatatttataatactaaattagtttcatcaaatcaataattaaatatatttttataataaatttgtcttgggttgaaaatgttactattttttttagaaacttagttaaatttaaaatagtaaaagtcaaaaagtcaaaacgttttataacctaaaacggagggaataatacattttgtgttgtccatgcaatcgattagtgttaagtaccagcagtacctgatcaacaattaagcttcagcttgagcggttttcagctctgaacaactgttcgtcgtgttctgttccatcttttctctatgtctcttgcagggtttacattaccgtcggtaatcacgcggttaccagttttatcgtggggtacggtaaaaaaaccacggtaaccaccttaaatttaaataaatttagaaaataatttaaattttaaattagaaaataatttaaattttaccgtggttaccgtgcctaccgtcggggaaaccctggtctccggtgatgaaggaaaagggactcgatctgcaatttttcagccccatctgtcactatctgaaaactgaagcagcactgaactgcatcagagaaggctgggcctaaagtgggctctggcccgcatgaaggcctgctatgaatcttgctgttggtggaatggactcaattagttagcgatccaagagagcgtcctccttgtaattaagccatttgggccattactatcagtttcaaacccaatacacacttgggctcagaaacgaggtaaggctacatttagaacaggaataattctgacctaaaatttcagctgcatcgcacacaagtcaggaagaaagattcattcttgcacattctgattctggagttggcacctttaatttctaagttttgttgcacatgaaactctttcattattccttcaaaaaaaaactctatcagtattttctctcaattgagtgccaggttgtatgaaaaccaattcatctcctttattttattcagaagaaagggaagaaaacgttctttcagaaaaaaaaaggggaagaaactaacgaagtcagaagcagactaattaattaatttaattccacactgcaatcagtgggaagtactgaagaaagctatagcttgctacaaaataattaagtggtactattttttgcctggtggatacaacattaagcaacacttgacaaatgattaactaaagtttcaagaattaatcaagactggctgcacgtgactaatttatacagctccaatttaaggttgttagttagggcacgattaatgtcgtaatgaaggcatacttaatgtagtctctccctgcaaaaaaaataggtactaattttaatattctaattacatgcagggacttgctgcaaaaataggataacagcataggttatattgattcctgtttttcaacgaaatggtatacccttttttagccaaaaaaaacctatagagttaataatggaaatcccctagaaattaattatgatcactagctagctggtatctctgctagctagctaagccactctctaagcttaattaattagttggttcagtaccagtactatgccccgatgcaaaatagttaaggcatcgcttggactgcaaggatttttcacaggaaatttgaacaaaatctcatagcaaatatgaacatttctcgagatcaagacatgcctagctggctaattatttattgatttatgggatgtcttcactatttcctatagtaaaaggaagcatgaccaaactttaagctctacaagaaaaccatgatttctcaggtcgaggttccatctagaaagtgactttttgaaaacaaagatgcattatgcatggtccatagtcttttcgcgaatgaaacaaacaagaaagaaaagcaaataatcaaagaaagaaagccctggctactggaaaagtactagctggttaattacagatgagatctaaattaaagcatcagcccctgcccatatagatcatgaaaaatgaagtgggacacacatatgctaccctttttttacaaatcatattatgagatcagtgttggttttcaacaggtaattatttatattgatttatataaaagagataatctatcatattcagaccacaacagcactaattttcatattgctaatgattgaatttgacatctcgatattataatcttgctagcattgtgcaatgttaggttgatcatgtgtgtggctggtttcatatatatgcattaaactcatcctagctagaaaagcttttaaaaggatttctcatccagaatatatatatataggtttttagcaggtcaatgtatgggcaaatgaaatacttatgataaaacttttaggtgttgaaagaatacatgagactaatataagtgcaaaggtcaatgtgcaaatgagaattacaatccatgcaaaagaggattcttcttccacacagaaaacaatatgcatcattggttctgtaaaggtcacgacaactagccgattggatgaattaatgggactaataagctttagtttcaccagctctctcatcaaagagagaaagctaaaaaggtgcttagacttgcagggcgaaggctcccatttgagcatatctttttgcaaaaagcacgcaagaaatgaagcaaaggtgttgaagaacatggaaactgggtaccaaattgagcatgagttagttaggccttttcttgcacaatttcttgaattagcacacaaaggtggagtgaagatcaattagtactaattaattagtataattgtgcaatgatatttaattaccatgaatttaattataagagagatgatattataatgtatcccttttcatcttatttgtgtctaacaatgcaaaaggcatcaacatgcattccaaaccactggcttctgctccatcatgagtgcttcacttggcagttcctattccttgtgctaatgatgtgaacagtacatatacttctattatagagttgtattgggatcttgctttgtgctaacaaccaaaggtggtgatggccaaatcctagggggcaagatttcatacttcaactgtccaacacttgcttgaaggattgcaaagctatcgggcccttctatatatcaacaagccatgtctccatttccttttttgacacttaaaaagggattaattatttgtggtagaaaaatgctagatattgttgaagacagttgtatctaaagcagggatatttagatatacctaatgtggtatttaataagtcatttttggcatgtcaaaaaatctatgcaaactttgaagtatcattcacaagctatagcaagtttggcatatattagttttaccaaaatatgtgaatttcaaggccagtgagtgattctattcatatgtctacatatagtatatatgttcaggaactcaaactcgggatttgaagtgtcataaattatttattttattcaatttccacatattcttttagcttggatatactaagttcaaaacataaaacttgttctattcaatacaaatatatatgactgcaaacctagctagctagaagttaatccaatactgaaaatgcagatgtgaatccatcaatgcagcacacgattaaaattttcatatatatatgcgtgcgtggttagggatgttgcatgcatgattgcaactgctacgctgaacttgaaagcttaaatgagaaagcattgtccttagattgttggcccaggttggaaaacactccttttgttttcttccgtcttaccatgacctatatatggggacactcgatctctcggaaaaaatagctatcaatggcaagcagtctgttggtaaagagttttaccgacactcaacctgccacgagcatctgccaggggttcaacagtcaagaaaaatatttaccaacagacttcttatttattggcagatgggtgctgataattttatagttttttccgacagatattgtatttcggtagatggggatctccaccatgtcgtcctcccggtggctacaccctcgtccatgtccaccttgtagcagctccgttgcacctctacccactcgctcggctggcttgcttcgccgcctcctcgtgccaaaaccctagaggctacgccttgcctagcagtgtggtgagggagacaggtgttttttcttgtcacaggaaccttatcctatccaccccaatatctgacacgccctagtgatatagcaacagacagctcgtcggtccaagatctttaccgagtacctacagatagtccgtcactttcttttactgacagattgtttgacatagttatctttttaccgatagattgttttgccaggatatttaccggcagactgacttgtaccaatagtccatttttcccaacaaactattgccttctatttggtgttgcggtgtagtgtatatactgatcaccagatgatcaatgctatagtatgaatatatttaataattacagcaaatagaaattttaccgttcactaattcaattttagtgtgtcacatcactaggggaggggtaagaataaaagctctaaaaactcgcggctcagctcgaatcaagctcatagtcctaacgaggcaagtcaagctgcgcttttatctctttagtttagcgagctagctcacgagcatcatatcttctttttatacttgcttcttaaccaatacttagtcctttatttattttaaaactatttgtatttagtttttttattagttaatattttattattatattatgaatcggtaaatttaaaactatagagccagtaatattaatataaattagataaaatttattgacaaacctaacaatcttaatgaaccagtttgcaaaccgaggcaagctagcacgtttattaaggtatcgagcctaataagtcgagccttaatgaatcgagctggctcattacccacacttacacatcatagggtttgggtcaacaacatgagcatatgctgttaaaattaaaacttagagaataattatgtcagggttatggatacctaatagtagttgactaaatctcggcaggacccaccacataccatgttttatacggaaacaaccttcgggtatagaaggagttccggataaagaaagataaatagagttctacatggacaacatagacgccacaaagccacaagccaatacaagccaacatacgccaagtcaaactgccagatatcgacatcagagataagtctaggaaaaccccatatggtacctacgggaaccaaagagaggaatctagcgctgtctctgacctcgccggatgtggattcgaggaggaaggctaccctgttgttgactacgagtcagaacttcagaccaccatgtcgacaacagatagataagctaccccaaatattgtactggtgtgattatggtgaataagagcaacgaccggcttcggtcaacaggagtagggttattacctgacaattcaggggcccgaacctgtataaaaatccccgtctccatcttttttactacaatctcgtatataccctggtatcaacaatccccacactatacaaatatcggaatcgcgacatcaaacatcgacaaattatatatgttattgtgtcaaatgcaagaggacaagttgcacggtttattatacattcaaactccgatcaaattaattagtggtttgataaacaattttctacatgcagtttgcatagtgtcaaatagtcattcagacagggctcattagttatacatgtactccctccattccatataaaccacttttcttagatgttccataatactccataaggcatgcatgcatataggcaattaactatgaccccttctccattaaattattacttttttaatcctccactctcatgttctttaattctattggatgcatgcattgtatttattaggatgatccaaactacaagatgataataattatttcttagtctttgtgttaggggtggttatgccttatattttggaatggagggagtatttatctcgtgacagtttcgcatgaaacaaagaattaaattttaattaccagaactctcataatctttattttcaattggaacctatatatatttctctaatttcaagataaacccaatggagcctgctttattaaatttcttacaaattatttttatatttattaaatttcaggagaagctatcaaagctagctggaatatcctattaaattgtctcaatgtgctagatgacagcatgatattaggggtagagaaagagagagatgtgatggcaaagatagtacatggagtactcactttcctgcctccccttcctatctttctggaccctagcagctaattgcatctgctaacgacctgtaattgcaaccaacctacatatattttgaccagtgacagtgactgttcctcctacttcattcatgcatgcacatgatactcatcatctctctccaacaccacactgatcactagtcactcaggcaagtactagctgcatgcacctttcagacacttcaatatatttattcataagctcatcaatgtgacttcatgtgcaagggaagcagttggtgcatgaaaggaaagaggaagcaaagaaacaaaacaggggaaactttaccctgaagaaaatttttataaaaaggtgaagcattatctacagtgtttagccctaattctaaactaacttctaaacatgaacacccacataattaaggcatctaactatatatttaattatgatatcgctatatatgcaaggctgtcgatattctgatccgtatcctagtatcttatggtgctgcgatcctaccaaatcaaaatgataccgatctcatctagtatcttaattttttatagtatcttgatcttactatttatttccagacgattctatgaaatcttaggtagtatctcgattctacgatccatacaatcctacaaaatattatttaaaataaggtggattgaaaataatttgaataaatacgctcaagtttacataaaaccaattaaattgatcaaaatcaatattatatgctttaatttatacaacatactttatactttatattaaattatgtactttctaaaatctggtagtatttcgatcctgtgatactacaaataaaaaaaacgatcttacctagtatcttgatactgagtatatatacaactcaagttcttttagttatttgcatgactacataactctataattttgtgtacaaggatgaatttcaagatatttatatatatgcaagatcaaaagtggagttggtgtgagaaatcttgtacatttggaagagagaatatatgtgtcaatggaaaaaaatactaccttcaatgtgtatgtatgtatatatatgtataattgtatatatatgcaatgtactcctttggcagctatagatggggcccctccctctcaatcattcaacttggaaatcaaggaaaggcaaggatgacacatctttcatcagctcctccaagtcccactctcccatgacattcctgctcatgtgctgctgctgctgctgcagcatctgatgctgctgctgctgttgttggtggtgaccctcccaatagatcatgttgctgctgctgttcattaggctaatgcagcagctgctgctgatgttgttgttattatcactgttgttcttgttgctgttgctgttgtctgtgatgttgctgctcagtgtggccgcggtcgtgttgctgccggttttgttagggtggtcgtcgtcgtcgtcgagaatggtttggtggtctaggagaggtggcactgatgcgccgccaaagaggatgctgctgctgtgatggtgatgatctcctattaagcttgatccgtccatggtggcgatcgcgtggtggtggtggtgggcgccggttgatccgtagtatgcttgcttgatggagatggagtggtcgtggaagaacggcggtggcggcgaggtgtcgacgccgcagacctggtcggggagtgggaggaggccgccgtagctcctccccgccgccgccgccgccattatcgacggccggctctgcatcgacgaggaagacgacgacgacgacgacgaggaatccacccacatgctcttcatggcagcattagctgtcccgacaacgacgtcgtccgtggcgccgccgccgccggcgaggtcgacgacggcgccgagcttgtgctccggcggggaggcgcagtcggtggtggtggccggagacgccgaggaggaggagatcttgaggcgcttcttgatggtggagttccagaagttcttgatctcgttgtcggtgcgccccggtagccgggcagcgatctgagaccacctgcaataattccatgcgtcgtagtacggtagatttttcatcagtgagcaaacgagatgtttctgtcaagaattattatccaagcttagctatagctatggttgtagtacaaaagattaattaaataaaaaggttaattagctgcatgcacatatatgtcaatgcgccttaattaatcttctttttatgcatgcatgcatgcatgcataagcgcataagcatgattaatctagtatttacttccaaaaaaaaataaagataaaatatatatgattttctccgtttcaaattacttgttgttttacttaaaaaaattacttgtcgttataactttgcagtaagtcaaacatttctaaccttcatcatcaattctctagaaatttatacagttattaccataataagatttattttctaaattcattatatatgagaaatattttcataatatataattcacatgttaaactgtatacgaatttttgaaaatttatgatgaatatttgactttatacaaagctaaaatgaaaaggtttttttaggtaaaacgaaaagcatatatatatatatatatatatatatatatatatatatatatatatatatatatatatatatatatatataggttagttttacatgtgagaaagtacgtagaggtaattagtcgatgtcataatctcatttctggtaagacaaggattaatcaataattatggatgattggatccgacaaatttgcatatgtctttcagggttaattagaacgtatacaagtatgaagtatccctttcggtgtcttttcaggcaacttttagtttctacgttacatatatatcagttttgtaattatgcatggtgtacgacatttcatgcaaaattaagcagaagaaaaaaaagaattaatcaagaaatattttgattgatatatccaggactcatgttgttctcatagccctttgagacttgagacacatgtctgtatatatattaatattctaataatcaaatttttttaacttatgtcacatattataaatgtatat

SEQ ID NO: 89301 - DNA, 798 bp, Oryza sativa
  unsure (1)..(798): unsure at all n locations
tgcacggtnnnnnntttgaatacactacnnnnnnnnnnnnnnnnnnnnnnnnnnnnnnnnnnnnnnnnnnnnnnnnnnnnnnnnnagtataagattattagatttgtaattagacttagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgatgataggtatccagttttccgctcctaggtctgcatattggacttttcctcttact

SEQ ID NO: 89302 - DNA, 628 bp, Oryza sativa
  unsure (1)..(628): unsure at all n locations
aggcccncccaaatgatatctctttagctatgcactgagagatcccctcataatttccccaaagcgtaaccatgtgtgaataaattttgagctagcagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagt

SEQ ID NO: 89303 - DNA, 1023 bp, Oryza sativa
  unsure (1)..(1023): unsure at all n locations
tgtggtnntaagactgacgtcgtgccannnnnnnnnnnnnnnnnnnnnnnnnnnnnnnnnnnnnnctgaggctccagataaaatcatgacgctttgggatttcttctgtcatcaagacaggggagatgattccgctgnnnnnnnnnnnnnnnnnnnncatccaagttggctcagttggcggtggttctggcttgccttaacgaaaatggttgtgtgaacatttgcgcatatatgttgatcatatccctcttaatatttaccacacaagtgttttgattagttatagctatgtatttctaaaaagcaagaaagaagctatgcagcacatttaataatgatggtcgcaagatagctgttttacaaatgcaataaaatcctgaagcatacaaaatagtgagtggcatgacctctctctctaggcctgggaaaccactccaaatgaaattttggcgccatcccctctcataaagaaatgataccagcggagtcctgttccataatcaacaggaaataaatagtctaaagagaaataatctataaacaagtatacctatgtgaaagacaggcatatttcataccacatctccagatggtcgaacattttcaaggtttcatagaggtgcagaggtttctttcactacataactacaggctacagccacagaccacaaagcatgattttggcagttaattgtaaactctcaaacaactaatgcgagatgcttagctacattctgccaacaattcataagtcaggaatacgtcaatttaagcacgataggtttggttcctctcgtaatgtgatctgttcatctaagttcaccagttaacaaacttcagaagactctgttacctgaaaacttcagttgtcactgtcgtggattcagagtactcagtagaaccaactgctacagtcatatcccagtaatcccctctattgggataaaatttcttgcaggtaggcactgaccggcctgaaaagattcaaacaaataactatcaaacggggaagcgaagcgatta

SEQ ID NO: 89304 - DNA, 8861 bp, Oryza sativa
  unsure (1)..(8861): unsure at all n locations
taatcgcttcgcttccccgtttgatagttaatttgttgaatcttttcaggccggtcagtgctgcttctagttctagtcttgagtgttctacctgcaagaaattttatcccaatagaggggattactgggatatgactgtagcagttggttctactgagtactctgaatccacgacagtgacaactgaagttttcaggtaacagagtcttctgaagtttgttaagctggtgaacttagatgaacagatcacattacgagaggaaccaaacctatcgtgcttaaattgacgtattcctgacttatgaattgttggcagaatgtagctaagcatctcgcattagttgtttgagagtttacaattaactgccaaaatcatgctttgtggtctgtggctgtagcctgtagttatgtagtgaaagaaacctctgcacctctatgaaaccttgaaaatgttcgaccatctgggagatgtggtatgaaatatgcctgtctttcacataggtatacttgtttatagattatttctctttagactatttatttcctgttgattatggaacaggactccgctggtatcatttctttatgagaggggatggcgccaaaatttcatttggagtggtttcccaggcctagagagagaggtcatgccactcactattttgtatgcttcaggattttattgcatttgtaaaacagctatcttgcgaccatcattattaaatgtgctgcatagcttctttcttgctttttagaaatacatagctataactaatcaaaacacttgtgtggtaaatattaagagggatatgatcaacatatatgcgcaaatgttcacacaaccattttcgttaaggcaagccagaaaagtcctatttgcatccaaactgggtctagctcaatcaggtggttgggttaactgatggactgggaaccagcccgttttttcaacactggaaactaaataagtaagccaccagctgagtttaggagatgatgtactcaaaactctctacctataatatcaatcttggtgctgaacacaacttgtagccatggttaatttattaggttcaattttctttggtataattaaagcatttatgtatcatcttgtgcatgcaagcataatttcttcactttctgaaaaatattgcaacgcgactgcagtttgaaatggctcaaacttatttgaaaccgacaactggagggattatagttgatgcaagttgtggaagtggcctgttttcaagattatttgttaagagtgaactatattctcttgttgtggcactagatttctcagagaacatgttgaagcagtgcaatgaatatgtcaagcaggaaaacatttcagataagtatggtcctcagttccccaatcaccaacatttgtatgtaattcctttgtcatgcttaattcattaagtcgcaatactcatttgtgtccttcgcattgtcttttatgcttcatagcattttttcgtcattattgatttcttctaatgttgaatgctatacttgatgctaacgttgaatgctatttattacttctgtttcaggacattagccttggcgagagctgatatatcccgactcccttttgtgagcggttcaattgatgctgtccatgcagctgctgcgatccattgttggccatccccagcttgtgctgtaagatttctacttgaataacaattttatgtctgtaaaaactcttacgaccttactgtgtctttcagtattgttgagttctacaagctgtttgagttgtttcctatattatgcatttgctgactttgtctttctcagaagaaaaaaaacagaaaaccatactcatttcctcagtgatgttcttctatgcactcaaatacacgtggatggcatattctcttttgtctaattccatctgtagagcccattgaaattgcacatagtgctagaacaagaaaatgctcatacttgtttggttccaaccttcccatagccacatgtatgtgattacacaagcactaaccataggataaacatgaaccaccactaggatacatgaaaacttactcagggtacttattacacatgtattaaggttcacttgataacttactgaagaacaaggaatcatgtttatgaaaaatcacagtacattatttgtggcttttctgtgtgtagaatgtacaatatgtagacttctccagcaacaaatactttttagcaagttgtcaatcgataccttgtgaggaagcgtaacattattattgtcttctttcttttcaggttgcagaaattagtcgagtccttagacctgggggcgttttcgttgcttccactttcgttgcagatattcttccaccagctgtaccggtattgaggataggacgcccggtaatactggaacctaattatccacgactgatgattcgttttaagaagttaaattaatttgcttcctaatgatggtagttatttaaaattggagtgaacctttaatgcttgaacatgtagatattagcatatttaagttaacctatggagtatctggtcctgctatctgtagtatcaccttttggaatctgttttgtttcacacaatcacacttttctcatgaaattatcttgcagtacatcagccaatttaccggcagtaatatcttcttatcagaagcggagttcgaagatctttgcagagcgtgtgggcttattgatttcaagtttgtcagaaatggattctatataatgttctcagctactaaagcaagctaattgatcaactggacagtcctctcaaccttgtcctgaaaatcattgattatgcactgtaagtgaacacactgcattctaattgaatcttgtgaagttcactacattttatcaagtctaatcctttactgaatgttaaaatatattgttacaggattctccgcgccctttctagttggactaatagttttacctgagggaaatgtggtatagaatagtgagtacatacatatattttgctttacctaaccattttggttgcttgtacctcaatttttttgtgtataggactcggcgactcggctcttgcaatcctgtaacttttgtatatcgactcatgctgctactagtagtatatacagagcataaacaaatttattgtgttcactatttatttaggtccctttgattcaaagaaaattcataggaattttaaaggatttcattcctatagaaatttatcctatatagccctttgaagcaaaggaatggatcttatggaatcctatgaaattcctatggaatgcctaatgtcatgcaagttttgaaggaattctaatatgagatagaacctcgtggaaactttcctttgagtctttatctctcttctaattcttgcgtttttcctgcggtccaatcaaatggccattcctgtgttttgcaatcctctgttttacacttacattcctatcaaaatcctacgttttttctattcctacgttttctcattcctgcgatagtgtagggtccttttgaatcgtaggaatggaaaaacagaggaataggaaaaatacaggattctgataggaatgtaggtgtaaaatagaggattggaaaatacaggaaaaacataggaatgaccatttgattggatcataggaaaaacgcaggaatcagatgagagagatagactcaaaggaatttttccaagaggttggacctcttgctaactttcctccaaaatgtgcataggattacctattccataggaatttttaaacatgtattagtcattcctcgtaaaacaagcgattcattaatatttacatttttcgatgctcatgtagccaatcttgtgtggaagaatagagagtcacgcattaaattcaaagaaaaccattaagatgataagttgttggattgaaatatgcctatcaaaaataatttttttcagatttggaaatatgactatcaaaaatagatggagggagtactaaaatggcttcttggttcccatcaacaatttaatttagcatataatgactacaaataggacttagacttttggaaaaaaccaaagaataaaataagccttagactttcggagggagggattattaagatttcaaggacgagattacatacaccgaaaacctaagaagattaaggcgatgtcccgcgaaacagaggaaaacgaccgacgccatcggtgcagtataagctaacacactcactgtcacgccagccaaactccattgttttgctgcttctgcgatctccacaaaacgctagggacaggattttgtaccacgtttagagaagttcttcactgatctcgcaaatgttagatgccaacagcactacaatcgatacaagtaagttttcctcctagatgaggttagctattttcatatttctttcaggcttagcggcaaaaatgtcattatttgctcatgtcaggcaagttgatgaaacaaggtaaggcaacatggagctcaaatcattgttgttgctacatacgtatcttgttgtatctagcaggggttgcaaaatttttccattaagcattgggttgtcttgatgtcgaatgaggatgtatggcattaggtatgcgagttttttttattagctataccattttttgttaatacaacaaaattagactccccattttgagatatcacaaaactgtactgctgtcgccatttgaaagggttatagaatatatcgacatttcaaatggagatatatttcaaacgcctagtaaacaataaatcactactaacagtggacagctgcatgctgcatcgcttatcatagaataggcacgaggcgggcgtggaggttgactgctagtgcgtggtggctggctcttttgcctgtccttgttcggcccgatgtggcggagccatagttagtgccgactgccgagagaataccccaatcggcttgcactggtgactccaagtcgacagtggcagtgtttgtcgagagtcacaaaaagggaacaatgacagaaagatgagttcgttttcacaatcagatcaacgagatgcaaaacaaacctaggagttcttaccgttgttcttcctcggtctttgatagaacttatgctgataacgtattatgctactccccctactacaaattaggtattatgcaacccttcatgctacaaagtagtttaagagggattatataatgcttacaaaaatggagtcacaaagatatgagggtgtgacatgctttcttactcattctctttttaaattgtacaatagtgaatcttctcactctatttataggtatagcttcattcaccttttgtatttagtgatagactcgattagtaagtaatcaagttgggtttttgtgggctgctggtttcgtaacacacctcaccaaagaaagtgcaagggctgctcatatttgcaatgattggaatgtgtatgtgcgtttaatgtcataacatcgtccttaacaaacggttagagagaagtaaatactactaatatctaaaagatatagtcgctttgaaagggagaagcaacaattaggagggattctataaattaggaaacaaatactaaataagatatattaaaaccaatgcaaacgagtgatcaccatgaggattgctatggtccagcaggttgtactgggtggtactggtaccgtgcggtaccaaaacacatctaaccattgaatccgggatgggtaggatcgggatagaaaagatgagcaagggtggatgcggcgttcgagtcattgttcccggcgatggcatcatccaagtcgttgtcgttcccggtggcggcggcgtccaagtcgttgtcgttcccagcggcggcgcagagcaacaagggaacgccggcggcgcggaagaggataaagtccggtggcggcgcgagagagaaaaaagagaacagcggtggcgcgagagaggaacaagggaaggatgacagcgtgggagaggaacaagtccagcggcggcgtgatggaagacggcggcgccgcgggacaggactaatggagatgcgggagaggcaaattctagggtttctgagcatctaccgtctgctctctctatcattggcacgcggaattacattactgcccttccacctacattcaacacgaggtaccgcatcagggttagaactggtaccccgcagtaccaatctctgccagccgttggatctgcccggatccaacggtcgagaatcggtaccgcaaggtaccgctggatcgtaaaaatccttgatcaccataggtagtgtgaattgtgaaagtcacaacaatgaggtgtggcctccatgaggaatagaaatggcaagctcatgagaagaggacactgctaacatataacatcatgaattagttgtcataaggtacatataaaacttacattagcacaaataggaagacaaccatacaacaaacaatatacgtggggaaattagcatgctagaaatggcaagaaccaggcaaagatgttgtaacaaaagggattatactcgtaccatttttttttaaaaaaaagtgtttctgaatgctacaattctaatccctccatattatactcaaattagtttattcatcaagaatattgtcattgagttatattacataaatagtatgtattttggctttaaatctttttaatatttcggatcaccacattaaaaacctatatatatatatccctaatattaaggaatattctgaaccacctaattaacatctttgatacagcaatagcgtaacaaatctagccacataaatacaccgatcaccctgctgcatatataatgacaaacatagcacaaggatcattggatcaagtcaagatggggcagtcatcgatatttgtcgtgctctcttttctgttcttcagcaatgctgcagcaagaagcttggtgctctccaacgaagacgacttagcactggagagagaactcatgatgcttaacaagccctatgtgaaatctttcaaggtaatattgatatccacgtgaagaaactttgggacaccaataaccaattaccatgctccattcaatatttcgttcttttattattctgcatttgatgaaatggcaggatagctatggtgtagtttttgattgcgtggacatctacagacagcctgcattcgatcatcctcttctcaagaatcacaaacttcaggtaatagtcaggataaaaaatttatattctctcatgtgcacttattttttgcgttttagtatagctatttcactagctgtggtagagatttgcaacagaagattattgcatcaaagagatttgcaaaacaaaaaattacacaacggtaatctgcaccaaaaatgagatcatggagtgaagtgtaccctggagaaaatagaaaatagatcgatgtcgatttcaaaaatctattttttctagcaattgttctgttatcacggtatgattctaaaatgtctttctagatttgtttgtacctgttctttacaaggcatacacatcagatttagatcgatggcgaattataattcatagagttcaaaaggaagtcatctgttttgcagcatgatgtattccctgtactacattacagaagacaaactctgtagaatagaagctcaaaaaaaaaaaaaactctgtagaatagtatttattggttactagcagtgaaacctgtcagcttataggtttactatgtgtaaattcccaatatattttatgaagaagcctcattcactggactaactgtttttttactgaaatctgaaaccagattccaccgcgctcatactccaaaagtttgataactcattttggtctgcaagaaagttgccctgatggaacggttctcattcgaaggactctcaaggaggatctcctaagggcacgcgcgtttcgtggaccgttgaaaccacagaaagaccaatcatttacgccaatgagttacactagtacaattcctggacaacatgtaagttggcatttcaaaattcgaattttctctcagattttatgattctctacttcggaatattttttttttgggtgatacaccaaatcatcaccaaatgtatccattttgcatttaatctaggacaacattcctcttactttatggatattaaatggtcatttacaacattcaaaagcaaaaattgatgctaatttattatgctgtaaaatgaaggacaatgatgcttccttgagttagtaataaacttggcaaaatatcgagaaaaactgcctctaccagcaaaagtccaatttcaaattagatttggcaatagacctatatacaggttttgtattttcattttgaaatggaagttaagaaatacttcagattttgtttgcgattacatggaaataattcagatttttttattgtatttcgttcaaattttacataacatccatacctgtcttccaaataaaatatattaaaatgatatagtactttgattcatgtaaccattttattttgacgcatgctatatttatatgttttattgcaaattgaaacgaagaaaatgatagtgacatcatggctagcacgcgtgatttcagcagatagcatgccagcatgatttactgagaaaagacaatgtatttatgggagcaatcaatgtttcttttaattacaaatcatgaatcaaatatttagatattgtcacagctcttactcctacatcagatggatggaggaccaaaaaaaaaaactcacttgtgaaacctataatacacatccacagtattgtccatttgaattcagagctactcgttnnnnnnnnnnnnnnnnnnnnnnnnnnnnnnnnnnnnnnnnnnnnnnnnnnnnnnnnnnnnnnnngtntatcatcacaaannngccgtaca

SEQ ID NO: 89305 - DNA, 698 bp, Oryza sativa
  unsure (1)..(698): unsure at all n locations
gcgggaatttgatttgtatttgtanaacnnnnnnnnnnnnnnnnnnnnnnnnnnnnnnnnnnnnnnnnnnnnnnnnnnnnnnnnnnnnnncggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagccaccggggaaacgcctttcttcctcgtctacggcgcggaggcggtcctcccatctgagctcaccctgaggtcccctcgggtcaccccatttcgcaatgcggccaacaacgtctttgtttctcacaacttcaccaagaggaaaagaggagacaactgtgactctgtgggcttgaaaatagtggcgtagcttccttgatgtcatgatgactgcgtaaagcagcttttggatctgtgggtatcttgtctttgcgtcgtggagagcttcgctgacgtaataaactga

SEQ ID NO: 89306 - DNA, 1374 bp, Oryza sativa
  unsure (1)..(1374): unsure at all n locations
agcggnnatgtanttcnnatgatataacactcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttatgtgacgggtggtgacaatgagtccgtgtcgagcgctgattttttcggcctttacagcgagatttatacaatagaatttggcatgagattggattgcttttagtcagactcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaccagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaaaagagtcgtgtaaaatatcgagttcgcacatcttgttgtctgattattgatttttcgcgaacccatttgatcatatgacaagatgtgtatccaccttaacttaatgatttttaccaaaatcattaggggattcatcagaga

SEQ ID NO: 89307 - DNA, 803 bp, Oryza sativa
  unsure (1)..(803): unsure at all n locations
ttagcccgtgaggattgacnttctnnnnnnnnnnnnnnnnnnnnnnnnnnnnnnnnnnnnnnnnnnnnnnnnnnnnnnnnncctccttttcccctttccttcctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctctgccgtccatcgccaagcgccgggtgagccggtgcgttcgtggacgcggaaggggactccgggcgcgccctcttcttcctcttcctcagcccgaggccggagagatcactcccgcgccgtcggcctctcgtcactgcgccccgtcccgcacggtagtgtctctctccgttcttcctcctcgctccatctcctccccctagctttcggtagtagctcgagtagactccccgtagctagccggcgccgccccgaccgttgccgtcgttcgccatgtgctcgccgccgtcgccgcccgagctccgtagcacccgctcgtcgccagcctcgctcggcgtagctccgtccaatccgacgctagcatcggattcccgtggtcgcgtagatgctctcaccgccgggaatcgacctctcgtgacctcgtcgccgtttccctcttctcccgccgctggttgccgacgccgcaatccgccgccgtcgagctaccttcggcgaatcgt

SEQ ID NO: 89308 - DNA, 983 bp, Oryza sativa
caaagggtgggggatagggaaagtgtccgactcaaacggcctgactaaagtcgttaactgagaacgccctcttcaccatgacatccagagtaagaggcatttgtcaaagatagatttctttaatcacaaaatactccttacagttttttcccaaatatttcgctacattacatcttttcctaagatatttgttatagggtacgagtactaccaagaaggccaacgtcagtccatagactggaagatcttcttggccagcggcgacattgaccttgccagatagtctatctccgccggagtcctccgagaacgagcaaaaccctcacgaagatattcgaggtccaagtgtgggcgatgatcttgtaggcaagccaacacgtgccccccggcatatcggctcgatcgacgacactcctgcttcaaggcctcgtcgatacgcttgccgattccatcgagttgggcataggccctattaagccacgagatgtacccggccaccgactcctcgggatctccgcggactactcgaagctccctgcatactctggccatggatgtgcagcaactcttcaagtacgagttaaaccatacctcacggcctcggagcgtttccacagcctgctctttcttcacggccagcatggttctctcgagctccgccacttcaaacttcgtcttccagtattgagttttacacattatctaggaaatacaagaagtcctactcttcaaaaagggggagaacagactccccagatcaccgacttcttcatcacctcttacgcgtgttgctggccggcccctagtccaagatctcgcgcagatgagtttcaggacgcacagccttacacacacgaggacatgacacgccccggtgtagaattcgtttgacgtcttcttcgcaattcttcccgcatgctttggaggggattttccccatcgctgtcggcaggttccgcgagagaagaggtcagcgaaaactc

SEQ ID NO: 89309 - DNA, 740 bp, Oryza sativa
  unsure (1)..(740): unsure at all n locations
cgtgtcnttangatgactaacctatagcnnnnnnnnnnnnnnnnnnnnnnnnnnnnnnnnnnnnnnnnnnnnnnnnnnnnnnnttcttttgtcggatggatttaggatcaatcaaataattacagtgaatcatttgtattattatgaacatattttatttgtcacaataaattatgaaaggttaataattatccagccccgatcttgacggtcttgtcggggttggcactggagagtggaacaatcttgatggcaccgtctggtttcggcgtcttgtttgtcttggtcactttcttgggtggctcagtcgtggcgggtgggctgggcgtttgctcgaccatgtcgaggctccgcttgtcgcattgcaccgccagctttgcgttcccctgaatagtgattgttcccttcggtcccggcatcttaagcacttgatatgcgtagtgagatgcggccatgaacttcgcaagtgcagttctcccgatgatggcgttgtaagctgtatcgaattcagcaacatcaaaggtgatctgttctgttaggaagttgttggcttggccgaaagtcacgggcaacgtaatcttgcccaaaggtctggacgatgattggggagtaattccatggaagggttgatcagttggtgtcaacttgttttgcgaaattcccatcgcgtccaaagtgctggcaaaaaagaagattgattgagctgccaccatcaatgagaactcgcgctaccttgatgt

SEQ ID NO: 89310 - DNA, 1906 bp, Oryza sativa
  unsure (1)..(1906): unsure at all n locations
cgcgtggccaaagtgccngngacnctcntnnnnnagannnngggaattnggtacgccgtattaaaaattatgataattttagtaaattttaactttgtaatgtaattcaaatagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcatctgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaatgcgagccctagaaagataattcctctttttttaattcattttggtattgacttcgaaaaagctataaccaattattatagagtttgcagaactaataattgcgaattacagaattatagctttgattaaataatcataaagaagagatcataaacaaaacaagaaaaattactaagaaaatcctagaagaataacatctttcgtacgcgaatctggatatttgtgtagtcttttttaagagatcatttcaatccggttcgggaggctcgaatttaaaaaattatagtgaaattcgtcgaagttgtgagccttggtgatattcagagtggtgttttgttatccctttcttctttacagagcatgtaccatcgtgggctttagtctcgtgcaagagataagggcttgcgctcttgggccggaaaacattgggccgtttgatgacgccgttcatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgttccatccgcctcggccggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctagtgcgcgttgaacaacatgctgcggatggcggtgaccgaaaactcgctgttggccaacacctgctcgacgtagaagatggcgtct

SEQ ID NO: 89311 - DNA, 723 bp, Oryza sativa
  unsure (1)..(723): unsure at all n locations
tcggcgcccttgtgatgatctagatctcgcgttctgnatgtaaggagttgggaggtctccggattccagattatngatttncaaccccanatancagtatactattagctatgccaaggcctggagggccaaacagaaaataatagagatgagatttggaacttacgaagcctcgtatgataatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaaatttttcataactatttatgtactttacaattggaaagagattagagcgcccctacntatcatttgagagtattaac

SEQ ID NO: 89312 - DNA, 1259 bp, Oryza sativa
  unsure (1)..(1259): unsure at all n locations
agaatgtgacctgatatgcgcctnnnnnnnnnnnnnnnnnnnnnnnnnnnnnnnnnnnnnnnnnnccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatccgaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagctagcgatgatcgctcccgcgtctgtcttcgtgcacgcctcacagaggacatggtacgtggctgctagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcggggtacggaattcctcattctannnngcntngtgcaaccgacntgcatacagaccg

SEQ ID NO: 89313 - DNA, 534 bp, Oryza sativa
ttatcgaggaaagaaaccgtggaggctcttacgaagtgaagaaattcccctcaattgaacatcctggcaagagtgtgctgcaaagctacatgcatgcaagatggcattcgtgaactgtcgtcctgttctctgcattgatgggacattcttgacaggaaagtatcggggccagatactaacagcaataggggtagatgggaacaatcaggtattgcctttggcatttgcttttgttgagagtgagccctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcgggtgatcgatgccaactaatggcttcgaggaatcctgatattcgaggagggcgcttttttaggtgccctaactatgaccgtgaggtattttattatctgcatatgcttatt

SEQ ID NO: 89314 - DNA, 712 bp, Oryza sativa
  unsure (1)..(712): unsure at all n locations
atgcttgaaatttttcaaaagnaaaaaagaaanngatccacannncttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggatgttcagaacttttttgaaagctatgtcacaaaaagaaccaaaaataatcattactgatcaggatggagcaatgagatcagcaattgctcaagtatttcaaaatgcaaagcacggaaattgcttctttcatattgtaaagaaagctttcaatctatctggaaatttgttcaaagcaaaagaagatagtggtagtggctatggttaagttacatggatcagagctaaatattccctttgtttcatatcataagaccctttaagtttgatcaagtttataaaaaaaatatagtagtatttttaacacaaaataaatatattattaaaatatatttaatgttagatttaatgaaatcaatttgatnnnnnnnnnnnnnnnnnnnnnnnnnnnnnnggntttcaacaannggttctacgagagnttaatacagct

SEQ ID NO: 89315 - DNA, 702 bp, Oryza sativa
  unsure (1)..(702): unsure at all n locations
ccgtggttttgaaccgcncccttttgatgcatgntagnaccgcgaattnggtaccccgatgaaccgaagtgaagaatacggtttcgccctgattcccagctgtcgcctgtggtgttgggtgttagaccgttggttccgctggggctgttgttgatggtgttcgcctccgccgtgtcgtcggttgtattctcgggctgtctgagctgcaaccaaggttaaggtaaataagtcctctatttattttaaggattgctatgattcatatttgttaccgtgggtaccaacaccatcttcctgtcatgagatgctcgggcaatgctctcgatgttcattgaagaaaaatgaaaatgaacaaaacaaaagaaaatatgctccatattatgtcgcatgtcatagtatataatgcatgtcaaaacgtgagcatgcactggtcatatatccacaataaatataaaactaagatataagcagtctgtgaacatttatcaattatcagaagattattagcaactgaagaccatgcaaatatgtgggatgcgacccaatggacaaatctgaggtaaataaaaaaaaatgagtagagcatgtttaaaatcaattaatggggcatgcaagcccaagttcagactttgtaaaagttaaattaatttaangattaattggttcaataccaaagttgtagaaattatagtatatttgggg

SEQ ID NO: 89316 - DNA, 1016 bp, Oryza sativa
  unsure (1)..(1016): unsure at all n locations
gcggcacnnatggtcatggcatgcaaagagctgccccatggcgatcgttgctgttgaaatcgtcaaccgggcgccaatgtggcagttttgccacgcccggtacttgccacgcccggtttgctggcgtggcaaactgtttaaatattttaaaggaaagtgtcatggttagtttgtaaagaaaagctgtttaaaagttcatgtgtgggattagtttgtatttaaaaaaatagtacttgacgaagcttggggctcctcaccgggagaccgcacaagcccccctttgccggttcggccgggggcgctaggtgagtttcttcaccctcgatctgtggaatgttcgcgagagagcaaaacgcacgagacacgggcgatgtagacaggttcgggccgctgagaagcgtaataccctactcctgtgttctggtggatctgtgtgtgaagaagttacagagagtcggagagcaagagagttcaggctctagaacccctcttcctctttctctcctctacgagctcaggtattctcagagtcgtctaagagtcctccctccctttttcgttctccatcatcccttttcggtgggcaaggtcctccttttatatctcaaggggataccacatgcaccacttctacctacttttcttttgggtggggacccaccctatcttgaccaaaaacttggctcgcgccttcgcctggaagctaaatcacaacttgtccttgagtgaggcccagcgccgtcactcgcctccacttntacggaagtagatgcagcgtgggaacacggttgtctgccgaagacgtgaccggggttagaccagtcacagaccggtcattcttgtccaccacgcgtcagtttaacatgccgtacatctggccttcttcatacaaagacttacttgtaatggttgcgatgaagcctggcatgaatctggccgggactgacgtgccaactacaggagttagcacgccggctccggctagggaccagtgcctggaggctctcatcattcca

SEQ ID NO: 89317 - DNA, 5974 bp, Oryza sativa
  unsure (1)..(5974): unsure at all n locations
cggggtgtaccccttttcggaatagacatctccccggggggtcctggggagaaaaaatatatgtaaagcaagcaaagtttgtgaattttgtgagaaaataagggatcatgtattcaaaatattctttnaatgaaatggtggtcaagaatattgggacaaacaaaggaaccttcgacccaatgttgtaggatttatggaacgaagaacctgccaccgatccccacacctgtattttggacgggcttcccatgaaggaagtgccgtagttagcacccgccagtcgtcttgttgttcacgacattttggttaataagcggcttttttcggtaagtattgctcagtactttggaatgcgaaaacacaagcacctttctgttaacaaggtgttaggttcaaaaccggattttttggtttaacccccttgaggttatgcccaacctaaggtgggatttcgccaaataagtaggcttcgagcgagtacagctggtgaccacggcgtgtccggacggtctgggctacacggtggcgggagaccacgacggcacggtgcggctggggtggaagaaacacccccctctacgcggtgtccgcgtggacgtggtgctccccgcctcacgcgcgtgcttaatcgaagctagttttaatcccttttgattagcacaaagtacatggtgattaagcactaagctaatcacccgtgcgtgccaaagccagactggtctcttgcaagtgggcccacgtaggaatagtcacatatgcaatgtattgtactactactactgtggctcctgggccaactcgtcagttgccagctcgggtatatttatccttatatatgcttgtatccacaattctacatcaagtatacaatttttttactgcactgagtataatatagtgcatctaaagaagaatgtttacactacactccctccgtctctaaatacaagatattttgtccgtctctaaatacaagatattttggttatgtgacatatcctagtacaatgaatgtggacaactttcttatactaagatgtgtcacatccaatcaaaatctcttatatttagggaagaagagagtactatttatcactttgtagtactacttatcatatcaatcacttccaattcaaattccccctactctactgccaatcatcatcccgaatcaaactatacattagtatttaataaaaaccattagtctttttttaacctctaattgcagccccaagaaatgaagaacggcctgagttggatagttgcatcaaagacttcaggaaataagatgagctatggatcttgatggtcatttagagaaagatgatgaatattgcaccattgcaagggtatgagtactatcaaagtcaacgaattccaagcatggtttcaacagaacgggcacagaatatatgcagtattttttttgggttaatgccccatgatcctaatctactgaatctacaagccccaaaaggctcttctaaactacaacaccctcacccattttgtgatgctggtgtacgaatcagcatctgtccaatcctcactgtacattgatcaatgaacaaatggaactactactcaacataccacggtagacgaccagtttgcaaaaaaaaatcaattttacttcatatctcagcagcatcctgaaagatcctcagtagtttgggcggtgctcactgaagcccctctcctctcatcaaatttcccgcatacagtgaactctcgctatcgcacaaggtggtgctgttcgtcgaacatggacttccggactccaggactaacaaaattgccttgttcatggattcacattgcaatctatcaagaatggatcatcccttggcaggtaccttctccaatatttcctgtatcgccgtatgccgagttctaaccacggtttcatgttgccgttgtagtgcaatatgccagctttctttatagcaccatgattgactccatagtcatgaccaagaccagactggatccactgtgcttcaataggatggaccagattttgaaaagcaagcaggcctgcaggtaacaccgcagctctccatgacgcttcagggccatgttgcagctgtcaaaagtgagacataggcacaaccgtatcagttaagaatttgcagctcttcgcttaacaggccaaacgtgcaagaaaaaaaatacatatcttaaataaacttcaaggcttcaagcaagtttatcttattagtgaagatcacggtacagtagggtaagttcagttgaacacaaacagaaaatcaagagtatagccatgaggaatatgccttatgtcaaatataacatcgaaagtagtttcttaaaaacaattcttgaaagagagaagaaaagacagctgctaagcatcactattcaatactaaccttttggagtactcgattacgaactgcagtcacatcatgctccctccatttattgagatcaataacactcactccagacatccagatacatgaactagcatcatatgggaagtcaaccaagtatggtctgagatgccttaatctaactcgacaagactgtacagcaccaatcacttttcctttcaaatcaagattccatatgtgtgacaagtctctctggactatagtatcatcttccaaaacaatcacccgtttaagattgctaaacagctcaggaagcaagaaaagagagtgtccaaacactgaaatatattcagttctcatttgggtatttggaattcgggcattgctatgggaagcgatgcggaactcctcatatggtgataagtgttcaactctcctattatccaaatgtgttgcttggaaatcttcaaaattcagaacaccgatagtggcttccttgtaagaatttctaatgaaccaattcttaaatgcataaaagttctgtgcatcagtaacaagatgaaaaaccacatttgctgattcctgaaacactgaaaagaactggtgagtgtcatgatgcagaaatttcaagagaccacatggtctacacaacaaaagtaatatcatacctcagaatttatcacagtcgagttgacagtcatggaagatgcaagaaggttggtagagaaaataacatagtgccggagaactggattttcaagcttttgcacattggagtactccatgtcagcaaaggatttaaagtagtctactgtcaatctcattgaaaggcagtggaggctcttaggtaatgtctgaactccaagccggtaaagatatgcaccttgtcttgcatgaaaatgagcttcatcctcagtcatatcaagcaattgcctcagttttttctcaaaattagtgcattctatcagacatgattttgctgcagctattgtcttctccatctttgccatattggctccatggcttcaaaaataacaaataatcactataacaaaacaaataatcattatagcaaactctaaacctatggggaaattttctgttccaaagtgaatctgtataacacattgagccatcagatcatcagtccactcatcatttagaacttactgctacaattattggtaaattattcatcccaatatcacacttttagcttaatacaatgttattcgatcaaactacagagtgttaatacatttcacaaaataataaggactacgaacatgctaggtgatgaaagagataatcctaaggaatcattcaggtaatgctcaatcaactgtaggctgtcaattatgcataagttatcttgtatacgtgcatattagacgacagtggatatcaaaatctgtgaaaataaaaaacaaacagtgaagcacaacagttagtaggtagaccatttttggtgcaaagtcaggctgcttaaatacccaacagtttcatgtatggtaaaatatcaatttctgaagttagcagtgccttatggattaaagatgatagcttaaaaatgagaactaaagaaagtatttctggaagattacttacaatgcaggaagatcagcatcacatatggcttcgctgagcatgtgctcatgctcttggatactttgcttcatttcatgtgaaagtttttccatcccctcaagttttgctatgcttggatagtaagctcttgcaacaaagagctggtctttaagtctcttcactacagaatctttcatcacttccttgtgttcaacagaccaaacacaatagcttccaaattctagttggcacgattttatactctcatcaccaggtaaaccttgttcaaaattgtccttaggatcagcatcagtattctgcaacattaggtgaaaaataaaaagtatgtaatatatgataattctgcaagtccgcaaacaagttacaaaggattattgaaatgtttctttaaaatattgcaaaagcaaggtgcatatcacatgccctgctcagaaattcatgcgaaagcagcatatatatttactgcacgaacagacaagggcatgttaaaaataactgtaaagcatattagctcttacactcagtaatgatatatcatcaaagatcacgatttgtttgataggaaggcctgcacattacaagaagaattaaagctgtaacttgatatttaaaattttaaaactaaataagtggtcaaagaatgggccctgcttacctggatggattgaggtattgctaatcggtttgtcaatacttggttgattgttggtcccattgctttttgcatcagaattaccggtatttgttttgctccagtcctgtgaacgaacaactaaatcaattaggtaacgcaaaaaaaaattgcatgtttcggtagatagacaagattttcagatgatgcaatgcaatttttgggacatagtgacaaacagttagtaagttcaaaaccccattcagctctgagcctcttacatgccaaaaggaaagaaacagtgccttgattgcagtagaaatgcaaaagagggccatgtgaaacaagatccatgatatggcaaaagcagactgacatttccaaaaaaatggggccatggaccatgtattaaaaggcaattccactcaaacactacccatgagaccacaatcggcacgatagcaactcacaacaagcactctacttggataaaatttcacgcatgaacaaagagaagaaacagctgcggccgatgggctcaaatgcaaaccttttcaatcgatggcggaaatttgttcgtgtcgttgactggcagcctgtcattttcctgcgaaaaaaaaatgcatcactgatctaaagattaaattctcttcccgcagtagtaccccatcagtcatcattgaccaaacctaattaggataaatacacctaaccacacccccatgtgattggaacatttcaggtaatagaacaaaaatatcccagaaatggcaatcatgagcacaccccctacctgcgatgtatttggctcccaaccaccaccctcgctgccgccaaacacctgtgcaacagaaacatgaggcaaaaatcttaacagcaatggattaaacaaatcaaatggcttaagcatgagctactagttagtttcaatctcaattgacactcaccgacacggcgctctcgtcggccaaatacactgtgatatcaaaagacaaaacaaatacaaacaaaatcgagtcaggggagcatagagagagagttgatgagcccctagatcgagcgcgagccggcgagccggacgggaagcccagatctgggagcggagaggctgaagagaaaagtagggttttggcaggggagagaggggtgggtggttacggactggacgggaagcgctggtggaggccgagcagcacggcgagcggcacgccgacggagaggaacagcagcgccagcgcggcggccgcggccgccacgctcctccaccgccttttcgccggggcccccgcgctcgcacccttggccttcattncccgttccccccgaccgaacgcacaggggggagcaaagcttagcttccacccccccaaagcaa

SEQ ID NO: 89318 - DNA, 802 bp, Oryza sativa
agccgcggtcacccacgtggcctgaccccctcgggggggtcgggcccgagggtgacatggccacccctcctcttgtctccccgaggggtcgggccgctcccgtttcggccccaaggcaaggggcgccccgaccccctgtgattttggcgccacgtgtatgggttaggtgagcacagcggggctcacctaactgcatttattgcggcttggacgagcgcgccacgccgcatttaatgcagcgcagcgcgcgctcgtccggtccgtgaccggtcgcagtgtgtgacaccggtcagatcgcgggttaggtggcaccaggcggcttgtcacacgcctcgccccgtcccgtcggaatgatgagagcctccaggcactcgtccctagccggagccggcgtgctaactcctggagttggcacgtcagtcccggccagattcatgccaggcttcatcgcaaccattacaaggaagtcattgtatgaagaagggcagatgtgcggcatgctaaactgacgcgtggtggacaagaatgaccggtctgtgactggtctgacgccggtcacgtcatcggcagacaaccgtgctcccacgctgcatctacttccggcgaagtggaggcgagtgacggcgctgggcctcactcaaggacaagctgtgatttagcttccaggcgaaggcgcgagccaagtttttggtcaagatagggtgggtccccacccaaaagaagagtaggtagaagtggtgcatgtggtatccccttgagatataaaaggaggaccttgcccaccgaaaagggatgatggaga

SEQ ID NO: 89319 - DNA, 1664 bp, Oryza sativa
cccctcgttatatttgtgtgggtacaagagaaagatataaatgtttcaatgcaagccagagatgtagagggtcctatcaatccaggggatgttgttggaccatcgatgcaaaatgaggaaaatcaaccaaggagggagcaggccatgggcatggcggattagggggagagagtcggtataattgttgatgaaatggagagggaagattcggataatgaggaagcggcggacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacactataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtagtgcatgcgtcacatgggtgcaaatttctacaagcaattcaagaacaagcatcttatggagctctttaagaggctatgtgcacagagccaagagaagaaatttaatgagttgtgggacaagttggatgagttgacaatgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcgtaaggagaagtggtctctattattcgacaccgatagatctcggtatggcataatgacaaccaatttggcagaggtgtacaactaggtaatgcgaggagttcgggtacttccattgttgctatggtgaattattct

SEQ ID NO: 89320 - DNA, 741 bp, Oryza sativa
  unsure (1)..(741): unsure at all n locations
agtgtagaanatcttgtagactcncgtaangagacnnnnnnnnnnnnnnnnnnnnnnnnnnnnnnnnnngcgcgtgatgttgatctggccgtagtggtaggacccctgcgggttggggcgggcggcgctcgccgtcaggttccaccggaacgacctccactggttgatcgaccacgcccatcccgccggcggctccggcacggccggcgactaaaaaatcatgtgcatctttcacagctagctgaaaagcctgaaaatgatgcgcagtgttatctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagtaaacactgtaattaagcgaccaaccatgaaccatctcatgaacaaatgaccactattagaccaaatggtgcttccaggtcagaaaaaagaatatgccg

SEQ ID NO: 89321 - DNA, 1037 bp, Oryza sativa
  unsure (1)..(1037): unsure at all n locations
gataactcacccatcatgctcatctcaaattccccgcgcatagtctcagcaaattttcaagcaaagcgtgagtcgaacaaccaaagatgatatcatccacataaatttgacaaaaggttgattatcaccatgcttgagaacaaaaagtgttttgtcaacctttcccattgtaaaacctttcgtaagtaaaaagtttttcagcttatcataccatgctctaggagcttgtttcataccatacaaacctttagaccatttaaaaacatgattgggaaaatcagaattttcaaaacctggtggttgtttaacataaacttcctcctgtataaaaccatttaaaaaagcacttttcacatccatttgatacaatttaaaaccttttgaaacagcaaaagcccaccaaagtctaattgcctcaattctagcaacaggagcaaaagtttcatcaaaatccaaaccctcaacttgagtaaagccttgagcaacaaatctagctttatttttcacaatcaaaccatcttcattttgtttatttttgaaaacccacttggttccaataatattatgtccaaaaggtggttcaactaaagtccaaactttatttctctcaaaattttcaagctcttcatgcatggcgttaagcatggagtcatcccttaatgcatctcacaaatcttggggttcataataagcttcaaatgcagcatttgctccaacatcagcagtcgtatcctcagtcgttgcagtacgcccacctatattaccaataatttgttccggcggatgtcgtcgttgaatgtgcaaaagagcagtgacttctaaagttgatccatgttctgtatcagtactggtcgaagtagtaatctctggaggaccatctcgatcagcatcaacagtacccgaacccgacgaccctggccggtctgaccgcacgtcctgtgccggtctgaccggaggtgtgtcggcggtctgaccagcctgnnnnnnnnnnnnnnnnnnnnnnnnnnnnnnnnnnnnnnnnnnnnnngacactaccc

SEQ ID NO: 89322 - DNA, 696 bp, Oryza sativa
  unsure (1)..(696): unsure at all n locations
caacgttgtnnncgcatgacaggnggccganncnnagnnnnnntagantggaggaattnggtacccccaacttcttagtggttttctccactactacctcttgttcttcacccgcagcctggtttaaactgatcagtggcttgtgcggcactggagactggaaggttaccacttctcctttcacattggtcaacttgatggtgcggctagcgcaatcaatcactcctctgtgccttgtcaaccaatccattccaagtatgacatctaggtccttggattcgagaagaatgaggttggctggaaaaatcaacccttggatttcaactgtcattgacgggcaatagtgagttgtggtcatgcctcctccaggagtatgaactcgcataggtatcttaagcttcactaaagataacccatgtgcaccagcaaaacgcttacaaatgaacgaatgagttgcacccgaatcaaacaatatttttgccggtgtcgagtcgacaggaaatgtgccccatataacctntggtgctgactgcgcctcctctgcaaacccatgattgacaccggcctgcacaaacatgggtccaccatgtnttgggttcggcactttcccaccctgtgtccccgcttgctaccattgaaggagagttccggcttttcttccaanctcttgggctgttntggcacagcttgctgagc

SEQ ID NO: 89323 - DNA, 700 bp, Oryza sativa
  unsure (1)..(700): unsure at all n locations
ttttggccttttgagactagantancntcnnnnnnnnnnnnnnnnnnnnnnttgaatttcctggttctttgaaaagaattcaaagtgataatggtggagagtttaaaaatgcttcatttgaacgattttgcaatgaaagaggtcttgaacatgaattttcgtctcctcgggttcctcaacaaaatggtgttgttgaaaggaaaaatcgtgttttggttgagatggctagaacgatgttggatgagtataaaactcctagaaaattttgtgctgaggctattaacactacttgttatatttcaaatcgagttttcttgagatctaaacttggaaaaacttcttatgaacttcgatttggacattaacccaaagtttcacatttgcgtgtttttggttgcaagtgctctgtcttgaaatctggaaatttggataagtttgaggcacgttctaccaatggattgtttcttggttatatcgtgtacttattttggggactaacaaaatcgtggagacttgcgaagtttcttttgatgaggctagtgcaggtattagacccgatattgcaggtacactgtcacaggttcagggggaggatggttgtattttttgagatgagagcgacgacgactaccacgacgaggtctgctcggccgtcagaccacgcaccagctggtcagaccgccacacacctcccggcaga

SEQ ID NO: 89324 - DNA, 1362 bp, Oryza sativa
  unsure (1)..(1362): unsure at all n locations
aggttnnnattgatggctgtcgagnnnnnnnnnnnnnnnnnnnnnnnnnnnnnnnnnnnncaacaccaatttggttctacagctgtgttggatcctgatgaagatggtgaagctgttgatcaaaaagagtatagaagtatgaggggatctttgttgtatctaactgctttaggccagacatacaatttgctgtgtgtctgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgattttggaagttgtagaattgataggaaaagtactagtggaacatgtcattttcttggtacatcattgattgcatggtcttttaggaaacaatctagtgttgctcaatcaactgctgaatctgaatatgttgttgctgctagttgttgttcacagattctttggcttttatctactttgaaagattatggtcttacttttgagaaagtacctctcttttgtgataatattagtgctattaacattgctaagaatcatgttcaacactcacgtacaaagcacactcatattcgctttcactttttgagggatcatgttgagaagggagatgttgaattgcagtttttggacaccaagttgtaaattgctgatattttcactaaacctttggattctaatcgctttgcttttcttcgtggtgaattgggcataattcatccttttggcatggtttgagggggagtttgtacctcatggttttatcaagcaataatatgacaatgagaaaaattgagaaaagagagctttgtttatgcatatggtattttcttgtgcatgctagcaatactttgaaggtttatttgtttctagcatagcttgtatgtattctagtcttttcatgagatttagattttgcttttaagggagatgatgcatgacacttaaattctatacttgaattaagaaaatatgcaatgttgatgctagcatatggtttgatctataaatgctctatatatatgctttattgacttgttattcctcaaatagctttaattgcttattgtgaaaaagagaataaaaataagaaaaaatgaatcccgaatccttgaaaacagtcatgacgacaaggacatcgatatatacttaaatcaagtgattgggatagatcggtcgccatgccgagactgtataaatcacttagatcaaaatatatattaataacannnnnnnnnnnnnnnnnnnnnnnnnnnnnnnnnnnnnnnnnnnnnnnnnnnnnnnnnnnnnnnnnnaggcgcgg

SEQ ID NO: 89325 - DNA, 723 bp, Oryza sativa
  unsure (1)..(723): unsure at all n locations
cggacgcgcactgtatacncctgtnnnnnnnnnnnnnnnnnnnnnnnnnnnnnnnnnnnnnnnnnnnnnnnnnnnnnnnnnaacacattatggatgccaagcatgttggagggaagctcaagctggtaagcaacttcacccctgcgttccaaaatccgatatggtcccacaaagcgtggtgccaactttcctttggtttggaagcagtgtactcccctgagcggagtgacacggagatacacataatcccctgcttggaaaacgagctcccttcggcggttgtctgcatagcttttctgccgagattgcgcgattctcaatctttccctgacagctctaactttttcttctgcctcatttaaagcttctgtaccaaacaactggcgttcccctgtctgatcccagaagagcggagtacgacaccttcgtccatacagtgcttcaaacggtgccatttgcagactagcctggtaactgttgttgtaggagaactcagcatacggcaagcttttgtcccatgctccacccaagtcaagcgcacaagctcttaacatatcctccaatatttggttgactcgctcggtcggaccatcagtctgaggatggtatgctgtgctgaaatttaaaacgggttcccaattttttttgaatttctgccagaactttgaagtgaattggcttnctcgatcgacaccgattttttatgtacaccatggtaacaca

SEQ ID NO: 89326 - DNA, 1013 bp, Oryza sativa
  unsure (1)..(1013): unsure at all n locations
acaccgtcggtttggtttttcaaaacctcctatggcatccaccagaccagaaagctgtttctccctcttcaaatagtggtgcaatgggctgggcactttagaaaggttctcaatgatccgcggttattagcccccatgtcttaagaacttcggatacagagtgactgtcctgggtgggtcccacttggtacccgactccacatttggtgatgccaccgctactccttgagcattcacgatgtggccgagaaactgaacttccttaagccataagtcgcacttgctgaacttggcatatagctggtgctcttttaacttttcaagtaccagccggagatgctgctcatgttcttcctcggacttagagtagataagtatgtcatcgatgaaaaccacgacaaacttgtccagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtcgatcttagagaacactgtagctcctttcaactgatcaaacagatcatcaatccttggcaacggatacttgttcttaatagtgacctcattgagtgcgcggtagtcgacgcacatccttttggctttatctttctttttcacaaaaataactggagcaccccaaggcgacgtgctcgggcggatgtatcccttctgtaactgttcatcaacttgcttcttgacttccgccaactcgtggctcccattctgtaaggccccttgtggatcggtgcagttccaggtaccaagtcaatccggaactcgatatccccttttggtggcattggtgtcagatcatcccgaaaaacccctggatactctctgactatgggaatatcctncaacttcttagtgggtttctncactactacctcttggntcttcacccgcagccttgt

SEQ ID NO: 89327 - DNA, 728 bp, Oryza sativa
  unsure (1)..(728): unsure at all n locations
accccttgcgattgcactttcgcatatcaagaatcaataaatctgtcatggtacgttctaccagggatagcaatttcggtcgtagcctcaagtctcttaccagctcgtccactcggtacatgcaacgtacagggtgtagtctcctccaagtcatcaaagggataatttggttccggttgttgggtctcttcttctgtcttaggcagtagaaaatgtcttatgcaaaaccccatcatttgtttttcaaatttcttacccccttcgtccctcaagctttccttataggcgtcacgtctcttatacgaggaggcgtcctgtttgaacccttctttccaactcagcttagaggacactcctcgaacccgacccccgtgctcccgatttcccaacgcctggctaagcacatctttctccctctgtgggataaattctcctttcttttccttgctagataaatcttctatcttgtcggcaactccctgcagctcggggtcttcaaataacactttcccttccgatgtgatcttcggggtcctttcttttacccaatgcttggattgtatgttccattcttccattggcacaattcgatcaccacctgatgctgtcgccagcaaaggtttcttctggctaaatttcgctgatctgcatgccatcaatnnnnnnnnnnnnnnnnnnnnnnnnnnnnnnnnnnnnnnnnnnnnnngcagtatctcaattnnaacact

SEQ ID NO: 89328 - DNA, 1411 bp, Oryza sativa
ttggttcgggtgttggtctcttcttctgtcttagcaagtaaaaaatgtcttatgcaaaaccccatcatttgttttcaaatttcttaacccccttcgtcctcaagcttttcctaataggcgtcacgtctcttatacgagaaggcgtcttgtttgaaccctcttttccaactcagcttaaaggacactcctcgaacccgacccccgtgctcccgatttcccaacgcctggctaagcacatctttctccctctgtgggataaattctcctttcttttccttgctagataaatcttctatcttgtcggcaactccctgcagctcggggtcttcaaataacactttcccttccgatgtgatcttcggggtcctttcttttacccaatgcttggattgtatgttccattcttccattggcaccggaacccccgccttcttcatttcctcatcctctttattccacagtgcaatcttacgtgcgtacccaccggagcccagtcgatggtgccatttttttcgcttggccaagtcagacaaccttttactcttggccatttcttccggcgaggtcttgaactttacaaatttgtcccattggttcagcgttattttcccatatttcttaaatggtgccttccccttctgcacgaattgtgtgttcagagtgtttttctatccgcgccacgccttgtccattgtttgcaatgcgcaattccttgtcattgcttctgatccctcagggaactagaaccttttcttcatctcatcccaaagagttttcttgtcccctgctgacacactatatatcccagtccttgatcatgactgcgatcttatcgcttactattgcgctacactgaaagctgaactttgcgcgtgcagtggagggcgcgagcggctcaccatttggacttatgtgggtgacaacgtacaacccatcgtctattctattcacgctcctcttgccctttctctttttggtaagctctttggactttgctttcttcttggagttggaggtcgtagttgggacttcatcgagttgggcggcttttttcggatgccatctagatctttgtggccccatttcctacgatattaattaaaaaatggttgagttagtacgaactactatttatcactcgtacagttgcaactcaaatgacattatagaaacctaccactttcttgcgaaggacgtagtcttcgtcgtcttcttcaccatcatctttcgtccgccatttcgggcttggaccaatatgaatctccctcgtcagcttcatcactgtcggacccatcggctggcggcacggtaggttgcgaagcaaccacaattgcttgtgacggctccacgataggctatgacggctccacggtaggttgagaaggctcgactatcagctgtgagtacttca

SEQ ID NO: 89329 - DNA, 1006 bp, Oryza sativa
  unsure (1)..(1006): unsure at all n locations
ccgctcccccttagaatctacgtctnnnnnnnnnnnnnnnnnnnnnnnnnnnnnnnnnnnnnnnnnnnnnnnnnnnnnnaagggttcttacaccttgttgcttggaagagattggattcacgccaattgttgcattccttcgacaatgcatcaatgtttgattcaatggcaaggcgacaagatagagatcgtgccagccgacaggtcagttaatgttgccagtgctaatttagccctttgggatatggatggccttgattgtttatctggaaaagtctgggatggagattttctaaaagtatccgattctgatatacagccaattaaagatggagaacccaagctattattttgagggtgtcgtggagggtttagatgtctacactaagcatacagtagatgatctcgatgacaagcaaggtcaaggtttcatgtcagccgatgatttggaagaaatagacataggtccaggcgatcggccaaggccgacatttattagtaaaaacttatctctggagtttagaaccaagctgatagagctcttaaaagagtttagagattgcttcgctctggagtattatgagatgcctggactcagccgatcaattgttgaacatcggctacctatcaaaccaggggttaggccacgccagcaacctccgaggagatgtaaagccgatatgcttgaacctgcaaagctgagattaaacgattgtatgatgctggttttattcgtccttgctgatacgctgaatgggtttctagtatagttccagttattaagaagaatggcaaggtcagggtttgcattgattttcgagatctgaataaggccactccgaaagatgagtacccaatgccagtagccgatcaattagttgatgctgcttcgggacataagattttgagttttatggatggaaacgnnnnnnnnnnnnnnnnnnnnnnnnnnnnnnnnnnnnnnnnnnnnnnnnnnnnnggccaaaggggtaatcagtccgcgccc

SEQ ID NO: 89330 - DNA, 1134 bp, Oryza sativa
  unsure (1)..(1134): unsure at all n locations
ttaaggtctacatcgatgatgtgatggttaagtctaaagaaataagggcccccatagccgatttaggaaaggttttttaaaagaacaagaaaatatggcctaaagatgaatctgacgaaatgtgctttgggtgtatcggctggcccagtttttggnatttcttgttcttgaaagggggattgaggtaactcaaaggagtgttaatgcgatcaagaagattcagcctccggagaataagacagaattataggagatgatcggcaaggtaaattttgttaggaggtttatttctaatttgtttggaaggttagaaccttttacaccattgttgagattgaaagccgatcagcaatttactttgggggcagagcagcaaaaggctttggatgatattaaggatatcttagctctactcctggtttgattcctccacagaaaggaataccgtttaggttatatttatcggccggtgagaagtcaatcgtctcagtcttcattccggagttggaagggaaggaacgagtcgtattttatcttagtcgtcggctcttggatgctaaaactcggtactcccctgttgagaagttatgcttgtgtctgtatttttcgtgtacaaggttgaggcattatctactatctaacgagtgtactgttatatgtaaagccgacgtagtcagatacatactatcggctccaatattgaaaggaagagttgggaagtggatattttccttaaccgaatttgatcttcggtatgagtctccaaaggcaatttagggacaagctatagccaattttattgtggaacatcgtgatgattcaatcggctcggttgaaatagtaccgtggactttattctttgatggatcggtgtgtactcatggctgtggtatcggcttagtaataatctcccctaggggggcatgtttatagtttgcttatactattaaaccgtatgcgactaataatcaagctgagtatgaggcagtgctcaaggggttgcaactactcagggaagttgaagccgataccattgaaatcatgggggattctctgttagtaatcagtcaattggnnnnnnnnnnnnnnnnnnnnnnnnnnnnnnnnnnnnnnncgagggcgntatagtcgcgt

SEQ ID NO: 89331 - DNA, 725 bp, Oryza sativa
  unsure (1)..(725): unsure at all n locations
aaagagtttgaagcgtttgcctggggtgaaaccaatggtgttcgttctgtatcgctacttcgggctgcagcctcatcaacgtcatcttcaattatttcttcatccagagcttgttcactggatggatctagagcaggtagatcatcagctggtgtagtcttctttgtcttagctgtcttagccggggctgaaatatttacagtcgatgatttgttgtttcttttcttgccagcatcggctggttctctgataagcccttgaagaagagctgaagtcttgggggcattatagccgatgatggggggagatggcccacctccgttggggatcagtcctggggcatactcgatatccctgacgttgttgctttggtgagggggcgaagattctgttgtctgcaaatcaggagaaaggttagctaaggactaatcgaccaagtagttgttcaaataaaatcaagtgagttaggacttacttgagggacaatatttggaaagagatctgtcataaacatggaagccgattggtggaataagtgtagcttccattcaccccaccatctgtcaaatgttttgctcctaaaggttgccagctttatggtgtcaatgctacctagaggaggtccttggagattgagcagccgatccatcattaaagannnnnnnnnnnnnnnnnnnnnnnnnnnnnnnnnnnnnnnnnnnnngcagtctctatttnngacgcct

SEQ ID NO: 89332 - DNA, 5096 bp, Oryza sativa
  unsure (1)..(5096): unsure at all n locations
acgggcgaggagaaaatagctgctgatggtaacgacgttgcggatgatcttggtcagatgttgcaggacgccaggggggactgcgaaagtgaaaaggaggcccataaattgaacaagatgttggaggaccacagaacttcgttgtacccaggttgcgagcaggggcacaaaaagttggataccactctgtagttgttgcaatggaaggcaaaaaatggggttagtgacaaggcatttggcgatttattgaaactcgtcaagaacattcttccgggggggaacaaattgcccgagacaacgtacgaggctaagaagatagtctgcccgttaggactggaagttcataagattcacgcatgtccgaacgattgtatcctatatcgcggtgaggagtatcagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtggaagaaggaaggtgtccccgtgtgggacgaggacaaacaggaggagtttaacctacgagcgctgctgttcgtaaccatcaatgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcccacataaggccgaccaccgtacgaagcataaacatcgcagcgggaaaacagtgtttgctatggttaaagatcttaaagtagtgttcggaaaggggcctggaagccagcatataaaaagcgaagatggtcacgcggcgatgtgaaaaaagaactctatattttgggagttaccatattgggaattcttggacgtacgccacgcaatcgacgtgatgcacctcactaagaacctttgcgtaaaccttcttggcttcctaggtgtatacggaaagtcgaaagataccctggaagcacgtaatgatctgaagcatatggaacaacgcggcgaccttcacccggaaccaaaggagaaaggaagccattacttgagtccagccagctatactcttagcaaggcagagaaggaaagtatgtttgaatgcttggagagcataaaggtaccgtctggatactccacgaatatcaagcgaataataagcacgaaggagaagaagttcataaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacataggcgttctgaagaagtgtgttcgtaaccgtgctcgtccagaggcaagcatcgccaagggttatggaacagaggaggtcattgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcatggctacgacaacatctcatgggtaacaacttgcctttctggtgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttcttccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagtatatgtgatacttacaatttttaaaagttttaaatcacacaggtggcaatttcatatgtatgttaattagagtttttaacatttaatttactagcattcatatgctaattaaaattgactaaaagggacttaagttcattaaatgcactgcacaatgaccatattaccccctaaaaccatgcaaagtggactgcaccatgcccttgttgcagcatgctgtttgctgccgctgctagcattttacaagcaaaccattgttgctgcatgacagcacaaccaaatgcaagccaaatcaatgtttgaccccaacatcacatgatttaatccatcataatttggacaaacacacaccttcagcaagccgaatcacaagcaataacccccacatcaatttcatcatcaatatcacagcccaatcacagaaattcaaagaagctcatatacatctcaagttgttgaaatacatcacagaagtttcaatgttacaaattacaagcactcatggttcaattgacaagttaaaccaaatacaattcacaagaaaaattgaaccattcattacattcctttcaaataccacaatccatcggcaatccagtcccgaaattggttcatgacacgcgagtccaattcgtttgttggttcgctagatggagaagaggttccacccaatggatcataattttcatcatggtcacaattgtcgaactctgtatcagccatttgactgtctctaatgaaattatgaagtgctatgcatgcatggataattctgctttgcttttcctgcgagtagcttggtaaactaaacaaaatcctccaattgttcttcaagaccccaaatgacctctctatgacattccgacaagaagaatggcagtaattaaagtgctcccttcttccccttggcaatgtgctttcgttgtactcttggaaatgatatgttatacccttgtatggtgctagataacccggcctatttgggtatcccgagtctacgagataaaactttcctgaaggtggctttggaaacttggcactaaatctagtttgtgcatcattgaataccctcatgtcatgaaccgaaccaggccacctagcaagtatcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaattttagtggaatttttagagcacaaataataattaagaagaaataaacaaagttaaaatggttttataaaaagaaaaaccctaaaaagtccttttccccccccttcccctcttgggccggctcggcccacctccctccctctctctcctctcccccgcggcccaatcagcctcctccccgcgcgcgtgccgctgacgggcgggcccgcccgccaccctcactgacgggtggggccgccgtcatcccctacctcgcgccgctcccgccgcctcgctcgtgccctagcgccgccgccgccgcgaatcccgccgcctcccgccgtccccgcgcgcaataaagagggggaaatcattccccgtgattccctccctctttccccccacttttctctctctctctccctcggatttgttcggaaacgtttccccctaaacctcgccggcgcatcaatggcggccggatcttccgcggccgattccccctcatccggccgccctctctcactcccaaccctatataaacgctccccgtgcctccctccaccgtttccgccactcgccgctctctctccccgtcggaatcgagctcgcgccgtcgctctctctctccgccgtcaccgnnnnnnnnnnnnnnnnnnnnnnnnnnnnnnnnnnnnnnnnnnnnagctgtctatcggaatccaaanncccacg

SEQ ID NO: 89333 - DNA, 698 bp, Oryza sativa
catggtggggtagttgccttcatgagcccgtagctggcgtgaggcataggccaccacatgaccatcctggaaattttttggggaaaaaagggcccaaaccgggccaaccccccaattcctttggcggcgaagcgtcacaatacaccatgaaatccttgcgagtattcggcaagattaacactggcgaggaaaccagcttttctttgagagtttgaaacgccttctcgcattgggggctccacacaaatttctctctttttttcaacaactgtgtcatgggtcgagcgactttggagaagttctcgatgaacctccggtagtatcctgccaaacctaagaaactgcgaatttgagtgactgtcttgggttgcttccattcagtgacggcggtcactgtttcggggtccacagcaactcctttagcagatatcacgtgccctaagaatttgacttcggacaaccataactcacacttgctaagtttggcatacaattgatgttcccgcaactttcccaataccagacggagatggtgctgatggtcttcctctgattgtgagtataccagaatatcatcaatgaaaaccacaacaaacttatccaagtattccatgaacacttggttcattaagttcatgaaaaaggcaggagcattggttaaaccgaacgtcatcaccgtgaattcatacaatccgtat

SEQ ID NO: 89334 - DNA, 2085 bp, Oryza sativa
  unsure (1)..(2085): unsure at all n locations
acgcgcaatagatacccgtcctnnnnnnnnnnnnnnnnnnnnnnnnnnnnnnnnnnnnnnnnnaaggatcccaagggcttacctccaaggaggaattgtgatcatgtgattacacttaagagtggagctgaaccacccaatttaagaccatacagagtacctcattatcagaaggaggcaatggagaagatcatagctgaactaattgaatcaaaggagattcaggtcagtgatatcccatactcatcacctgctgtgatggtgaggaagaaggatggatcatggaggttatgtgtcgactacagacaacttaatgcacaaacagtcaaaaacaaattccctatgccaattattgaggatctgttggatgaactcaatggggccaaagttttttctaagctagacctcaggtctggatatcatcaaatcagaatggccactcaagatataccaaagactgcattcagaactcacttagggcattatgagtatcaagtaatgccctttggcctgacaaatgccccaaccacttttcagtccctaatgaatcaggtactggctccattcttgaggaaatatgtgttggtgtttttcgatgatatcttgatctatagtaaggactgggcagaacacaaggagcacatcaggcaggttatgaaggtgttggaggaaaataaattagtagttaaacttaagaagtgtgcttttggcctccctagtgttacttatttggggcacatcatatcgcaagatggagtggcaacagatcctaagaaagttgaaaagatagctacttatccaactcctaagagtgtgacagatcttagaaaattcttggggatgacaggttactataggagatttataaagaactatgggatagtgtgcagaccactgcatgatatgctcaagaaggaaggctttcaatgggaaagggaacaaactgaagcttttgaaactctaaagacacatatgtgcactagtccagttttgagtctgcctgacttcaccaaagagtttgtgattgaggccgatgcttgtggcaatggtataggggctgtccttatgcagtctggtagacccttggcctatttcagcaaaactctgggacctaaagcagctgctcaatcgatttatgaaaaagaagcaatggcaattctagaagctttaaaaaaatggagacattatgtgttaggcagtagattaatcatcaaaacagatcagcaaagcctaaaatttatgatgaatcagaggctagttgaagggattcaacacaaattgttgctcaaactgatggagtatgactactcaattgagtacaaggcagggaaagaaaacctagtggctgatgccctgtcaaggattccaccagctgaacagtgccaggccataactactgtgatacctgaatgggtgagggacatacagaggagttatgaaggagatgtgcaggctcataagatccttagtttgattgggacagagggtgacacagatgggagctatagtcaggaagctggattattaaggtataaaggcagaatttatgtgggggagaatactgaaatcagggaggagctgataagatcatatcactcctctgcttttggtggacattctggaatgagggcgacatatcacaggatcaagtccttgttttactggccgggtctgaaaaagcagtggaagggttcatccgagagtgcccgatttgtcaggtaactaaggctgaacatatccacattcctggactgcttgatcctttagaagttcctgatatggcatgggctcatattaccatggatttcgttgaaggactaccaaaatccaatgggaaggatgtaattctggtagtggtggacaggctgacaaaatatgcccatttcatagcaatggcacacccctatacagtggagcaagtagtggaattgttcatgaacaacatacatagactacatggaatgcccatggccatcataactgacagagaccggatttttannnnnnnnnnnnnnnnnnnnnnnnnnnnnnnnnnnnnnnnnnnnnnnnnnnnngtgcatggggaagtgcatntcaaggagcggg

SEQ ID NO: 89335 - DNA, 896 bp, Oryza sativa
  unsure (1)..(896): unsure at all n locations
gtgtgnaatgataatgcctcgccnnnnnnnnnnnnnnnnnnnnnnnnnnnnnnnnnnnnnnttgcttaataattatttccggtgctctgaaaattcaagtaaaatttgaggactccttttagaccaaggagaatttaacaaaaattctccgggccacatttaaatttttcttgtacgtattttaatgtttgccaatttctttttcgaattttaattaattctattattccttttagcgaatgaattttaattttgggatgaatttatcaggacgtgacaacaattgatgttcccgcaactttcccaataccagacggagatggtgctgatggtcttcctctgattgtgagtataccagaatatcatcaatgaaaaccacaacaaacttatccaagtattccatgaacacttggttcattaagttcatgaaaaggcaggagcattggttaaaccgaacgacatcaccgtgaattcatacaatccgtatcgcgtggtgaatgcggtcttcggaatatcttcttcacgaatacgtaattggtgatatccggaacgaagatcgatcttggagaatacagtggcacctttaagctgatcgaacagatcatcgatccggggaagagggtacttggttttgatggtgacttcattgagagctctgtagtcaatgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtacagaggagtggtttcttgagcaagatctattcggaactcaatctctcgtttgggcggcataccccggtagtctt

SEQ ID NO: 89336 - DNA, 844 bp, Oryza sativa
  unsure (1)..(844): unsure at all n locations
agctgggatcgttatatcattgcgccctgcaannnacnnnnnnnnnnnnnnnnnnnnnnnnnnnnnnnttcagtgactcactacgttggttgctgcgcatacccaacaagtatttcccatctgtataggcagctgcccatttctcccttagtcggtacatcagagcgatccattgtccatttcccgtgcctccattctccttaaaatcagcccaacgtctctcgaactcctcttcatccatactctcataaattaattttcttagctcgtcgagttttggcttacgaaggtgacgactcatattctcctctatatgccaagtacacaatctatggtaagcacccggcattaccttactgatagccttcgccattgctaggtcgccatcggtaattaatgattttggatgcacttgacgcattgcctccaaaaaagtctcaaggagccaacagtaagagttgacagactcatttgatagaattccgcacccaaaaattgttgtacttctgtggtggttaactcctatgaaaggaatgaaaggaagattgtacttgttcacacggtaagtgctatcgaaaataacaacaccaccaaaagcagcatagtctaaacgtgattcagcatctgcccaaaacacattcctaagacgcccttcctcatccgtggtgtatttgaagaaaaattctgcatcttcttcttgcttccttgttagatatttcaacacatcttcagcatcatgacccttgatattcttcatgtcgtannnnnnnnnnnnnnnnnnnnnnnnnnnnnnnnnnnnnnnnnnnnnnnnnnnnnnagccataggtncttcattggcacagct

SEQ ID NO: 89337 - DNA, 1082 bp, Oryza sativa
  unsure (1)..(1082): unsure at all n locations
ggagtttatccccattgactcctctcatttccccataattttccccttgaatggtgcccccaatcgccgggaacggccgcgccattcccggccgccttccattgccgcaggccggctttcccgccgccgttccgacctcccccgtggccggctccctcttctctcatataaaataggatccccgcactccgttctaccgttttaaccccatcccgagcctccccggggtctctagccccatccccgccgtcgccctctctctcccacgccgccggcgacctccagccgcctgtgccgcctcgctcgtgcgccggccggccgcgccatcgcctcctccagcgtcgccgccacctcctccacgccggcctgccctccgtttcgcgaggagacccccggaactacgttcccgccgtcgccctcctctttcattcgcgccggccacctccagccgccttcctctcctcgcccgagcgccgcccggccgcgccgtcttctccctcggcctcgcagctgcctcctctttcccgacttcgcctccgtttcgcggggaaatcaccggagacgcgtcctcaccgacgactagtggtgtcgccaccactccaccatctccagccgtcccggccgcctcgcctgagcgtcggccgacgtcaccgtctcctccctcggcgtcgccgcatcgccctccaccccggctgctcctcggttttcgccggaacgccgtcgccgcgccggtctctccatcctcttcgtcgccggcgtcctttcggccggcccttcctcctccccggctcgtcggcttgctgcaccactaccacctccggcatcgcagcggcaaggcccgcctcggcatcgtttcccctccatccaaacccctccgtggtccatcatcatcgtctccgaccgttctcatcgtcgacgtcccgtcggtcgctcggctcgtcgtctcgcggcgccgccttcgtcatcgtcatcgtagcggcgtgttcctcgtcgtcctcgtccccgtgcagccgctgccggctgtcctcgtcaccttctcgccggtcccggacgtcgacgtcctcgtcctctcgtcngtcccg

SEQ ID NO: 89338 - DNA, 912 bp, Oryza sativa
  unsure (1)..(912): unsure at all n locations
gcgttccagttagcnatgnnatgaacaacccctgcttttggtctnnnnnnnnnnnnnnnnnnnnnnnnnnnnnnnnnnnnnnnnnnnnnntaaagctgcagccatacagacaaacagcttttggaattcgcggtgcacttaaattacgatccaagttctatggacctttcaagatcatggagaaagtaggaagagtggcatataaactgcaattaccagaagggagtaacattcatcctgtgtttcatgtaagccaattgaagaagcacattggttctagagctgtaccaatggcgaatttgccttcagttggtccggacggacagatcaaaactgaaccggtggctgtgttgaaaagaagaatgattcccaggggaggagttgcagtaacacagtggcttgttttgtggcacaatctaagtccatcagaggcaacatgggaagatgcttcgatgatacaaagtatgtttccgtcttttaatccttgaggacaaggatcagctcaaggggaaggtaatgtcaggaattggacaggagaaatggagattctgaaggatgcagaagttaactaaacttttattcagtaaatttcgtttagtgttactggaaggactgatctgatgaagattggacggcccaggagacacttgaagcgttatgaaggcaaatcccaccgtccatgtttcccatgggaccactgtagacgtcatcattggcgttttctctgaattttactctgtttttccgctggaatgcaagctgtcatcgcaactcatgtaaacctttaataatccgggggaatgagagaggaatatattgaggaccatattatactttgtctagacttattgtgagggggaccccacaagtttgtcgccgtcactaaatgagagctttcttcgtgagaacaat

SEQ ID NO: 89339 - DNA, 712 bp, Oryza sativa
  unsure (1)..(712): unsure at all n locations
ttgcccgccaagtggtgcctccgcatacacggtgggcctattatgccgccgttgtgggggtccagaacttcaccgcgggcccgcctccgtcgccgcngattgaagtcctcgcctatacggtcggttggtcacaccaccgttgatgggcatcgtcatttacaccgccggcctgcttccgtcgccgccgactagtgtcatcgcctatacggttggtcggtcacaccaccgttcatgggcgtccatgtcttcaccgatcggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcctgcacggctggcctattatgctgccgttgttgggcgtctacgtcttcaccgaccggcccgccttcgccgccgccgactggtgtccacacctgcacggctggcctattatcacaccgctgttgggcgcctacgtctacaccgccggcctgcctccgtcgccgccgactggtgtcatnnnnnnnnnnnnnnnnnnnnnnnnnnnnnnnngggtcggtcggacgcnatatccaaannncacac

SEQ ID NO: 89340 - DNA, 724 bp, Oryza sativa
  unsure (1)..(724): unsure at all n locations
cactggctttgtttgcatntccnattgaagaacctctgctatgcactgagagatcccctcataatttccccaaagcgtaaccatgtgtgaataaattttgagctagtagggttgcagccacgagtaagtcttcccttggtattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcg

SEQ ID NO: 89341 - DNA, 1602 bp, Oryza sativa
  unsure (1)..(1602): unsure at all n locations
aaccatatggacgaaaatcgggtatgcgttccagataacagagaacttaacaagctgatactcaggaagcccgccccccggaaaaaaaaaaaaaaagggtttccccctttttattttccatccacccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtaattgtggatcgactaaccaaggtagctcgatttattcctgtgaagaccacctatggaggaaataaactagccgagctctacttcgctaggatcgtgagtctccatggcgttcccaagaaaatcgtatctgataggggaagccaattcacctctcacttttggaagaagctccaagaagagcttggtacccgactaaatttcagcaccgcctatcacccgcagacagatggacagaccgagcgtctaaatcagatcctagaagatatgctccgcgcatgtgtcctagatttcgggaagacttgggataagagtctcccctatgccgagttctcctacaataacagctatcaagccagcatacaaatggcaccctatgaagcgctgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgtggagaggttgcttaccagctggagttgcccgcttccttgggtaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggagnnnnnnnnnnnnnnnnnnnnnnnnnnnnnnnnnnnnnnnnnnnnnnnnnnnngggcatatcgtncatcattaaannnnttctcacc

SEQ ID NO: 89342 - DNA, 1215 bp, Oryza sativa
atgatcctcccccttgtgcacaagtttacattccacaaacctaccgtaacgctatcatcggtaagcatggccggggtacaacctcaggaactactgcatatcagtcaacctctctgggccaaggtactgccctttcacagccattgtcgacatatgcaccaactatgtcagtgacgatgcctcctgctggaaggaatgatcagttttctggtaggcatggattggagtctgggttgggaaagccagaagcacgtgatagctggcaaccatggaatgctaacaggcatgttgacaaacatctctggagggatgactcgacataccaacaaacaaccaacggtcatgcatatccgcaaccttggaaggatgttaattttcttcaagcaaggggcacagaaacagaaatacccagcaggtttggaggaccgcaactacctaggcagttccaagctgagactcatgcggattatctcttgcaacaaccacaggggccagtggcagaagaatttccgcaccttgacatcataaacgatttgcttgaggaggaacagagcaatggcagtatgccagagtccattggtcatgattaccatacatttggtctgccgttgccgtttttgttaagaggcaatttggcagatcaggaaatggcttctgctagcagtcctgggcggtttaatttgactgagccatattacgacgagggatactcaagggcctatgacatgagtgctttccaggggacaagggaaagacaatttccctccttggatgcctattctaatggcctgtctgacatgagtccatcaaagccttggctgaatggctctcctaatccatcgatgaaccatgcagttggtacaaatggatacccccagcaaataccggactacaccaatttggctagtgagttgaatggagcctctctataccatcgccgctacgccaacggtcgctggtaacgtgatgacgcctgtatacagtcttgcaatcaaaaaaaataatgcttgttacctgtaatagatgttcagtctgggtctgagccgtgtcatggcctgtaattccaaacttttaattccaaaagggcaaagggttgcattctgtaaagcgttcgccgtgtttaggctggttaatgctaagtcgagtgcttttctgatcaactgtgtcccgttttcctaatggtcttttgagaagaaatactgggaaccgtgtcaa

SEQ ID NO: 89343 - DNA, 3500 bp, Oryza sativa
ggagaatggaccatctctccgcttacgaagaaaactgtttctgagcctgaggttaatgaaggtagaggatgatgaggaggattatgccctttttgtactgtgttcatgccctagctcaagggcggcgtccagggaagctattcttataggtggtaatctctacttataaaccaggtttatggtgctttgcatcccaaccgtagagaaagaagattggccccctctgaaggttcaaattcacaagcagaaggcttggttgttcgggccaggcaacaggagaagaacacaaacagcaaatcaagagataaaggtgcaagtagctaccgtgggagatcaaagtccagaggcaggtataagtcatgcaaatactacaagagagatggacatgatatctctgagtgttggaagctacaggataaagacaagagaaccggaaaatatgtaccaaaaggaaagaaagaagaggaaggtaaagccgcagttgttactgatgagaagtctgatgcagaattgcttgttgcttatgctggttgtgcacaaactagtgaccagtggattcttgatactgcatgcacctatcacatgtgcctgaatagggattggtttgccacctatgaagctgtgcaaggtggtactgttttgatgggtgatgatacaccatgcgaggttgcaggtgttgaaacagttcagatcaagatgtttgatggttgtatcaaaacattgtcagatgtgcggcatattccaaatttgaagagaagtctcatctctttatgtactcttgatcgcaaagtgtacaaatattccggtggagacggaattttgaaggtaactaaaggctcttttgttgtgatgaaagctgatataaattctgccaaccctgtcccatgtgcgagggacaactatattaggtaatattgctgcagtttctgattcattatataattccgatgctactaatctttggcatatgcgtcttgggcatatgagtgaaattggtttggcagaattaagcaagcgaggattgctagatggacaaagcatctggaagctcaaattttgtgagcattgcatctttggcaagcataagagggtgaagttcaacacatctacacatactactgaaagtattcttgattatgtgcattctgatttatggggcctgctcgtaagacatactttggaggtgctcgttacatgatgactatcgttgatgattattcgcgaaaagtttggccttatttcttgaagcacaaatatcaagcttttgatgtgtttaaagagtggaaaactatggttgaaagacaaactgaaagaaaggtgaaaatccttcgtactgacaatgggatggagttctgttctatgatatttaaatcatattgcaagtctgaaggcattgtgcgtcactacactgttcctcacacacctcaacaaaatggcgtagctgagcgtatgaacaggataattatatcaaaggcctgttgtatgttgtctaatgaaggtttgcctaaatagttttgggcggaagctggttccactgcttgttatcttatcaatcgatcacccagatataccattgataagaagactccaattgaggtatggtctggttccccagcaaattattcagacttaagagtatttggttgtactgcttatgctcatgttgataatggtaaattggagcctagagctattaagtgcatttttcttggttatccgtctggtgtgaaagactataagttatggtgtcctaaaaccaaaaaggttgtgattagtagaaatgttgtcttccatgaatcagttatgttacatgacaaaccttctactaatgttcctgttgagagtcaggagaaagcaagtgtgcaggtggagcacttgatcagttcagggcatgcaccagaaaaagaagatgttgctattaaccaagatgcatctgttattgaagattcagattcttctgctgttcagcagtctccaaaacgttctattgcaaaagataagcccaaaagaaatattaaacctcctcgaagatatattgaagaagcgaacatagttgcttatgctttgagcgtggcagaagaaattgaaggtaatgccgaaccttctacatattctgaggctattgtttctgatggttgcaatagatggataactgctatgcatgatgagatggagtcacttgaaaagaatcatacttgggaattggtgaagttgccaaaggagaagaaacctatccgttgtaagtggatcttcaaaagaaagaaaggtatgtctccaagtgatgaggcaaggtacaaagcaaggttagttgctaaaggttatagccagattccaggtattgatttcaatgatgtcttttcccctgttttgaagcatagttcaattcgcactttactcagtattgttgcagtgcatgattatgaactagagcaaatggatgttaagactgcatttttacatggggagttagaagaggacatttatatggagcaacctgaaggttttgttgttcctggaaaagagaacctagtatataggttaaagaaatctctttatgggttaaagcagtcacctagacagtggtataagagatttgactctttcatgttttctcagaagtttagaagatccaattatgatagctgtgtttatcttaaagttgttgatggttcatctatatatttgcttctttatgtcgatgatatgttgattgctgcaaaagataaatcagagatagaacagttgaaggcacaattgagtagtgaatttgagatgaaggatttgggtgcagcaaagaaaattctcggtatggaaattactagagaaagacattctggcaagttatatcttagtcagaaaggttatattgaaaaagttcttcgtcgtttcaatatgcatgatgcaaaaccagtgagtactcctttagctgcacatttcagattatcttcagatttatgtccacagtcagattatgatattgagtacatgtctagagttccttatttaagtgtagttggttcacttatgtatgctatggtatgttctcgtcttgacttatcacatgcattgagtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattga

SEQ ID NO: 89344 - DNA, 1696 bp, Oryza sativa
  unsure (1)..(1696): unsure at all n locations
tagattccaatgatccattcatttttggactctgccccacctgtatgtttatttatcatcatgatgcctgctaaaaaaagatcttagaatccttttctcttataacttgggtgataaatcttgatgaaacctaagtgacttatgatgttttctttgaggacactgtttgtaatttcactgacttaaatttccaaaagcagtatcatcttccagtcagttgagtcttttcaagaacagatcgaagtccataaccataagatttgctatccttagaatgaagcaactatccctggtgtacgtacagtagaaacacacacacacacacacacacacacacacacacacacacacagagagagagagttgtgcctccagttccaacttccaaatgatattcttcattgtgcactaatgagatgttaaattaaagttccattgcttctgaacgaccttacaaatgaatttactgtttagagccagtttaaggcattcttcagattatgtgggaatctgtgtaagcttctactgccaaaacagctgtgcaagtgtttaaatatatcgttttagttgagccttgtgtctttgatagttatattgattcttttttttttgtaaaacagataagaatcctgatattaattattgttcttccagtactacagtgttcaacgttagggaattatcttaaactggtgctctggtaaaattcgaaaggtacatatggctatgtgcctcataagaaactcctcaggcaatagggatgattcttgggagaaacaaggattttgttcctaaaagtcactcatttggtcttgtatagttgtatctaggtcatgtttcctcttgtttaattccctcaggtttcctcttgtttaatgctttctacatgattcttgaaatacatttttcacttttaactgctggttctacctcattttcagtggtaaaaccatgccagtacttccagttaatgtggtttggattgttgtttaagtgcttgttggagcttctcagctacaggtgccatggagggaataaacaagatcaagacaggttctctgatcagcctttccgaacaggaactaatagactgtgatagatcctacaatagtggttgtggtggtgggctcatggattatgcttataagtttgtggttaaaaatggtggaattgacacggaagcggattacccatatcgtgaaacagatggaacatgtaacaagaacaaggtaaaattgaaatgtgtacattcaacaaatgttgagataacctctgcctgccatactagtacaataatttgtctgcttaaaatgcagctcaaaaggcgagtggtaacaattgatggctacaaagatgtgcctgccaacaatgaagatatgttacttcaggctgttgctcagcaacctgttagtgtaggaatatgcggtagcgctagagcatttcagttgtactccaaggtaaatagtgcataatttgttggtttatcctctcatgaacagatgtatgtattaccaattttaaacatttttgtacttgccttttaatattttgttatgcagggtatcttcgatggtccatgtcctacatctcttgatcatgctatattaattgtgggatatggttctgaaggtgggcaggattactggattgtggaaaatttttgtngtgaaaagtggngtatgaaaagctatatgtt

SEQ ID NO: 89345 - DNA, 741 bp, Oryza sativa
  unsure (1)..(741): unsure at all n locations
gcggccatgaatgcaatganatcgcctgcgacgatgctccttagactcgagaattcgtacccccatttttgctgtgtattttaataagagtctgtgctttattatttgtagttgaatacattatgtgaattagtgcaccgaatcatgggcatgttttgtatgtatctattgtttgctatgaatgcactacccttctgtaaccggccaatgatcaggctaggactggtactagcgtcatagtggcgtctatgttagttccatttcgtgaaaccttgatttatgcttctgtcattgcttgaagtccaaccatgtaatttaatttttcaaacacccaaccgcaaccgctgacattttcatgaattgcttcggtgcttgctcaaaatcgatggcaaagttggacgaagagtcggaggagctgcaccagaagttcctggagaagacattgaccttccaacctttggtcaaaagtacaaaaagcttcgggccggctaccacaagcaagcgttgctccatcttgcccgcaagacctcacttcgttgaaatccattcgcggtctgtaggacgaacaccctgttgtatgagtttcccatttcttcatcattctatccttgtcgtggtgtctgtccacttggcttgttatcagtgccgctttaatattgtagggcttgtgaaaaccgcagggttgattgcatttgtaatatacgattgtattcgcatcatggaaatttatgtatgatcatt

SEQ ID NO: 89346 - DNA, 1252 bp, Oryza sativa
agtgttgtcagtagatacatggctaatcctggcaaagagcattggaaagttgttcaatggattttcaaatacctacgtggtacatctagtgcttgtttgcagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagtagagtatatggctatttctgaagcttgtaaagaagctatttggcttagaggtttgtacactgagctttgtggagttacgtcttgcattaatatattttgtgatagtcaaagtgcaatatgctttacaaaggatcagatgttccatgagagaacaaagcacattgatgtgagatatcactttattcgaggtgtgattgctgaaggtgatgtcaaagtatgcaagataagtactcatgataacccagctgatatgatgacaaagccagttcctactactaagtttgagctttgctcaagcttggtgggtgttacagtatagtcctagagactatttggcgcgcggtgattttacctacatgaggtatttttggtgattgatatttttatgctacaagaggaaattcatctcaaggtggagattgttaaatatgtgatccgaattttgggtccacaatatattcggattagttttctagtaggagccctattaggtgcctttcttttatcccctatatatactcttgtaagtcatacgggaaggggtgacgttcccattgtgatttccctatgtttataatcaactcctctatagtgatcattgccggtcggcgcccgtggtttttttccgcaaggattttccacgtaaaattcgtgtctccattgtgcatctatttccataataattttgtcaaaaatatattgtttaacagtttgaaaagtatgctaacgaaaaaacgaaaaagttgaagtttggagttgatcagaaaaagaattgggcataggcaaacccgcatccgcagccgtgcatgtggtggcgcggcatcagggcaccacgccggcgcttaaaaagatcgtgttcagcaaatcatcgtcgcaagacacacatatgtgatcctctcgaaatttgggttgatcctcagatttgttgtgaggataaaaaaaaacatttcgacagtgaatatcttaattgggatgtgcttcgatta

SEQ ID NO: 89347 - DNA, 1160 bp, Oryza sativa
  unsure (1)..(1160): unsure at all n locations
aatatccttttcgccaagactctggacgacatgcaaatccctcgcacggaattgaagccaagtaatgcgcccttccacggagtcattcccgggctgtcttctactccactcggctagattactctgtcggttactttcggcactcgagagaactttcgcacagagaatatttgcttcgaagttgctgattttgagacagcgtaccatgccatactcggacgcccggcgttagccaagttcatggctgtcccgcactacacctacatgatgatgaaaatgccaggtccccgaggagtcatatccctgcggagtgacatcaagcaagctgtcacttgcgacaaggaaagctgcgagatagcccagacccgcgagattgcgctcgctcgagaagaaattcgactggctgcgttcacactggcccctgtggttgttgcaagagataatccgcatgagtctcagcttggaactgcctaggtagatgcgggtctccaaacctgctggggatttcttgtttctgtgccccttgctggaagaaaattaacatccttccaaagttgcggatatgcatgaccggtggttgtttggtggtatgtcgagtcattccctccagagatgattgtcaacatgcccggtagcaatccatggttgccagctattacgtgcttctggcttttccaaaccagactttcattcatggctaccagaaaactggtcattctttccgcaggagggagtggccctgacataattggggcatatgtcgaccaatggctgtgaaaagggagaccccttgcccacacgaggtgactgaattccagaattcctgaggttgtcacccgccctgcttacccaagaatacggtaccgaagtttgtgggaagtaaaccgggccacaagaggaaggaacatccctgaactcnggttggtccactattgaggccaaacaatgtgaaactctccttttatatgggccaagtgttttgggccggaaacagggcacctaaaggtttggtttggcagcactcaaaaatgggggaggccctcttggccgctcttttgggttaaatatgaggtgaatttgggcatttcaaaaagaaaactttcacctggtatttggggcggcgaggttacatttgggcccctgagagggatctttcctcg

SEQ ID NO: 89348 - DNA, 740 bp, Oryza sativa
  unsure (1)..(740): unsure at all n locations
cgcgtcccgggtgaagcannnnnnnnnnnnnnnnnnnnnnnnnnnnnnnnnnnnnnnnnnnnnnnnnnnnnnnnnnnnnnctaggatttagtgatcaataatctgccttcttgcaggtgcaaactgatgctgaagagttactcataatcaagactagagaatctcttctagatgccttgactgaacatgtcaaagctaaccatgaatacgagtaaacttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatattcaacaacatgaagtaactgatcggatgttctctgtttggcctatgtatcacagtgacatttgctgcaaggaatatatgtgtggttgccatcttgtgaggtctgatgaagtactggngtctataattctgcttacaataaaaaatggattagtactcatacttgtgaattgctgcccttgattgggattctctatgaagtttttctagcgatgcaatgatgag

SEQ ID NO: 89349 - DNA, 746 bp, Oryza sativa
  unsure (1)..(746): unsure at all n locations
ccgcgcctttgttgttatacaaccntcnnnnnnnnnnnnnnnnnnnnnnnnnnnnnnnnnnnnnnnnnnnnnnnnnnnnnnnnnnatggcgctgctcttccaggccgggagcttgtacaatggcgtcttctcctactgccttccgggctacaggtcatactacttctccggctcgctccggctgggcgccggcggcgggcaaccgaggagcctccggtacacgccgatgctgaggaacccgcacaggtcgtctctctactacgtgaacgtgacggggctcagcgtggggcacgcgtgggtgaaggtccccgggggatcaggcaaacgaacaaaccaacagtcaacggtgcaggacgctactgaaattcagcacgaagatcgtcgtccatccgtggcaagcatcgttccccgccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagt

SEQ ID NO: 89350 - DNA, 1232 bp, Oryza sativa
  unsure (1)..(1232): unsure at all n locations
cgccttgattgctaatctgcctgcgannnnnnnnnnnnnnnnnnnnnnnnnnnnnnnnnnnnatgtcgagggaagttccttagtgccatatcaatatcaccatgctccttgtaatgttcacccaattgttcgcactgacagattagctacctgataacttgaacttgagctatgatttcaagaacatcatcaacaagaaagccatcctgaatcttcgacaacttcataaattttttccatccccaatcatgctccttcttccagaacttatgcaaagtatctacaaaatttacttaagacctgaagctcaagaagataagaatggtagcttcctaggaagagaacaagccaaattccactcaccggagtattttactttcttaggatctatattgcctacagctatagtgaactgcgcaaaatgactccaccctgaaagtgtaatactaatatgagatattaggtccatggtgcaccattagatagcagcaaagactacaaaaaccaaacctgggagaagtttgtcatgattagcaacacagagaaaaagtgataggtggttggaaacatcacatncttggaggtatacaagaatatacctgaaaatagcagccggacaaagtagggataagtaattgggcgtatataattaccaaatttaactgggaagagacaaggagcttttagaattggtctatgggccttagcaagaatccttgagccaacaatatttggtggtcatgtaagccaaattcctatattaatattacatggttgaccaagatgccagatggtatgtgtacaggtggttcttttttttttacataaaagcttaggcgagataaccgtggtaaaccccaaaattatttaatgaaataaatggtggcaattagaaaagtgaacctacaggttcccaattgtggtggggaacataggcacagaaagcgacttgttttcaaaacttgggaaaactttttaatttgagaaaccgagaacaatttttatgcgccaaatggggggggttactttctccatatcaaaattttttgaaaaagtcttaacaaaattttcgggttgtttatttgtttgcgggaaagaaaccggggaggaaatggcaacccttctttggcccaccaagggaaaaagagttttgtaaaaactcgtgttcggaaaggttttaaaaaaacatcgggcntttttttgggaaagaggctcggggatttcccctttta

SEQ ID NO: 89351 - DNA, 1003 bp, Oryza sativa
  unsure (1)..(1003): unsure at all n locations
cggagtaagagcctcnnnnnnnnnnnnnnnnnnnnnnnnnnnnnnnnnnnnnnnnnnnnnnnnnnnnnnnnnncgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccgctacgactaccgcaacctcgacgacttcgacgaaggctatgaagataactacacgccccctctacttcggcattttcatggccgacaacgagacggaaaaacagcgtcaagcccgagaagaagaagaacaacgcgtgcgacaggaagccaaacgtcgccgactggaggaggagcgccaagcacaagagcgagaacggctgcagcgtgagcaacaggagcgcgagcgagctgcaaaggaggcttggaggccgggcgacgagcacgagaactcatcgggcaacaagatgtcgaggggacggcggtttttcgcaccccgcttcaacatcctccaagcctttgccactcccttcgtcgctgtcctgatttgtatctattaatcaactcgtatgatctcttgtttggagttctttttgtacaaatatttttgtaggagtatcatatatttacagaatctctcctcatttaatgttgtgttggatctgtctccttgaagtgcttattggttgagttgaattatttattctattgactggttattttcttcctatctgatcaaacctttcactggatcaacttcagagctcaaaatggatattttagcagaaacagcacatttgaagtcaaagcaattagatttagatgataggcatgtgcttagnnnnnnnnnnnnnnnnnnnnnnnnnnnnnnnttcgaagcgatgagtcatcatgggcg

SEQ ID NO: 89352 - DNA, 725 bp, Oryza sativa
  unsure (1)..(725): unsure at all n locations
gcgcggtgaagaacctctnnnnnnnnnnnnnnnnnnnnnnnnnnnnnnnnnnnnnnnnnnnnnnnnnnnnnnnnnctgaatcattcactgacaaaatcctacagaccattcctattggctatagttaaacacttaactcaactagaacacctatttgcaagcatccaaaatgacagaaaattatagatctcgaagttaccatgcactgatatgctgacaagaactttttcttttgtgattgccaacccccattctccaatgcctcttactattaaggctcctaatttcctagtgtcacccatcttcagtaggacgaagaagtgaacagaaacaaggccagtgcaataaggttttgatttatgaatgtctgctaagcaagtccaatataactatagctaacgtgggttgtaacaactaacaaatgttgaggtacatcactttctgaaaattgaagtattgaaaacaggatatagcacattaaaggcggaaaacagttgatcatcgaaagctcataaaaaagggacttacagcattcattgctgcaactggcacccatccaccatgctgctgctgggcaagatcaagcattggaataataccagactgcttgtagttgcttggatagtgagacaatatctcattaacctgaattaagtattgaaatagagattttaggcccgataaccaaaatagctgataccattgatataaaccgtattcacaaa

SEQ ID NO: 89353 - DNA, 528 bp, Oryza sativa
tcgtccaaaccgcaataaatgtggttaggtaagccccgctatgctcacctgccccatatacacggcgcaaaacccacaaggggtcggggcgcctcggccctcggggccgggacgggagcggcccgacccctcggggagacaaagagaagggcggccgtatcaccctcgggcccgaccccccccccccccgagggggttaggccacgtgggtgatcgtgtctgcctcaagtctctaagtcatgatactcccggtgccacgtgggtgatcgtgtctgcctcaagtctctaagtcatgatactcccggtcccatgtcaccgacaaccacctaacatctttgtcgtctcccttgccctgctctgccttctccctatctccagtggttatcgcaggcggataagctatggtcgctcaccatcttatgatccagctatttttttaggccctgtttaattctaaagtttttttttttaaacttccaactttccatcacatcaaaccttttatacatatacaatttttcagtcaca

SEQ ID NO: 89354 - DNA, 1900 bp, Oryza sativa
ccgtcaacctgagcgagctgctgtcggcgcacgccgccgactcgtcggtgcgcgccatcatgggcgatcggttcagggaccgcgacgcgttcttggcgatgctggagcgcggcctcaagctgttcgccaagcctgcactgccggatctctacccgtcgtcgcgcctcgccatgctcctcagtcgaatgccgcgtcggatgaagcagcatcaccgggacatggtcgcgttcctggacgccatcatccaggagcaccaagagaacagatcagccgccgccgacgacgacaacgacttgctcgacgtgctcttgaggatccagagggaaggcgacctgcagtttcccctgtccagtgaaagcatcaaggcaacaattggagtaaggaccttttaactacgaaataccacgtcactttctaggaaatgtaatactacttgcctcaatatatagcaatctagaaccgaatatgatacatcctaatgttataaatctgaataggcctatggtttgaaacggaggtagtaacgctaatgaatttggcttcgtgttatgtgtgtacaggacatgttggttgggggcagcgagaccgcagcaacgacgctgcattggatcatggcggagctcgtgaggaatccgaaagtgatgcagaaggcacaagatgaagtacgacgagagctcatcgggcatcgtaaagtgacagaagataccctatgtagactgaattacatgcatatggtcatcaaggaggcactccggctacacccaccgggatcattgctgctaccacgggaatgccgacgcacgtgccaagtcctaggatacgatatacccaagggagcaacggtgtttgttaacgtatcggctattggtagggatcccaagtactgggacgaagctgaagagtttattccagagaggtttgagcatagtgatgttgactttaaaggcacacattttgagtacacaccatttggagcaggtcggaggatgtgccctggcatggcgtttggtctagccaatgtggagctcacattagcgagcctcctgtaccatttcaactgggaactgccgagcgggatacacgctgagaacctagacatgacagaggagatgcgattcaccacgcggcggctccatgaccttgtccttattcctgtagtccacgtacccttgcctacaatataagctcatcatagcacactgatttttgtacaacacttaagcaatctttttgactggcaactcaaaggtgcaaccacctatggtgaagcttgaggctatatgtgaaaaataaattttcataagcggcttcttataagatttccacctacactaatcgtactttgatatgcaccttatcatgaaatgtatttggaagctttgcttgtttgatgtgattgttatgttaaactttttcttgtaatttctttgtggaaattttgtgacacatttggaattcctaagagctctcatgtttttcctatgatatacatatatctcaatgtctcatgtgtaatttcttatgcaaacctaatctaatgagaagatacaaccttcaagactatctcttttgtgaaacccatttagggctatcaacgaatcgagctcaaacgagcttgattacctaggctcaagcttgacaaatgctcaagtcaagcctacgtagttcatgcatctttgtacaagtgtgccggaaagatcaaaccaatagaactgctcatatcacagtagtcatagtatctattgaagacctcaaataggaaggcctataaattcccccatgcagcccaattccttggggagagcccacatatgcctgatgcatctggaaaagctcttgagctcgttggcgtgtgagcccaactagctgcacgaacaggctcctttctatttttggctat

SEQ ID NO: 89355 - DNA, 2870 bp, Oryza sativa
  unsure (1)..(2870): unsure at all n locations
cttatcgtggccccaggtttgccacaattgtagcaacctcctttctttttcttctaaggttatttctgagtaatctattcaactaggagcctgcgctataaaatagagataaaaggattaccatatgctcattcatcaaaaactatagagacatgaaaagaaaaatgatatttttatcaaatcaacagaaggaaagatcctttaccaggtttgaattccaccgtcctactggcttgcttctctcgtctatcctcccatcgattcttcctcatgttgtgtcatgcaccacctctaccaatctatggatgcttctcaaaagctcttactcctctcaatcgaggaactaaattagaagaaccagagaagagaagtaaaaagcatgcaagtgactacaagctaggtctactattgatacgccttgaggaaggaagtggtgagacccaatgacagatcaaagtcgaagtaagtgaaaagaaaagggaccctctgctgaccggaggaagcattttggaaaataaaaactcgatctatacctctataggtagcagagcagagggaatgtcgccctcgttcccgaggaataattctcttaatgaactacttccgaatatagaagtgaataccaattctactagttgttaggaagagctagggttgttttgctagagctcacgtgtacgggggtacgcatggagaaaaaggttctagaaggacaattttcaacacaaacccataatcttttacaaatttgagcccccccccccccacctaatgtaaaataagcatggaagaatatcttggtgacaattcttcgaggaaagaccactttgtcgaaagatctcaatacctagaggaaaggatggtacaattagccaagagagtgaaattttccgtaaccatcctgaaatcggttgaccattctggttctaatttgaaatcgtagtgagaatatctagcatacatctgcataagacaaccagtcaatccggagtttagtaaaacacgttgtctcatggcctattagtagaataatatatatgctaaagataatcccctactaagaaaattagattatagttaaccacattaatgaaagagaagaaaaagaaaacgtttagagtaactcgagacgatgccacgttgctacatgtagtttttttaacctatcgctatatattggcacttccgtgtgatgtggcaagattcatccatttaatgacatgttcatttgctaccgctcataagctcaatacacgattaatgacttgttcggtttggagcaaattccctcccttttgggatttaaccaaacaggatctaatggttccactacaatatataatagcaactactccctttatttttcaatagatgacactgttaacttttaaacacataacaattcatcttatttaaaatttttatgcaaatatataatatataaatcatgcttaaaatactgtgtgataaaacaactcacaaaataaattatatttacataattttctttaataatacgaaccatcaaacatttaaaaaaaatcaatggtttcatttactttaaaaaaacggaggtaatatattatagagagagtactaacgaaagcaagttggttggacgtatgtccgctagacgcctggcacagacacaaggaggcatgggcggagatggagatcggccttccgccgtgcagtgatgccgaacgcttctgtcatgtcgagcttggccgggtcggccaagccgggcaccttcccaatcaaagtggaaaagcaagctggcgagagggagctccacgttggcgagcccgaacgccatccctgggcacattcgccgcccagcaccaaacggcaggaactcgaagtcggttcccctgaagtccaccgccgccgtcgcctcaccgtcctcgaaccgctccggccggaactcctccggcgagccgccgggccagtaccgctcgtcgaggccgatcgcccaggcgttgaccagcacctgcgtgccgcgcgtcacgtcgtagccgagcacccggcacggctcccggcactcgcgtggcagcagcagcggcagcggagggtgtagccggagcgtctcacggatgacgagttgcaggtaccggagctcgccgagcgcgtcctctgacacggcgccggccgcggcgaaggcacggcgaacctcagccatcaccttgtgcatggccgtcgggttccggatcagctnnnnnnnnnnnnnnnnnnnnnncgtcgccgacgtctcgctgccggcgctgaagatgtcctgcgtgcacgcgacatcatcgtcaaaaatactctcgaggaatacaatgatcacaccacatcacttacaaagatgatggatttgatgtcgtccatggcgagcgggaactggagcccaccctccttctgtatccttagcagaacatcgacgaggtcctcgccgccggcgctagttctctcttggtgttcctggatgatgccgtcgaggattttgtacaccgagttgcggcactcctcggcgcggcgtacgacactgctcagccgaccggcgagacgcgacgactgttggaaataaacacgtcatggtgtattcctggcgtggttgagtcagtgtgtgtgtgtcgtgctgctgcatgtgtgcgtcgtatgcgttctgttagtttggttgagtcgtgatcacgagtgcatggctgctgcatggatgtttgcatggccgttgcagtgttgatcgagtcgtgggtgtgcatggtgtgcgtggcgtcagttcttgcggaggaagccgcgtcgtccgggcgagcgtgtggctcacggcgacgtcgagcgggttctgcggaacgtggcgcaatggccggcatggaggctagctcccggtgtgtcac

SEQ ID NO: 89356 - DNA, 812 bp, Oryza sativa
caaggtaatgatccaacggatgctgaatctcagctccgcggaggcatccctcatcccccaaggagtcctccccctctgcagcgatccatatcgcgccaacatcctgaccatcatgcaagcggtcggggcgtcggaggagcgggctcctcgaggccacgatggctcgggcgggagccgcaggggggaacaatctaccccgggagggggtcgtgcttctgggccccgtgatgggggctcggggggcagccgccctgccgacgcccgagggaagagaaagcaagagggtacttcctccccatctcctccccgagggggcggggcggcgcgtgtcagcagcaggcgcccggagggggccgcgccgacgccgcagctcgagagggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttggttgacttctggcttttcttctgcttcagcgagatcccgtcgcgtccctcccgccattccaagtccggccagtctgaggccgaggacccggcgaccacagaggcccggaggcggaaatctgaccggcgagaagccgcggatcgccttcgggaagccgaggaggccgctcgggaggccgcccgggctcgccagaccgaggaagccgctcgggaggaggccggactctgccaggccgaggcgacgacatcctccgaggcgacccgtgaa

SEQ ID NO: 89357 - DNA, 3040 bp, Oryza sativa
gcgtaggacgagctcgtccccgcagagtgatcgggcccgaacgtggcgctgatggtagccccgcaggctcttctggtagcgaccggctcggaggaccgcgcgccgccttcgctcttccaagtagtcgaggtcatctctgcgaagctgatcttcatcagcctcgcagtacatggtggcccgaggggagctcagggtgagctcggatggaagaaccgcttccgcgccgtagacgaggaagaaaggcgtttccccggttgctcggcttggcgtggttcggttcgcccagagcaccgctggcaactcctcgatccacgaatcgccgtgcttcttgagaatgttgaaggtcttggttttaaggcctctgaggatttccgcattggcgcgctccacttggccgttgcttctggggtgggcaggtgaggcaaagcagagcttgatgcccatgtcttcgcagtagtcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcttaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggatccgcattcgccttcatggatatcggcaagaagttcgacgccttgttcccgaggaatgcacttcaggagaattccgttagccgcgcgccgatagagggtcccttctaccagcacgtagcatttggagatgcgttggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcatcgagggcctgtcaggcgcgtccgtctcccctaaggggttgggtcacgccgacggctgggcaagcctttcttcaaaggcgcccggtggggtctgggctcgcgaggaagcgagccgtgagagttcgtcggcaaccgtgttatcctgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacactagaaggcggcggatccccagtccagctgccaccctgagtcccgcaagaagtccctcgtactctgccatattattggtcgcccgaaagtcaaggcgaaccaaatatctgaggacgtctccgctcggcgaggtcaacgtgacccccgcaccggcgccctgaagagacagggagccgtcgaactgcatcacccagtgggcggtgtgaggcagctgtgaggggcccgagctggcctcggggactgagacgggctcgggagctggggtccactctgccacaaaatcgacgagggcctggctcttgatagcgtggcgtggttcaaagtgcaaatcaaactcagaaagttcgattgcccatttcaccacccgtccagtaccctctcgattatgcaagatttggccgagggggtaagacgtaatcaccgtgacccgatgcgcctggaaataatggcacagtttcctcgaagccatcagaatagcgtaaagcatcttctgggcctgagggtatcgggtcttggcgtcccggagggcctcactaacaaagtagacgggccgctgcacctttcggtggggccgatcctcttagctaggggccacatccctggggtgctctttgtccaagcggcctcgcggggtgcactcgtcttctgtgccgacgacctcggggtcggaggacgacaggggcggccttcccacagtggactcggggccgtcctgggggtcgggggctcctggcgtcgttggacaagcgggcaaagggccaactccggtcgtcaggggccttaggccaccgttcggctccgggggccttttctccctgctctctcccgggtcgagtcgtcacagagttagcctcggggtcagagggcgataggtgcggccttcccgcagtggccctcgggccatactgggggtcgggggcacctggcaccgtctgacaagcgggcagagtgcctgctccggtcgtcgggggccttgggccaccgttcggctcgggggcctctcctccatgctctctcccgggccaagccagcacagggtgggggtgcgcggaatgaggattgtcctcatcgcgctccacaaccaacgccgcactaaccacttgcggggtcgccgctaagtagagtaacaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgcaa

SEQ ID NO: 89358 - DNA, 1127 bp, Oryza sativa
cgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctggaacggccggagcaccattcccggggccttgatagcgtcaaaggctgcgggggaaaggatgttgagggctgctcccccatcaatgaggacacgccccagcttcacgttgcaaacagtgggggaaaccaccattgcgatctgtcctccctgggcaacgcacggtgggtggtcggtctggtcgaaggtgagggcaaccttcgaccaccgcgcccggcgcgtcgcctcatgagtaggggccgcggccagaagctctcgcttcatggccttgaggctccggcgagaaacgtgagcacacgctcccccatcgacagtggaaatggtggccccaggctcttggaaacctaggtcatcatcgccgtcatcgatgtcctcggcgggggccttctgcttggcctcacttcgccgattgccggaaggaaccgccgaggacttgccctctcggcgctcctgcctcctctcctcctcccacttcctcgtccgctcagccaaacttttgactgcgcggcagtccgcgaggtcgtgaagggaggtgttgtggacgatgaaccacttgccggttgggcgctccctactgggagcgccggcctccttctttttgttgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctgaaaaagctccgcggtagtctggggctctttgg

SEQ ID NO: 89359 - DNA, 3244 bp, Oryza sativa
ttttgcgccgcgtatatggggtaggtgagcatagcggggctcacctaaccacatttattgcggtttggacgagcgcgtgactccgcatgtaacgcagtgcagcgcgctcgtttatccggtctgtgaccaatcacagacatatcagatcgtgggttaggtggcgataggcggtctgacgcacgcctcaccccatcccgtaaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcgaaagtggaggtaggtatgggctgtcccatcagaaggtcattcagacggcaaccatacaagtctccgtctgtttatgaaaagataggataagtccccacaaaaaagagagagatggtgcatgtggtatccccttgaggtataaaaggaggaccttgcccacttagaagggggatggattttcggatccagaacgatcagagagggagagagtaagggctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcagtggtggtggacaaagaagccgatggaggatggtagtatagagggttcgtcggcgagcctcgctggtgttggaggtgacgttagcgatgtgaataggcagcagtgagagggttggggggggaggatggcagcgccggcaactaggccattaagggcaatatatatatatgagaccatggatgtaatctaggtttttaggttgtgatccaatggtttaatatttgcaatatttgtctgcaaatttttctggcaaattatatacttttttgcaagattcatttttctttagaaaattcagttgaatatttgtttttcttccgattcatgtaggatctgtttataggtggcagcgagacggcggcgacgacgctgcaatgggcaatgtcagagctgttgaacaatccaaaggtgatgcagaaggcacaagacgagatacgacaagtgctttatggacaagaaagaataaccgaggagaccataagtagtctgcattacttacacttagtcatcaaggagacgcttcggctacaccctccaacgccactacttctaccaagggaatgtcgtgaaccatgccaaatattaggattcgacgtgtctaaaggggctatggtactcatcaatgcatggtctattggtagggacccaagcaactggcatgcacccgaaaaattcatgccagagaggttcgagcaaaacaacattgactttaaggaaacaagctttgagtacataccttttggagcaggacgaagaatctgcccaggcatgacgtttaggctagcaaacatcgagcttttactcgcaagccttctgtatcactttgactgggagcttccatatgggatgcaggcaggcgacctcgatatgactgaaactctggcggttaccgcacggcgaaaagccgacctgttggtagttccagttgtgcgtgtccccatcgtgggttaattagccatccacatttcagttgaccgttattcatatcgatcagtgtctcgctgtcctttgtccaaatgtcaaattaatcagccccaataatgatcatatatatgttttgtttgacttttagtttgttcgagcagcagtaagtagataggctaagctttgaacaaacattcaatgtcgttcatgaaatgtatctgcgagtgatctccaatggtatcttgacagtgatgttttccaacctgttcagacaatatttttcaacatgttcagacaatttttgtccctgcttagaaacttatcaagatcagaattcagattattagaaccaacttacaacaatgaacaaactgcaaatgatctgaagtccaaaaaaacaactatgcctatgctgaattagcaacgactgaatgagaacatgcaaagcgagagctcatctgctcaccttcctggatactcacacgtcgtatgcatccattctcctcccgtttcatccccccctcaaaaacttcttgtcaacatttggcagagcagcggtgatttcaccgtgccatgttttggaatttcgacatcctgtctcagtgtctccacacaaaatgtttttatttttgtttgtgttttgttttaaagaggccaaatgagtatcagctccacaacctcagggcagtaggacactctgtttggctgggctataacttttcagataaacagataattagttaagataatatagatgcttagatttgatttggtcaccacatgactaacactagtacatgccgataaaaatgctgctttgcaatatgagaacgataagtatcttgatatgaaattaaatactcctactaaaataacaagtaatatgaagaataaaaaagaaaagtattttttatgataacgaaaagaaatccggtctctatgttcacacacggccctttcagtgtagtatgctaaaaccttgtcaacggcccagaattaacgtcgtctgaatgtcaacatgaaagaactcatttgctcatgggcttcaccttcctgcacactcacgggtcagatatatccattctcctcccatttctttccaccctcgaaaattttgtcaacatttggcacagctgcagtgatttcactgtgccatgttctggaatgttggcatcctatctcactgttgtgtctggctgcttggctggccaatgaattgtcagatataatagactagtattagacaaaataatatagatagttagatttaatccattatctaaaagagcttagatttgatcaggtcatcacatggctaccactagtagatgtcagtatcactttggacatttggacaaacactttcttatcggcacagcttctgagctccttcagttcaatccacccatt

SEQ ID NO: 89360 - DNA, 1289 bp, Oryza sativa
gctgctgtcggcgtacgcctccgactcggcggtgcacgccatcatcggaagccggttcaaggacagggacaagtacctgatgctcctggagcgagggctcaagctgttcgccaggcacaccttgccggacctctacccgtcgtcgcgcctcgccatgtggctcagccgcatgccgcggcggatgatgcagcaccggcgggaggcgtacgcgttcacggacgccatcatccgggaacaccaagagaaccgagccgccggcgccggcgacggcgacggcgacgacaaggaggacttgctcgacgtgctcctgaggatccagagggaaggtgacctgcagttccctctgtccactgaaagaatcaagacaacggttggagtaagcactttaattaggccgtgttttagtgttctttctagcttatttaccaaatcatactccatattttttacaaaatattttatcttgaaaaaacatttttttcactacaataaaaacttgttttaaattattggttaagctaatttattaaaatatttaattcattcatataattaactagataatccgcgttaacaatatgctcaataatctaagtcaaacgaggcaccctaagaattatgatattactttgtcacatgtaacactaattaatctagatagatttatatgtttaaatttattaacatcaatatgaatatggaaaatgctagaacgacttacattgtgaaacggaggaagtatgatattactttgtcacatttaacactaatgaattttacttcctattatttgtacaggacatgtttgcgggaggcagcgagactgcggggacggcgttgcaatggatcatggccgagctcataagaaacccaagagtgatgcacaaggtacaagatgaggtacgacaaacacttgccggtcgtgacagagtaactgaagatgcaataagcaacttgaactacatgcaccttgtcatcaaggaggcgttgcggctgcatcctcctgtgcctctactactgccacgggagtgtagaaacacctgccaagtcttaggattcgatgtgcccaaaggagcaatggtgcttgtgaacgcgtgggcgattagcagggaccctcagtattgggatgaacccgaggaatttatccctgagaggtttgaggatagcaacattgatttcaaggggacaaactttgagtacacaccattcggggcaggacgaagaatgtgccctggcatcgcatttggtctggcaaatgtagagcttaggggatcctctagagtcgacct

SEQ ID NO: 89361 - DNA, 2589 bp, Oryza sativa
tgatcggccacctccaccacctagccggggcgctcccgcaccgcgccatgcgcgacattgcgcggcgccacggcccactcgtgctgctccggctcggcgagctccccgtcgtcgtcgcctcctccgcggacgccgcgcgcgacgtcatgaagacgcacgacctcgccttcgcgacgcgccccatcacccgcatgatgcgcctcgtcttccccgagggctccgaggggatcatcttctcgccctacggcgagacgtggaggcagctccgcaagatctgcaccgtcgagctgctcagcgccaggcgcgtcaattccttccggtccgtccgcgaggaggaggtcaaccggctgctccgggcggtggcggcggccgcggcgtcggcaacctcgccggcgaagacggtgaacctcagcgagctgatgtcggcctacgccgccgactcgtctgtgcgcgccatgatcgggaggcggtgcaaggaccgggacaagttcttggcgatgctcgagcgagggatcaagctgttcgtgacgccgagcttgccggacctgtacccgtcgtcgcgcctcgccatggtcgtcagcaggatgcctcgccggatgaggcggcaccgcgaggaggtgttcgcgttcttggacgccattatcgcggagcaccaagaaaacagagcctccggggaagatgaggaggacttgctcgacgtgctcctgaggatccagagagaaggttgcatggagtccactgttatccaccgaatccatcaggacaacaattggaggaagtactcccatgaacacacaaataactcaaaaaaaagtacaatcgtaatttcacgcgaatagcaaatatcatcgccatctatagttatactctgtaatctctatctctactattacaaaaaattaaagatatttttgtcggtattttggtccgtcatctgtgtatgagttggttttcaagttcgttcgcttttaaaaatacagatccgtatttgagtcgggttttaagttagttcacttttggaaatacagaaagagtcgtataagaagtctttttaaaaagctcgcatgctaatttgagatgaccagatttctaattgcagcttatgattttctagaaaaatatatatcgaaacgaattctcacagtgaatttcaccttaactaaaccatataataataataagataaaaataatctttatccgttgcaacgtacgagcattttttttctagtaataacctgccactttgtaggacacacaaacgagagattttgcttatttcctaacccccacaaatcctaagagctctagctcaataggcacctaaaaagtaacagcaaaattaacataatcatatataatatattagataataaaaataatttgttatgggcttcaaaaaatatatacaatgagctatttttattaaaagaaatccgttgtaacttagtagtgttatgctagtaagaataacgcgtgaggactgaacctacacgtcaatgacacatatatactataattttgttttttgatacaatgatatttttcagcaccataatttttttacagggttaccaagcaaattagcaaaaagttaccatggcttttccacaaaatgtagttacctgaaaatttggcttcatggtacacaggacttgttcaatgggggcagtgagacgacagcgacgacgctacaatggattatggctaaactcatgagaaacccaagagttatgcaaaaagcacaagatgaggtccaacgagtattcattggtcagcacaaagtcacagaagaaaacctaagcaatttgagttacatgtacttggtcatcaaagaggcgctcgggctgcacccgccaagaccaccactgctgccacgagagtgtcgaactacttgccaagtgctagggttcgatgtgcctaaaggaacaatagtgctcgtgaatatgtgggctataaatagggatcttaagtactgggaccaatcagaagagtttatactagagagatttgagcatgttgatatcaatttcaaagggatgaactttgagtatatgccgtttggagcgggacgacgtatgtgccctgggatggcatttggtctagtgaatttagagctcgtactagcgagtctcttatatcactttgactggaagttatctgacaaaataagtcggtgacctagacatgacgcagaagaggggggccaccacacggcgactccatgatcttttgcttgtccctgtgattcgagtgccgttaccgttagactcgcgcagctagctaggtgctagataagtagcttgtgattttttatttcttgataaagcgaccaaatatattggttcactaatgtttacctatgttcaaaccttaacaattaaattattacaaaactacttcaactcactgtgcaattaattacatttgtacattccgatatgtattttaatatacagtttctctgtgctattcatcttttgttattgttatatttgcagatttatgtgtcatatttattagacgaaaagaagtagaattcaacacaccacatatgtccgacggcttctctggatagcaagaaaaatta

SEQ ID NO: 89362 - DNA, 568 bp, Oryza sativa
ctttttaacaaattttccccttatatacagtacttcaaatatttctagttttgacctgttattctgttgtttgcaggttgtgtacattttggaccaagtccgcgctttggagaatgagatgcttttgaggatcaagcagcaaggccttgatatcacacctaagatcctcattgtatgttcaagatgttggtcttgaatgtttcaagttttaaacacttctcagtgcgaattgtagagtaacgtgcggacatgattttacttgatgcaggtaaccaggctgttgcctgatgctgttggtactacatgcggccagcgtgtggagaaggttattggaactgagcacactgacattcttcgtgttccattcaggagtgagaatggtatcctccgcaagtggatctcccgttttgatgtctggccattcctggaaacatacactgaggtaaatggtttatctgacaacgtccttcagagctgagcacaaaccatgaattctgagagctcatctttttttttttggttgcaggatgttgcaaacgaaattatgagggaaatgcaagccaaacct

SEQ ID NO: 89363 - DNA, 2851 bp, Oryza sativa
tatgagtctaagtgctcttgtattttttttgctgtgtatatcctttgtggatatagatacgggattaataaaaatcattatctaaaaaacttcccatctcagtctgaatgatcgttcctatcctgaggccatggccgccgatccggcgactatcctggcaaggatcctgctgagttgcacgctcgttggcctgaaacaaacacgccacacacgcatccataggccaggaaaatgtaattaactcaatttttttttcactttggatggcgtagcaattattaaaaaaaagttatatcagctttgctaaaattatgttgatatatttcttagctaaatacagttagtttgtgatctgttatctatcttcatggttcgcgcaaagtgcatctggataagcccatagaacaacatgccccctaataaggtgacgactcctttttgctttgcatgacacgtgctagtcatcagtgaattatttaatcaatttacattgtaattacatatataattacaaattacactatagttttttttagataatgaaaatggattatatctccggcttctgtcataagacacacagccataagtataatagtaataaaaggtaaaataaaagtaaatcaaaatgagaaataaggtgatgggacaaatccccaactcccctttattattgactagcgttaaaccacataaaattttttagctaacaattcttatggaactacgccacctatagtggaataagagacccttggctaccgattccaagagtgtagcaccattgcgtatagtatcctgctccttctgtggtagcattgtagaccaaaagtggagccagtaggaagacatgaagataacctgcatagggttagataattgtttaccattaaaaactttatcattgcgacaacgccaaattgaccaacatacagcactagctccaattagaatcatcttcttgatggacctagatacccctctaagccaattaccgaaaatgtttttggcgttacggggtgggggatatttaaaagcaaaaaaaacacacatctccaaacaaactgagcgacaggacactaaataaaagatgttggattgtctcttgtgcatagcagaaagaacaatgtttgtctcccccccatttttttttagccaggttatctttcattagaattactttcttgtaaagaaaccacataaataccttgatctttagtggaatttttaagtcccacaaaattttttttatccgaacattacagttcatgatcgcggcatatatagatttgacggaaaattgaccattcttatggagtgaccgtacaaagcagtccttttcatttgacagagttatattagctagcctgaggatcaaatcgttccactcgattagcttttggccaacaatagctcttctaaaagagatattaagcggcgttgtgctcatgacctctgccacaactttttaattacaccgtaacttttattgtattttgactgtaaaaatttgttgatagtttttctagataaaagttaattttgttgtgtattttaaccaatttacttttatttttttagtttacaatagcatattagtgatttatgttgtctttggttcatccgtaacttacccatcttttttttaatcatgtgatctcaaatccgactatgcggagcatagatttgtggcgctattattatagatagtcccatgttatatttggatggtgtagcaactacaagataatgttacatttggatggcgtagcaactatttataggccaagatgcagttactctatattctgaactttagtgtaactcctgtcttactagaagcaaatgccttccatactaggcagcaatagtggatcaaattaaagatagtacaatttcctctttatacataagtcgggctgaggaggaagagaagggatgtgtgatccaaaatatatttcgaaccagctgaagggagcacacacaacttcacctcaagttctgttggccacacaatctaaactctagccatgattgcaggattgggattgggatgcattaggaaacacttgaatggcaaaagtgatggctagtcctagctcattcccatattattctattgcacttacaaatttggcacaatcttatctccatttgcacagctggtattggtcaaactgtagtaattttagttgaacaaactatatagatgcatacaccataattttaatttcagttgaggataaagagaaactaaacatagagagagttgatacagtgagactatgagagatacttcaactgaacaaacctttgagagtttatcatttgtccacactagctcaaaaggtattggggcataaatcagcgtaatacccaattaattaaacaaagaaagaatacactgtacgagtggttggaaacttggattggatgaacagctgggccggatcaagttgcgaaatcatctaacaaaaactataattgatttgttcctaatatgcagccaacggattgaattcaagctatttatcaatttggcatgatcatttcggctcactattcattagggcccattcaatcagttcatgacaagccataaattaatacatggatttatactcgtctccttggatctcgccactcatcgccggaaggtgtcgttcgttgcaccatcacctttcaccacatagatgataccgtcaaatcggagaatacagggtattgcgaggggatgatcggatgctggaatacatggacataaatagactaggtggagtgtggacaaaacagtaaaaaaaatgtgtgggcgcctgaggggtggagagagggcgaggggtgaggggaggga

SEQ ID NO: 89364 - DNA, 547 bp, Oryza sativa
caagaattcccggcacttaccagtggagttggggcagaggcgagcgagcagctcaaaccggatgtcccgctcgcagttcatggtgcgagtgtggatcttgaagatctgggtccggccctccaggtctggcaggccaaactcaactttcctgtccagacgccctggacgtagtaatgcagggtccaaggtatcgggcctgttggtggccatgaggaccttgatgtttcccctggcatcaaatccatcaagctgattaacaatctcaagcatagtgcgctggacctcattgtcaccaccaacaccatcgtcaaagcgagcaccaccgatggcatcgacttcatcaaagaagacaatgcaagccttcttcgatcgtgccatttggaagagttcccgaaccatgcgggccccctcaccaacatacttctgaactagctcacttcctatgactcgaataaagcaagcatccgtgcggttggccactgccctagcaagaagtgttttcccagttccaggagggccataacacagtactcccttaggaggatcg

SEQ ID NO: 89365 - DNA, 2069 bp, Oryza sativa
agtcatatcagccacaaataaaaattaatagcaattccccaaagcttcttcaaaatatagcttgtagtactaaggaaccatggtttgcatgcttactcaatttcttagctgggtgatattggtttaaagaccataacacttgaaggattgtgtactaggaaggatgcttgagagagaacacaaaatgtccatacaacaacatgctcaagtagacaagttaacataagatgaattgcttccctggtgtaaatgaaatcttgtagcctagtccacaaagcatgctaacttacaagaaatgactgaaatcaggaattcagacgcatcacataaggagtaatagtataaaaaagcatcctcagttaccaattgcaatgatatcccttacatagtgcagatttctgaactgtgcaagctcaaagtaaatctaacaacttagcctattagctggtaaattatatgccaatttaatacttctgacattgtttgccatcaaaagactgaggatggctagtccataagtaacctaatacgtagttaatattttgaacattgttcatcactcaaaagactgaagatggcctagcaatcccaattcaggtcaacctaattcactagaagacctgcaaagtaaagtgaccaattaacaaggaatcaagtcagtatcattacatcatgtatgatagataataatcaaattagaagaaaagaagagctgagcagtgggagaaaagacgaagctttgttagacagttttaaacgtactctgtatctatatatttttcattttaagattcttgtggtcgatttttaaaaactgatttggccataaattttactagcatatttcattaacagtaattccagaacaatacaccattgcatatatttatttaaattttataatcgtaataacacgtaattgctaaaacaaatataggcaaaagttatgcactcctgattgcatatctatcatcgcataaaactgcatatgtcacatcttccaagtgaaaactgcagaactcctgattgctaaaaaagggagtaattcacatcttcgaagtgaaaatggcaaagtcttatcaggctccaacagaagaccagtagtctagtagagctatcaatttgaacgatagattcaaattccaactacaacacatgccaaaaataacaagaacagcacacctgtgccccaatcacagatatttggagcctctacatcagtcgtcagtttcatagtaggaacttgctctgattatgtagacctgcaccattttgatacaagacaaaacattgtttgcactaatgtagatttctcctgggtaggccttataagaaccaacgtttcctgcacaatattttcctatatttagacacatacattacctggctaggctcaacaaattatagcaataacatgtgcaaacaatgaatgcttgaaaattgggataccatgagtcaatgacacattcattccagttatttatggtgaactggtgatgaactgtttttctgatttaagacatcaataaacctaacacatgattagtcggctactacaaatcaaccagaattatcatcaaccgtgcaaagattcaggagatcttcatataacattcgtgccgtgcccgaacaactccaaactcaccttgaacttcgtgcgctggataagttggaacaccaaacaatctccatcaactagcttatgagcaatggaaaaccccctccaccctccactgagccccctcttgttggcaagatagagggtgtcaaactcatcatcctcctcatccaccaaacggatagtctcgtcgcgcttcggcagatacttccggctgaaatgcgtcggcaggctctaccaatttcattcaccccaagaatcagctgcctcatccctacaacctacatgatgcaaagcaagatgagagtgaagttacaggcttaccagccagaaccctccagtgacatgggactgaagcatgggcttgacgaagattgggtagtcggagccgagctcctcttccagctcttgagcagcgttgatggcgtagtccctttgctcgtcggtcgcg

SEQ ID NO: 89366 - DNA, 3856 bp, Oryza sativa
ctgtcactcaccaaaggaactcatggcgaaggtcagaattaggcatctacatggcaaagccagcatacatggcaatttgattttaaggtattgatcagattagatttgatgcaacctgtttggaagtcaggccccttcgactttgaggtgcaaattaatcttttgcttgtctcctagcttagaatcgcctatggattgttgttgtttataacttagaggttggccaaacaattagttttgtcccctatgcatcgaacctcgagacatctcatcacttgttcatgaagagtagattagttaaagccatccgggcaggaataagcctgtgcttgactgaagtttcttcagcaagccctccttcggcctgttcagtattggaatggtggtgccacaagatttcatcagaaaagatgcaacgcaaagggctcaggaccctcttcttgctgtggtctgctggccactgccgggaatttggatggagcgaaacaatagaaacttcaagaaagagggatggtcaattcagcacattgtcgacaaattctttttttacgagatcaatcagtgaagcagctgcagagcaaaaaggctggtacagttctctcgaagagagagagccgttttttgtagtttgtatagcctctggcttcggttctattttgttcgctcctatcaaaatatgcacaaaataggcagtcatgcccatgtttacaagtaccgataatgttggttactatatttttttacagttacataggagatatattttataaattttggttgaataaaatgtttttggtagatatagtttccaaacattcaatgtactcctatgatatattttatgaaaaacgtgcattgcacgtgcacgattactagtatatatacttaagtgtgagaggaaatggttgagcagaatcacaattcacagaaggaaaaacagcctaactgaagggtgaaaagaggagacctcatacttgcacgatactgatgaaatcctcccatcatttttttcttgtgaaaccatgtagacatggtagggctaggaagcatcaggaaatacaacagagcaaaacctgccagcaaagcttggtacagtttcaatcctggtccgatgaagactgattcttcttccggtaaacatcatccatgtggctgattaagatgttctggtcacttagtgacagctctgtcttatcgcatgcaagcacttagcacagcatggatcaaagtatctgcaagctttgattttctctcgtttcatgaaaaggtattgacaactagccggtggctaaaattgataaggcttgtggtgagtttttctttcaactgtgcaattgcattgacaatgttatgaataatgaaaggcattaattcagtacacatctatgaaaaaatgttttatgggtataaacataaaaatatagaaaaacaataaaaatgcagaaagaaaaacaagtttccaaaagaaccacactgccccaatagctctttaaaaatggcaacagcacttgcccatgtcctcctccttgattaagccagcattcattggcaagattgcatcctaagtaccagcctatctgtcgattagaaaaagggttagcgcatgagacctaaaagtggatggacaaagatttaaataggttcagaccctctcgataagaggtaataccctacttctgtttggggattgtatccgccggatgtatattgatctgattatctgacagtgctatatccttggagggctccctgcccaccttatataggttggaggggagcaaggttacaaagaggaaaacctagccagacatggtattagtttcctaatctattacatggtagtactcaatcgggactctaggtcctgccatagaacataaggcaacattgcgaaaaagtcctactctattacattacagatggattcgatccacttcctatctctagttggatatttaggctgtgtgggtccccggtactcatattcttcgtaatagcccctgagaccttcacggtcaagttgcagtcttctccgtggttcatgaccaattctgagtatttcaatcttccctgtgaaggcttcccaagtgcttgatgtggaaggcctaggctgaatgacacatagatgcactttgaacgccctttagcttgcctcacgggccacctcatactgtaggtccagattgacttctaagtttcgttgaaggtgcacaaccctctcctccagttgatgtcctaattctgctgacagattttctagtgcttcctattcctattctttctacaccatgcgtccgtgctaatggactgtccatcaggcatgccaccaaagaagtttcagatgtgtatctcttgctctcttcacttccttcgttcatctcagatgagtctgttgctatataatgatcttgaagcatctgtctttcatgataaccatcaatatgctgcaaatctgcaacagggacaactattgtaacatgttgcagaagtccagtgtattttgatggtggtacgctattatggtgaactgctatattctggccccatttgatagggctccaaactaccacttcgttgggagctggctcctgtggaagttagagaccaactgaaaagtgtttggctagatttaagctctaggtctgaaattaaaaaaaaatggaaaaaaatgcaatccccaatctctcgtgaagccctaggcaggttgttcatccctgcaagcgccgctcgtccccgtcagagtgccgccatcggccccaccacatgtgcacctgcctatgggcgagctgagggttacggaagggagggagagagatgtgaggaggtgagtttggggtagttaaaaaaatatgtataaatatgttaaaaaaatatgtgtaaatatgttaaaaaaatgagtttgaggtgagtttggcttttttttaaatatgttaaaaaaattaaagggtggtgggtcttttaggttggagtggagctatggagcagaaaaaaaaacccagctccaccctttgttctctttgactgcccgatatacagcttgaatttctagagcattcataacacaaacaagatgatcattgaactactttggtgcaatttgaagtcaatgccaacttatttgatcaaactaacacatttataaacaaacacgtgtgttcatggaatcacatttgaacagtttgtttgatcgacaaaagcggcatttgagacatgtgcctagcctcaagtagatgtggcaaaactctcatttcactatatttcccaatgcctatgcttaggacttagaccatcctgaaaattttaagggcgattttagggtcgttgaggaatgaggatatattaagagctataacatttattagcgtaaaatttgctattaatatctctttagagtctgaagtaaggaaaaagactaaattttacataattgtaaaagaataaagttacatgaaaattttacggatattcatattaagctaaatgacaacagccaacaacgttccaagctgccactactacaataccctatttttccggtcggtcgtatttattatcccgtgcggtcactcggcccgcctgcagctcctcatatgggaaaatcggtattttcacgtgcgggcgggctgaccgcacgggataatcgattattccatgcggtcgacttaacgtaaccgcacgaaaaaatcgattatcccgtgcgatcgtattaagtcgaccgcacatgataataggttatcctgtgcggttcagttacaccacccgcacgggaaaaaagcaaaaaaaaaatgaaatcgaaacaatcccgtcgtcgtcgctgtggtaatcgagaccaaccctgtcagtgccatgtgtggaa

SEQ ID NO: 89367 - DNA, 615 bp, Oryza sativa
atcggtgatccgtttgggttcttgttttgggggtgacaggatcttgtctgtgtggattcgcgggtttcttggatcggaaagggggaatgctggtatcaatatgctagcccgcggagccgtgcggtcgctgttcgatcgtctccggccgccgccgcatcaccggaggaggaggagtagccccgccgcgattatgccggccgccgccgccgcccaccgtggctgcttctgcagcctcagccactcgaatctgtgcggggagggcagtgtgattcagaggaagggatttcttgatcttgggatgggtcggaggttcgcgccgggcagcgcattgggatccaagggatgcctgaattggcaggatcggggtagatccaagaggggggtggatggtggcgaggccgtgaggatcaaggcgcaggttctggcgccgcagcggcagctgctccatgacccggaggttctgccattggaggaggttgccacgaagagcttgaacgggaatggcgcgtgccggcgtgggaagccgctgggtttccccgagaacgctgcgccgacgaagatggtggttgctgttgatgtggatgaaggtattgggaaatcattgcaatttacaat

SEQ ID NO: 89368 - DNA, 694 bp, Oryza sativa
cttaattcaaaagtttcttccatcacaaccaaaaaaatatgacatcacagtgagtaggaaatgctaaattttaaaggtttgtttgccaaacttgttgcaatggtcattcatttcttttagtttgaatattccaacttgcatggcaggaaaaatgcatcttgaaactaaacgtacacaacaaaaatggtagaatcttaccaaagctaattcgttcctagtatcatttagttcatggtccagtatggtatactcaagtgatcttctttgtttgtccagctgctggtacttcttcatttcttctttctcttcatcaagttctctcaacctttcctccaagtagtggacaacttgatcaatctgctttcttttgttggctgctaataaatcatgaatcaatgtccacttacaagaggtcccctacaaatatataaacatttatgataacttaaacatgcctgtttcctgcatgattttcaaactctgtcgccgtctatcttcataaacgcgcgtaccaccgatctctttcaggagttccagtcgttcagaatctttcattagggtaagggctgcaatctactcataacaattttcattacattatagctgaacagcacatggcaacaatcaggtgaaaaaatattacctttccctgctgggcaacgtaatatggatttgagcgagaaaatccagcatt

SEQ ID NO: 89369 - DNA, 1451 bp, Oryza sativa
atatgaggacaccaactatgaatttctgtagctttactgctgtgcccttgttttccaactatcaattatcagatacatcttttctctcagaagcaactcttccaactacttttgtgctctctctcctgttcatgaagtacgatcaattttacttacctgcagaatgtttggacaccatcgaaggtcatagcttgtcttggcaaagaaataaatgatgaaagttcctacctttattgggcgtataaggtaacacatgtttattaactacacctgaatatccttacaaagtgcaaaataatagcacaagaggggggccacaccatcaattctgtttataaagtccatgcatctctatccttagtacacaatgagatactaggtagtctgattcaaaatttttctttgttccttgaaaaaatatttgagttattttttgtctgtatttaatgttgtgtagctgtgaactcttcacaataatgccatgggaacatattttcctcctggaactagtgcaccgccatcctatatcttgatgttttgcttattgatgttgatataatgtacatgatatccaaattttaacctttatttgactttttagaatgagttatagacttatagttgagtggatttggtcaagacacttgttttttttctctctcatgatgttgcaatagaccatatactttaagcatctgtggagaatacgacacgtaaaccagcatcgatattcgatattcttgtgtgggttttaagttcttatgcccaagtgcaatgttatgatctgttaatcaaaagactgaaacgagatagtactgactttccaaaacttgatcagaacaatattcctgtatactgcccagcattgactgatggatcgcttggagacatgctattctgtcatgcagtccgcaatcctggcctaattattgacattgtacaaggcaagtttgtgtgcttggttttcttgcttttgcattcaattttttttctcatattatgctcgaaaatgtggcagatataagattgatgaatggggaagccattcatgcaaccccaaggaagacagggatcatagttcttggtggaggtctacccaagcatcatatatgcaacgccaatatgtttcgcaatggtgcagattatgcagtctatatcaacacagcccaagagtttgatggcagtgattctggagcacaacctgatgaagcagtttcatggggaaagattaaaggttcagccaaacccgtcaaggtatatttctgtaccttgagcaattttcacatgattatttttaatatttgatgtgcgcctagctagctaaaagtgccttttgttaaacatcatatgctgcatatatgaacatttttgtcagcttcgcttgaacaaggtatgccaaagagattgcatcaatgatcttggactagatcctaattctaatccatcttata

SEQ ID NO: 89370 - DNA, 859 bp, Oryza sativa
acccaaattagggttaaagccaacgtgactaccggcaaaattcccaccactaggtcctgcattcaaaccgaacccgttgttccatccatgtccattaccggcacttccaaaccaccttccaccttgaaaaaaatcctggcggccgccgcggccatcgaaccaacctcttccacgtccgcgaccccttccaccctgatgatttccgccgccaaaaccagggtgaaaccctcgagcagaaaattttccatagccccccacagcaggacgaccctgacggttgtttctctccatcggcagacgagcgacggcggcgtacgagaagggtagcgaccttacagattgatcattcaccctaactttgcgccgtatcgtaccagtttttgcgaagagagaaaccaagccagccgtgggcctgtatggtatgttgggctttggaaaagcaaggccctttggactgtttgtgatcgattcaaaatttgacatcaccggaagttttggaaaacattccaaactagtcaccgtcgggtgagaacccgagtcagaagacatcaccgaagacgaaacaactttttgaatcaaaacattcgccggacgagattggaatctcgccggagaagaagaagaaacagtggaaagaaaacccaatgataccttcccttgcagcgccaaagaaatagccgtacctaacgttcgagggggagacttccttggtaatgaaagcggcccgctccaaggcttcgaagcactctccagcgaagacacatgtggccacgtatcatcggcatgcaaggtctgcaaaacagaaaaacgggaaccagacgactcacaacatcatccagaagagaaacacctccagctg

SEQ ID NO: 89371 - DNA, 781 bp, Oryza sativa
gtggtccggcaacgccagcgcgagctcgcagaacttggcgggcttcaggttggcgtcggacgcgatctcggcgaggtagctgtcgaccagcttgccgacgtgcaccatggccacggcggacggccgcgacagcgtcgtggctcccggcgccggcgcctactcggtgatcgcagcggcccccaaggtcgacgcctggccctcgccgtggtcctcctcctcggcgaggaagtgcctgaccacgcgctggacgcagtccacgtcgtagagcgtctccgtggcgccggagtagctcgggatgagcacgtcctccagcgtggcgtgctccagctgcgtcgcggccttccgctcgagcgccgcgcacgccgcgtccgacgcgcgcaggatgtgcgccgtccgcagcagcgcgaacaggaacttggcggtgacgacgcgccccgagcacttgtcggcggggaggctggcgaccaccgcctccaggaggtccctctgctccacctccgacgacaccggcgccgacgcgagccgccgccgcatcgacctcgacaggccggggatggtgcccctggcgtacgacacgaggcagctctccctggcctccgtcctcacgtcggcgcgcgcggccatggccgccatcacccgcttgtacatgtgcagcccgaggacggcgaggtcgtctaaccaggagcgcgacgcggccgacgagcgcgcggcgatggcctccacgcagcggccgacaatgccgagctcctcggcgtgcggcagcagctcctcgcaggacttg

SEQ ID NO: 89372 - DNA, 2869 bp, Oryza sativa
agaactggaggtttgggtcggagtgcggcgccggaaacggcaggttcgacgggtgcgagcgcgggaggccgccgccggccccttcgccgtcgctatctctcatcagcttcgagctcttggccggcgtcccgttcgcggcgaggcggcggagatgagggggggaagaagagagaactgcgagaggtgtgggagagcgttgggtgtgtatgtgtggaggggaggggagtgtgaggcgacgagaaaatggcgggaagcgagaaaagtgttgagaccgttgcgaggttggggcggggaagaaacggtgggccccacttccctcggattgctccctttcgtcggtttaggaggctaaccaaacttagaaaatgctattttgcctgattaaaatgtttagtataagaaaataggagaaaggcatcaagaatagcctcagtttactgacagttcacatcattcagttatgacctgagatgagttctattggcttgattcacattcactagtggtttgctctttgttcatattgttgccatcagtttacagacaatttaaatcacttaatggtttgttagacattaatccaacttattaagtcttcagataatgttcatcaaaggattttcggtaattcagtcctttcaattcaaaacatggtagatatatggaggatttgcttgaaaatgctacacaaccatatgcttccttattctttattaggaactgaaagggaaattacacaacgaattcatcctccatgacacctccgggtgtaggtgtcatggcaattattgaaagtaaaatactaccggtaaagaccaccgtaaaactactcttgtccacgctggcgcctccgtggagcagcctcatctgatgagatggagatcagatggagatgctgttggggatgcccctggcggagaggccggcagcgtcgcccttgaggtcggaggtgtttgggtagagcagcgtgtaggggaaattggtcggcccgacacggttcttgcggtgggggtccttgttcatggcgacgacgcggctctcgatctccgtcagccgcgcgccgaaccgcttgaacgcctccagcgccttggcgtccgacgtccactccggcgtgtcgcgctgtccgaggtacacctcgtcggaggagtgcttggacaggatctccagcagcgagatccccacgatggcctgcatctgcttggtgattgtccggacgaacaccttctccggatcgcgcgccagctcgtcgtactccttcgttcccggctccggcatcggccgccggctcaccgacggacggttcgggaggtacccggcgtacgggtactgcccgaagttgacggcggcgtgcagcgcggacccgatccagatgatggtggcgcacgccttgaccagctccgccaccgtcttcatctccggccaccacgtcgcgtccttgatgtcgccatgcccgacctcgcggacctccttccaccacgcctgcagctcggcgtcgccctggagcacgccgtcgttggggtagtagatggcgaggtactcggtggcccactgctcgatggcgtgccagacggccagcccgtcgttggcgtacgggtagtcctcgatgagcagccgcaccttgtacgggctcgccgggtccggcaccgcgacgccgcgcttgacaaggtcgtcggggagcgcctggtcggcgaagctccagtccttgtagaacgccgacgacatggcgagcgcgtgcttccgcgggaacacggtcatctcgaagatgccgccgccgttgatgagcgtctgccgcgccagcgcgttgatggtcatggtgtcgcggtagtgcggcagcagcagcttgtgcaccgggtgcgccacgctgagctgccggttggtggcgatgacgaagggctccatcacggcgtgcgtgttgagccagtggctgatcagctggtgccagcagtagtcgttcacgttgacgtacgccttggcgagctgccacacccaccactccacggcgccggcgccggtgccgccgcgcgccgccggcgtgtacacggtgctcctggcggtgatcagcccgtcgtcctgcaggtgcggcaagctcagctcgatggcgagcggcgccagcgtgccgtcgccgcgcaggaacagcagcgtccgcgtggcgtagatgaagttgtcgtcgaggctattgatatccaacaagtagggcatgaaatgatcgtggtggtccaccacgtagagaaggttgccgtcgatcgcctgctgcacggtgagcccctcgagcccgcgctcgacgtgcgccgccgtgatggtgctcgtctggtcgccgtacctggccgggtcgaggcggctccgcggcgggaactcggtgaggcgggcgatgaccatggggttgacgccggcgaggatctcgcgggcgaactcgtcgtcggtcatccacgccttcttgtcctcccggatgacgtgcggcatggggagcttgaggaggtagtcgccgccggcggggatgaggtccttgacgagctggagagggaagcgcttgcggagctcctccagcgccgggatgctgggcagcttgaggccgccctcgtagagcttgaggatgtccttgaaggagtcgaactcgccgggtgtgaggtcgacgtaggtgcggatcgccggcacgatgccgtcgacgagcgccttgatggagtagcccaggaagtcggccatcttcaggtgcccgaaccgctcgtcgcgtggcacgtagatgttctccagcaatgacagcctgctctccgcggtggggtctacaaagttacatgtcccacatgtcagcgaatgattttttagtattcaacaatatagtagtgcgatattttctaatataaaatttagtaca

SEQ ID NO: 89373 - DNA, 1405 bp, Oryza sativa
cgatggcactgctcgtgatgtcgtgcgtggcgcgcctcgacgacaaggacatgggggctggaggcggcgtggaggaggcgtgggtggcgagcaggtggcggccgtcgcgcaccgatgaggtcaggcacctcatggtgcacgagagcatgcatgacgtggtcggaaatctctcggtttttcttcttctctcctcagcagacggcttgacgccctccatctccatccctccccatatggcggtgtcactccccgtggcccccttcccccgagctggcgacaccctttccccgagccggcggctcagccgtggtgcctacactctccctctccctctacttgcgaccctgcgccaaggctgcctagtgagcagcggtccgcgacgggtcggggagcagtagtccgtgagctaatcctctacgtcggcggctcttcttccacgagcagcggcgattcttcgcccctcgcctcctccctcgccatggggccgcgggaggactcgaccctagcgggcggtgtcaggcggcggcgccctcccttccggcgggagttgtggctgcggacaggggtgatacccttccctccaccggatccagcgggaagggaggtggtagcggcccgccggcgtcccaacggcggcgacggtgccatcccctcagccggatccagtgggaccggagccgttggcggttcggtggtaccctccccttcgatctagctgcatgggaattttcggataaaaattgtgtgtatatgcttcagttttccctgcctccgattctatttgtgatgaacttccgactgggattttttttttgagcggggattatgtgatggaattccgactgggattttttttgttgccgggggggggggggcggaaaattagcgacggacaaggtgacaatcggaaagttatgaatttttaattagttaagatcggtgtcggttttaaataaccgacaccattaattaattataggacacctgtaatacattataggtaccgttttcttgaaaaaccgagccgaatcttatccatccatccacagcggtgatataaggctggtttctaaaaaaaccaagccgagccggcagggcgcaccgaggagataaggccgagaaggtactggatttttctcgctctcattttactctatctctctctctcctctgtcgctctcctctctctaaaagctgagtcgccggtcggcgggtggatccggtgcagcccattggcggcgatggcggcaccctcccctccgtgtcattggcgtgtggcaggaggagcgtcacccgcctagagacgccctccctctgctagatccggtggtaggaagggtggcgtcagccttacagtgcctccgcggcctcggggcagcagtgcccaaggttgataagtctctct

SEQ ID NO: 89374 - DNA, 3222 bp, Oryza sativa
agctcctgttgcgagagaaaaaatagaaccaagagatcttcaaaacgacgcctccaaaaaaaacgacgccaagaacaccaccactacctgtcccggagagcaaggacatgattttcacttgaaaaaagtaactggagagacaagaatatgtaacaacgctccaagaggaaagcggcacccacatgcgttattgttgctaccccgaagatagagcattcgcccataattatttcatcattcccaagaaataagctcctgcacactccgctgccaccaccgtcgaaagccttcgacgcacagccaccgcatcggcgccacgttgccggccgaccgtcataaaggagctcgacccctgacacgctccagctccatccacgtagttgggttggatgaggagagggtgagagagaagaatggatctcctctctcccacactagcccgttcgacgtggtcatcttttgtcggcaaaaggcgccgttgccagaggacaaatatctagactggggcccgtcgtagaatcgcagctccccctgatggtgtacccgccgactccgccatgatctagttgcccgcgtcacctcggggcaccataccgcgtctatgctgatgacaccatccgtcacagcgcttccgatgtcatgttaggccggaattaatctctatctcgaactccgtttcgattccttcttctctaaatttggtcattaacatttctttgacgtggaattggtactggcagtactacttttcatgttgaaaacatcgtagtgttgtatcagttgtaggtgtagttaaccgatgattatccaaacggtaatggaaattcccaaccgattgagcatagttttttttttaaaaaaaaagtggtgccgttttcaactgttttttttattctggccatgtgtaaaatttgttgcaaatatcacagtgatgtactagttgttcgttgttgtggttatgtgattattgcagtgacgccctgttccacgacaattagttattactggatgaaattgtatataatttttttgagataataatgaatgcaatctgtaaaatggcaaagaaatcggaaactttacaagcaaaggtgtactgaatatatgatatatgggagttacagattatactgcaggttatcaatctcgaccaaatgataccaatgtgcagctgaaggggacagaagaaacgatcaatcgaggagaccgtagagtagagtcgctgtatcgaaagaaaaagttgagtttgatctccagccccgcacgcgaacggaaaaaggagcagaaaaccccaaactgagatgacgaaagatctccccgccgctgcgtcgtccgtccgtccgtccatctgaacgtagctcacattgttgcgttagttccagctggttcacagccgctctcctccgttcaaacagctgttttttacaaaagttttatatacgaaagttatttaaatattatgtcatttttctaaaaaataatatacacttaattaatcacatgtgaatggatcatttcgtttttcccaatccaatccagggaaacgaacgcagctgctgggatcggaatgaacgcagccgctcggaatgatcggccgcacgcgtgggcgtgtgtgacttgacgaggatgtgtagtgtagcgtcgcaggtaacaggaggcggacgtgtgcggctcccggccggcttacgccgaggccggcacggcggcgcacgtgaggcaaacaccggccgctcgttgaaggcggtgcgtgctctatgacgtcgccgtctccgcgtgtgcctctgaagttctcaactctggcacgtgtacggtgcaccctgcgtcgatcacatggtccattggctccagccgacgatttccatcagaaaactgtttgtgttctacaacgtggtaacagatcagaaccgtaggagcacgtagaatttttctttttttagaaaaatacgagtgatattacagtttttaggaggtatcgaaagttgctatattttcgaatgtaaaatttgtataaaaaaaaggtgtagctatatttatggcgccatatttttcacctaaaaatagtcggcgtgtatttacattgtaagtctctaaattacatatgtaaatttagtgtatttataatgtaagttttaaaattacatatgtaagtctcaaaattacatagtaattatatgtgtaagtgggatgtaagcggggtataaattgtgttaaagaaaaggatgcatacatgtagcatgaaattaggtgacgtttcacttggatttgcatgactttagagattagctagcaatagcatatgctttcaggtctcttcgcgaggaaaaagtcagtatggaagcacggatcttaaacacagatccaacggccagataaccgactgtaatcaacgaaaaaaatctgtcgacataattatagcaaatccgaaaaaaatggtacgtcttagtatctctcgcgaactgtaaaatttctttaaaaatattccttttcaccggtttcataggaatacgcatgtttcaaagaaattgtcacagatatatcgttatcgtatagcgagaataagaactcacgacgagttcgcacagtgagtacacaaactcgcgatgtttgcgaggaatagcgggaacgatccgcgccaccacgaactcgagagcgagatcgctgagcgaactcgtgagtactcgtgcatgctagtctcttctggtttgctgctaccacaagttcacatttttagaccattcacggtgcgccacaagaatttagtgtgcgtcacatgccacctagacctaagaacacccaagaactagatggatacatactccacggtgcgtactacttgcatactactttataaagggtcccacagtgtttcccatctcctctgtccttcttatctcttctttctcccctctttgctcttatctcttttctctcacctctctacgtctcccacagacggtgaggaatggtggcgatggggtggctggtggtgccggagacgggttgagcggaggccacggcgccgggcaacggggcgacctaaacggccgccgccgccctgctcgagtggtggcgacggctccgagccccggggcggcctgagcggagggcggcgacgactgtgccgggaggcggcgccagagacgggtcgagctcgccggctctgaaccggcgtcgacatcaagctcctatgcctctctcttctccagccggccgtgtaacatc

SEQ ID NO: 89375 - DNA, 1722 bp, Oryza sativa
cccccaatttccgaacacattctttggtccatgattgccaattttgtatgttggaggcacatgatggatatgcggttggtggttgccacttcgcggattgcttctctttttgccgggtagtttagaccccgcacattccaacacatgatatgttcactaatcattgcacaacgagacaaccattctaaaaaggcagcgtcttataatctcagcatttgaaccaatacattgccacagcagtagccaaatactagttactatcctgagcctaacacagactagaggaatgcactgcttatttcttattagcccgggggcttaaggcccgagccggctaatagagcaactactaggggggagcaaagggtgtgaagcacccctgacagcccagcgctaatctcttacaacacggacagtgactgactaatatggggatggtcgcgctcctgcatggtgatggtgagacgcacgcctaagccgtgccggtggtgatgccatcctgtccggcgaagtccgacggaatggaagctgggtcgtcgaggcgggtgaggcagcggaggccggcgatgacatgtggcggcagtggcttgtcgaaagccttgacgaacgccgcaatcgcctcgtcgttgaggtcctcctctttgtcaatgaaccccatctccttgaggaggcggccttcggtgtgcttggagacgggcaccgagaaggggcgtgctgcctgtctcgcactgtgcctagagggcaccatcttcaccttggagcggccacggcgtgctggagcggggggcggcggctgagggagaagcggctcgggtagaggctcgaacaggcgaggtggcgcaggtgcgcctggaggggcgatgtgggccaggccgtcgccctcgtccaggtagcccaccacgtcgggcaccacctccttgctggcttgggccgccatctcctcctgtgccgccagctcctcctgggcctcaaacccggactgggcctccagcagaggatgggccgtaggggcgctgagtgggattggaggaagcttctgggtagcttcctctaccccaatcgccacctccatcgtcatcgggtcaatgctgcccaggcgcatgccatccatcgccgcagtagtctctgccaacatctgtgagcaaagttgcagcgagaggtcagagagcacagagagggttagggttagtggtgtagctgtcagtgtcgtcggtcccccccctcgagaagcgcgaccaggcccaccgccttgtcgtttgtgccgctgcggcgacggtggcgtgaagtcctggcttgcggggatggagatctccggcgggaacaacgacggcttgctgagcggcggcggctcgtcgaacaagagcggcagccacgatcccggccggcaggtgggctcccgtcatcgtccccgtccaccgcgtcggcagcgcatccacggcggcggcgggaagggtggggggtgcggctcctgtggcgagccccatcaggttccccctgccctgacgacctgctctggcccaggagagccgcacgccaagatcggcgtcgtggggcgcaaccagctctgtcgtcgtcgtccccgtcgtcgttcctgcgtggagcgaccatccggcaaccctcggccgcctccagcgttttcaactttaaatttggagttaattttgagggttttttatcgaagtttatttttcagcctttgcttttagatcggtaagaacgaac

SEQ ID NO: 89376 - DNA, 612 bp, Oryza sativa
acttcctcgtaagtgatctggaggtaatccagatgaaaaattatgaaaaaaaactctctgtaccatcttacatgtgtgttccacgattttccactttaacatttcatatgatattttttaacacctttaagatgttctgatactccctaaccctttctattctgttcttgaatgcactgaagttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatggtgagaatcgcgttgctgtaatttccttttatgacctggtttggtagagatggttttacatgcttttggtaacatactagcattatcaaaagcattgatatcttatccctatgatgtagctaatccccctttgaaaatgtgttatttaggtggatgttattgttacaactgctgctggtatagagaaggatctcatcaaatgtcttgctcccacttatagaggagtattttctttacctggaacactgttgcggtcaaaggg

SEQ ID NO: 89377 - DNA, 596 bp, Oryza sativa
tgaatcttcaccttctgtaatcagtcaaataattcacttgttatgcaatctgcaggtttgtgacaagcagaaggcaatacttctagcagatatggcacatatcagtgggcttgtcgcagctggtgttgttccatctccttttgattatgcagatgtagtgactaccactactcacaagtcactccgtggaccacgtggagccatgatcttttacaggaagggggtgaaaggagtaaacaagcaaggcaaagaggtatatacttgagcagaacaatagcaagatagtagcgtagggtgttggtactgtttcttctccatcctgtgactctgtgagcttcaaaaaaataaaaatgcctaatgaccctctaccgtctaggttatgtatgactttgaggacaagatcaatgctgctgtcttcccaggtctgcaaggtggaccacataatcataccattactgggttagctgtggcgcttaagcaagtctgtagcacttctgatccctgatgttttatattttatagatcacattgttggcctttgtcttggactctaaaaggactttctaacttccaggggactactccggagtacagag

SEQ ID NO: 89378 - DNA, 1409 bp, Oryza sativa
ggcgaattcgagctcggtacccaattaatagaatacttatatcaacaagttacaacttcttttccggaagccgatttccaaagaactccagagttaagcatgcttggtctggagcaatttgggatggaatttttctcgggtgcgcacgagtgaggacaaagtgctatgaaagctgtcagatataagcgggcgcctgagagaggcgggacgggacgttacagacgtgggacagaacatacattaaccttttttagttaattatgcaagcaaaattcaaattcaaggcagctttggcacaattaatatttgggtcgaagtgaacacaagcagtgacaaaggcgccactggccagctagcccggataaacgtccggattcacgggcaaaaactctattaaattttaatattggttaattaattgatactgaaatttctatagcaaatactagttatattgaaatttgctcggccctaaaaatctttttctccaccactaaagtttaagctagggaaagtaatttacttaattatgttcagcacctagcaaattaattatagaaactatatatacatatcattaagaagaaattttacggtctttaatgttgtatcggaagtactaatacatgatttttaccgtaattttgacaaattgaccttttgggaaaatttatttcaagaatagactataccaaaaacttatttaaaaaatagaccgtcagctcaacgccataaagattggcgctgaggtataacgctttaacgctatacatattggtgctgatatctcatccgaggtggcaaaaatttaccagattgtaggtgttgacgtttgatgtcacgattctggtatttgcatagtatggggatcgatggtactaggatatatgcgagattgtaataaaagagatggggacgaggatttttatacaggttcgggcccctgaattgtcaggtaataaccctactcctattggccgaagccggtcgttgctcttattcaccataatcacaccagtacaatatttggggtagtctatctaactgttgtcgacatagcgaactgaagtgttgactcgtagtcgacaacagggtagccttcctcctcgaatccacatccggcgagatcaaagacagcgctatgtctctcctgacagtatccgtagacactataggggactagccatgcttatctctgaagtcgatatccggcgtcttgtcttgccgcatgttggcttgtaagttaatcttgtgtcttgatctattattccgtgtcccctctcctcctaggggaccttgtatttatacccataggtgtccccttgtccaagtagaactaaggaaaccaatatggatacaatccgagtagtcctcgtcgttttcatgtaaaactctatttatccttcctt

SEQ ID NO: 89379 - DNA, 6573 bp, Oryza sativa
tctctctctcatgatacatatatgtatatatatatataagaaaaagtacgaattacgatcaaattacccccgtgaacccaaaaacagacattgttcaccttgaacttttaataccagacgaattacccccctcgacccatccagagcggttttgtcctatgtggcgtacgcatggcaatccagtcagcattttcttattaaaaagtggtgggtccacctgtcatactcttgttggtatttcttaaccttacagataaaatccgcaagcgcacggaaaataccgatgtagcacttcaaccgggagtattcttaggtatcgatttccacagggaacttgtgtgtcaacgccggttcagattcatccaaggacatgaagctatagataggcaaaagatagagaggtttcaccggtgaagaacagtgtctatggaaagcttaactttaatcctaatgaggtacttcgggcactggccagctcgctgctcctagatatcgctctactgcgcacccagacagggaggactttagtgtcttgagggttgtcaccacctctacaaccacctcacacctactgtgggatgcggagcaaacaccggaaattatctacctagacaccgcgcctaagcatattaatttcttactttaatgttagctacacactaaagcaaatcactatattttagttgattatagtaaacgatgatcccatactttgaataggaactaaccaagaaataattctcaccgagcaaaactaaattactcaaaagataattctattataatcggagtaattaacagagcagaaagaaacagggataggattaccgacaactggaatttcttccacttcttctactctactctcttcctattctagtatacaatatagtactatagagcatcttataattcagctcaagcttggagtgtgtgagtgaagtgaagaggtgaagtctttatatagcggcaggtgtaacggttatagaacgcaaaaggtcaattttgccctccaaccgccattcaggagctcatccagaccgtccatgcaaaaccccaaatcatacggctacagaggtggttcgactgaacccgaaccatgggttcagccgaacccatggcaggcccaacaggcttcaactttggcctgttgctcctcctctgcctcctttatccatttctgtgagtggaaggaccattgaagatgtattctagtagtttctggcccactctttatatggataggaactctccttcacttaagtctatatttcatccaactttggcggtttattacctgcattcaaatatacaccaaaacttgcggaatatgttagaatttaaccctatcactatgttggatgttttatccctttgatttatgcaggtattggcggcataaaatttgtcaataacaaccaccaacaaccctctcatcctctctctctcccgtcgggagctcctcttcctatctctcttcctacggaagcgacgcaatggctggtggcgagcgtggcgggggaggtgagggcgcatggtgcgacccacgatggcgactacaatgagcggcggcaactgcggcgagggcacctagcgagtggctctcccccttctctctatctctctctctctctaggcaccatcgggagagcgcacgcagaggccggcggcgcgtgtggcggaacggtgagggcgcgcagcgcagcccacgatggcgactatagcaagcagcggcaactgcggcaggacgccaggcaagcggctcttccccactctctctctctctggtaccgtcaggagagtggacccgaggtcggtggcgggtgttgcgggggcggtgatggcgcgtggcgtggcccatgacggtgactacggcgagcggccttccacacaccctctctctctctatgtgtggcgcagtcgggagagcggaccccgaggccggcggcgggagtggcgggggcgtttagggcgtgtggcgtggcccacgatgaattgatcggcagtcggcgaccggcgacggaggtcctcctgcacctctcacccgccagcgcttgagcgacctccgcatcccttgccgggggatgccagaaatctctatgatgaatctttcccgacaacgatgccagaaatgcttgttggtatttcttaacgacaatagtagaaatataattcccagtactggcgcataaatacttctggtatattatggttacagagttcatccgcaagcgcacagatataccattgtagcatttcacccgagagtattccaagggtatcgaatttattttatcccgtgggaagatcatgtagagagaacttgactaataatttatatattacttgtgataatcatattctaagcaggggttaagataattgaagggtagagtgacacacaagcattagctactcattctcataatatattatctaggctaagtggaaagaaaagagaaagaaaatcaattcctatacttttaatattacatagtatatatacattctagttaaccgatatactaactaataccctctatctgatgccctcctggcatttcgagaagccacccctcctcgtggcatttcgagaagccacccctgattgccgagttccttacgatagcccgtcatgaccatacaaccggggctaaatacggaggaataccctccccagggaattaacttaggattatataccggcgcggaggaatacccgtactgagctgtcaccatcagcggcccacctcttatccgcagcatataaccccaaataatgatatcccataatctagacaccatgtctaaattactagatactactctaatatcatcgtcatgacatagagtaattgcatatgcaaacattatacccgcaccaaagcatctcccagataagctagccgtataatcagtataacatgaacataatgtaaagtaggtactcatatactcggaaagtatttcaataccacaaatatatatagaagagtattctaataaaagtagaaagcttacaaaagaggaaaagaaagatactatagccatacccaaactcttccgaagacttctcgactcctgatttctactctatttccatttcaccagctagatactactaaactaaacttgagagaaatgagagagctcttgcttgaggtgtgtgttgaagtgaagagagtgaactccttaaataggcaggtaatgatggttatggtggttggaaaggtcggtaataccctccaactgccatagggagtgaatctccactgttccctcaaaaccctgcatccatcggcgctggcattggttcgaccaaaccctgggctggcccaaccagcccacaagttggctggtggcctcctctggtgtttctctccgtagacttgtgaattttggcctagtgcgtcgtgtcaattctaagttcttggcccattcatacataagtctggttctcgacattgtccgattgatttatcatctgagttgatgtggattctcctccactttattgtcattctctgtaaaaagttagtatacctaataatagtggaatattattattctaacatatatatgcattgcaaacatcactagttctcctctattttagtaatattgacggtcgaaactgatctataacgaccgtcaacagtacccagtcttgtgctgtctcccaccccagagttggagtatgcatcggatggtggctactcggaggagtaggcttcgtccgtgccgtcaaggatgcctgtggaatggtgtcgctccgctgttagcgttaagttctagaataagctcgcttttattttccacttcatttatgtaggatttttatatgtttgtaagacgtagttctgtatatcaactttgtcgtttgtgtaccctggctggtcctgaacaggtgtttaatgcacattctgcttggaattctattcgggaatttccgggcgtgacacgtatgtgtatactatatacacacacatatatgtgtatatattgtatatatgtatatatataatattttttatgaatatatttttagtgcataaaaagttatatgtcgtatacaaattttatatatgacatatacaaactttgtatacatacatattaaaaaataataaaactagaaaatacgtcacatatacaaattttgtatacgcacgtatacaaaatttgtacatgtatatacaaaatttctatacaggtatacaaactttgtatacgtgcgtaaaaatatatacatgcatataaactttatacacgtttacatatacaaactttgtataggtgcgtaaatatataggcccacaacgatcacccgcccattagcgatgccctaaatatatcggcatgtttggctgctagggttgcggctgcaccacagccaaccggaacaggccggcaagctccatgacaactaggccatattaagaaatttcacaaaactatatatactttgataaaattatcacaaaactaaatatttaaaaaacgatagatttagcgctaaatttatcccaaaactatatatttaaggtagagtatcacaaaactacatatttaataataaagttatcacaaaactacagattttagagtttaaatccttagcactagcattatgtttgagttatatacgtgtaagttttctgattaaattatcactaaacctgtagttttatgatatttttattactaaatctgtagttttacgatactccaccttaaatctgtagttctgtgagaaatttagtgttaaatctgtagttttatgatatatcatcttaaatatatatctatagttttgtaataatttgatcaaagtatccaaatttacttccatattaatataacccaatgaactttgatatctcaaatatatacaaatttctttcatggaaagttgccgtaggaaattaaaccatttaatggtaaacttgttgttttttaaggcaaaaaggcagcgcacatgtgtcatgtgcccttgagcgctcaatcaagaccaaatttcatcttatcatatattgtttgctgcccacccttaccgcgtggtgcccagtacacgtgaagagcgccctaaaacgacgtacaaaccaggttaggctaacggtacggtacaaaacggaggacgcaaaattccactatcttcgtggctgccaatttcggcccggcccatacgatgcacgtacccggccactaggcccattaaaaccagatgtgatgccacagccacagcgtgtatgtcaaccgacgaaaatatatacagtgctatctcataaaaattttacttagaactagaaaaattgcccgtacattacaacaggtgaaggctattttagtcatattattgttcactacgagaattcgcttggatatatttttttctaaaaaatcatgtcaagttagcatgcaagtttttttataggagatatcatatacgactccttctgtatttccaaaagtaaatgaacataaaacccgacttaaatacggatctacatttctaaaagcgaataaactgtattttccaatacggttaaaaattgattcatatacggatgacgtactaaaataccggcaaaaatatcttcaatttttataatagtagagataagatgaacaaatatcggatattttttattccacggtatttttaaatttacacatacacatatgatatacgctatatattttcccgttattatttgtggcgctcaccggtgtcgaggccactggttttgcgcgtcacctcggcctggttgaggaagagcagtgattgcagccagcggaaaagagagaaaagggagaaaaagaatggcaaaatactacacacttcgtttcatattataaattatttgacttttttctaattaaacttagtcaagtttataaaaatatttaacaacaactaaaatatgaaattatttttattaaatctaacattgtatatatagtttaataatatgtttgttttgtgttgaaaataatcggtagcgctaatacaatcgctgcgcgttaaacaataattaacacgcctcggatctcgctcccacctccccttttctcttttttttttctggttctcttccgttcccaccttccactcctattttttcgttttctttttctatcccctcctattcccgtcccctcctactttagctgtctgcatctgcgttgttttgtttcgagtaaaataattactccccactcctatttttccgttttcttttctatcccctcctacctcggctatctgcatccacgttgttttgtttcgagagaaggcaagtggatcggatgaggaggaagagaagagaagagaaatgatacttgataagtggtatggattttttttatttagttcggatccaccgtaatgcctcctttgctatgcatacattgtattaaggctttattagctaaagaccgggttcatatgaagccacctatacaagtagatattatacagtgctgatgcccttacaagtactctctccgtcccataaaataagggattttgattttttgtttgcattgtttgaccactcgtcttattcaaaa

SEQ ID NO: 89380 - DNA, 1316 bp, Oryza sativa
attgagtggtttcccataccacacaaatgaggctttaaggcctgacccttgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacataagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttggacggaagccgacatagaggatgaccgcgactccgatgaggggcggaattcctatgatgtccggactagagttggatatcaaatggagcacgccccacttagagacagagtcgtaagttttcttgcatttatcaaagttacttacatttgcaccctagaccctaacatatatcttttcaagctttcagtcgagagagctcctcaggagtgtgaatgaaatggggcatgccctccaagctccgaggggtggtgaggacatggagaacacgctccgcaatgttttagaggtaaaatttatttagcactttgcattacttgagttattcctaacaaacttcttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgtttttaaaatgttttaaacattggattttcaaatgt

SEQ ID NO: 89381 - DNA, 656 bp, Oryza sativa
gagaatggtaagctcattttacctctttttcgctgcccgagtggatcgcaagttgtattgcgtgggttgcgtcccctgaggcgcgtcgggaagctgtgacatgtctatctcctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggaataactcaagtaatgcaaagtgctaaataaattttacctctaaaacattgcggagcgtgttctccatgtcctcaccacccctcggagcttggagggcatgccccatttcattcacactcctgaggagctctctcgactgaaagcttgaaaagatatatgttagggtctaaggtgcaaatgtaagtaactttgataaatgcaagaaaacttacgactctgtctctaag

SEQ ID NO: 89382 - DNA, 1549 bp, Oryza sativa
taaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttattgctgaacagcagaagcaattcgaggaagccactactctctttgtgggatgcattcttagcgttcttggcaatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcaaacgggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatatacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctaaagaacgtgcagcatgtcccttctatcgacaggaatcttgttagtggctcccgtctgactagagacggatttaagttggtttttaagtctaataaagtagtcgtgtctaaacatggatattttattggtaaaggttatgagtgcggaggcctgttccgtttttccctttctgatttctgcaataagtctgtgaaccatatttttggcagtatggatgatgaggctaatgtttggcattcacgtttatgtcatattaattttggcttgatgtctcggctttccagcatgtgtttaattcctaagttttccattgtcaaaggtttaagtgccatagttgtgtgcaatcgaagcaacctcgcaagcctcacaaggctgccgaggagataaacttggcaccactagaactcctacattca

SEQ ID NO: 89383 - DNA, 1266 bp, Oryza sativa
gtctgatcgcggtgcggagtttttctcgaactattttgacttagtctgtgagaaacatggcatcatacatgagaggacgcctccctattctcccgagtctaatgggattggtgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagttttttcccaatgaaggatacacatagtggttcgaaccaaccctctgaaataattcccaattcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtaatgaaatggattccattatcgctaacgggacttgggaggtgacagagcgaccctatgggtgtaaacctgtggggtgcaagtgggtgtttaagaagaagcttaggcctgacggtactattgaaaagtacaaggctcggcttgttgctaagggctatactcggaaagaaggcgaagatttctttaacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgtagtcaatgaggcagataaatgtgtgtactatcgccatggtggggg

SEQ ID NO: 89384 - DNA, 10995 bp, Oryza sativa
attgaaaagtacaaggctcggcttgttgctaagggctatactcggaaagaaggcgaagatttctttaacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgtagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgttttggctacattgatagtaagccttctccaacaccttatgatcctagcttgttgcttcgcaagaacaagagaattgctaggaatcaactagaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcttgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgtcttaatgagttatgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccatccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatggggtggcatgcatgtggagtttaataccaccttgtttattctaggagagggggacctccttaaaagggaggatgccctcctagccacttgaagcatgtgtggtggagagaagaggggaaacacgcgcgcgctcgcctcgcctcgccgggccgggccgggccgggccgggcagcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctaatcaagcgacccttctctatataaaccgatctgccgtcttcacgcaacatatgcgaaatcaatctagggtttgcctcctactctgtactgcgccgtcgctcgtagactactccatcccgctcgctggcgtgcaccggcgatcgggagagcaggtctccgaaacctctgccttcgacgtcctgcaccgggagaaggcggcaataaggtttttgggaagcgcttcgtgcgactgctccctgtttgttcgcgacggctcgccttcctcttcgctcgcgtgtttcgtgccttcgtagacacctgcgaaaagtttcaaccaatcagccggtctttccgtcatctcggtacgtgttcaatatgttgcgcatatttgatctgttcatgttatactgtgtagtttacatgtatagatctaatgatgcgttcatgctagttttcttctgtaatgtcatgatttatttatggaatagattaaatcattatatatctataatctcaacaattttgacacctcatcgagccagtaatctacatggattgtttgttccactaatgatttgaatgatggtcctgaatgtaattcagttcactgatgtccgctcggcagcctacttcaatggacatcaacacaacatagaagctccccatcagaatcgtaaaaaagaataccgaatgagaacatacattacatatggcattcatataatgctactggatctcaaacttgtatattgctgatggtgtgtttctcattttactttttacagctcaatgttttttctctatgccattcttattctcagtttgtttgtcataacattagtaaaacatcactcatcgtggtgtacaattgtatgacatgtacagtccaaacatttggaaatgaagcgagcagatattaacagtagctgaggtaagtcgattacttccactctgaattaacttgacagattctataaggaattataaatgcagctgttaatttgatttacctttgtacatgattcaagattcaagtgcaggagctgaaaggttttttttacccctgatcaagaagaatatgaaccttaatggccagtgtttactgtggttttacatcatgattcacttgatggatgccaaagtgcaaatataagcccatcaaatgtgtccttacctaaatgtgtatttgcctacgtcgctgattgggacaggttctgaacttctgtcatgtccctttaacaacaattatttttggcatttagtatttttcatagccacactttattcatgtagataaacaaaacctcttggtgatattgctaatttcagttgaattaagtataataaagtatgctagagagaattatctctccctcactgctgacaaagggaagaattggttcaaatgaactatgagtatatgtagcacaagaaggaagcatttctagagcaataaacttgtctgcctctacttctattagaggtgagctgaaaacaatctataattctacttgaatacaattagcatataaatacatgtcataaactcacagtgtatgaacttttgtatttgaattcagaatcaacaacatgatctgacacgcacatccaactaaggggagcataagacaggcttgcaatgaacaagctttcgaagaaatgggtccattcaataagatgattttttttctcgacagatagaaaccgcacttcatgacttcaacttagtttgtataggcagtaataagccccataaaagacaatactaagaattttttttgggtaaaaatgaatgttttttccacataagtttcctataatagtaatatgatcgaaccccttcctcttttgatatgggttttcacttgcaacttttcttgtttttgcagcaaacttatttgcaaagcactcaattcactaccctgcaattgcttcacaagttaaattcgtgctttgaaatttatacaattcattcataaatagcccaccatccagctgcaattaatagtttcgatgttgaaatgcttcgatataacattggaacactgggctatccttttcttagcgatgtgaactgctctcatcaaggggcaacattaattggaggtcggaaagtgtgaggaaaaaaaattcatggcatcagcatttattcagctggatacttacagttttcttttttaccagaatggaaatactgagtatgtcctttgtacaaacaccaagggcagatgttgtaaccaataaaatactgcgcaacttaagtgcaggatggacaatatatttcttcatggcagtctctaatcagttagaaattggcctaccgattcagcagtacatgtcatttgatgtgaaactttgttggttttaggtaattagcttgttcgtttgatttatgtgtacttttcccaatttcttttttgtaaaataggatatgtttgataaactcactattgtggagggctcatatattgttgttgttttatagtgtgtgtgtgtctgagattttcatctaacacgcacatatgagatttgtgtataacaacgaagctaattatttgaatcatcgaagagttcatactttgcgccaaaatttgatctttccaaaacatgtattgcacgtgcatgattactagttaggggggggaaagggagaaaccgggaaaaaaactgcaagaaaaaaccaaaataaacaactagagaaatttaaaaaacatatatgaaaaaaaggccacgcgccacttgccctcgcgccctcccatcgcccctcgtggttgcgccgcgcaggagagggcgcccgcccctagccgcctggtagccttttcaggcctcttaccgtgcaagctatggggccgtacccttagctcaaaaggttgacaaaaacacccatgctacagtacaagcacccatatatatgtggcttaattggatggagacactggtaaaaggtaccaagcccacagtgagcgtgaccctaccacgaggagacgggggagcgcaacgaaattatttcctcacctaccctcgcctgcgcgtggactcgtttccatcccattacatcgcccttgcccctccccgccgcttcttctccgccccaccgctcctcctccacgcgcggcggctttcttcctcctcctcggccgccgccgccatctctggcgccgatggggaggcgcggtgtcggtcggaacccgctctctcctcggggcgctcgtcctctgcgtccgccacctcctctccctcgttcttggcggcggctcgccggtgcgcccgcagccaccagttcttggcggtgggaggcgcccccggctgccgcggcagcgttggccaccaccaccgtcgacctcgccgccacccaccgcgtcggccaccaccaccggcctcgatgcgtcggaggatttggattgggagttcactagcagcagcagtagaagacaacacaagcgcagcagcagctgcaggaagggaggatggaggagaagcagcttcaagaatcaccaacaaagagtgagcaagagagagagagaggtgagaaaatggtggttcttttgatctatatgccctgcttctgtttgcagaaatgcgtgtgtgcttgcagtattgtcttgtgggttgtttcttgggtttttttaattgtatgtatggccattgttgttgtgggaggaggaagaaagggtgagagctctcttgattgcttggcttctccaggtccatggcttgtttcagtggtagctagggataaagatcaagagaaggccttttccttttgcattgcatacttttttatttccttttcgtgcactctttgtttcatgtctttgtggtttctttgatctgaggagcaagttcagtccctttttttaattgaaaaaagccaattccttttgaatcctctcatttccatcttgttcttgcaatcttgctaaccccaaacttaggaagaagctagtacaatgcgggcaaggcaaaaatccagcgcaggagcggaggaatcggtggcgggagaaggaaatcggtacggcgggagaagattttggaggatgaatcggagatttcgccagaggaataggcgtgaggccacgggtgggctaagccacgctgccacagcgcgtgttcctgccgatttcgtcgccgcacgcgccctcgtctctgcgaggtttcgcgtcgctctgcttgggtacgagaaccaagttaggttccgggcgcgcgctccacatcagcggaaatcctccgtggcactggtaggtaacgcgctccagctgtgtgcactgtgagaggcctcacaagtagaccgttgtatattgggtggtattacccgtaaataatgcaaactttgtacagaacaaagtgtattacggtttttctcttttctttaagtaactagtataatgcccgtggattgcgacatgttctaaataaaacttattgacatgaattaaaatactaagcctaccacaattgggcataaatgatgaaacaaatataatcgtagaaataacaacatgaaacaagtaactttgacctgaacgaatacgaattcaatatcatgaactaaatcattttttatttagctatatacaattcaaatacgaggaattataagtttcagaaaaatttaatggatcaaatactgataaaactaacactataaatgaaaaaacaacttaaattagctagaaattaaaaaaacatatttaagcccataaataaatgatccattagtttagaacggttacccatttcattgacataaattagtatgtgagtgatataggagcatggttgggcttaactgagaaggaatattgccgaacatgaactgttcatcgtctttcttagccaaaggcaagaaatagaagaggggaaaatggacgttggtgatccagcgaccaaacggcggtgaggaaggttgtcacgcacagaaatttaggccccctttgattcaaaggaaattcataggaattttaaaggatttaattcctataggaatttttcctatatagccctttgaatcaaaggaatgaatcctatggaatcctataaaattcctatggaatgcctcttcccatgcaaattttgaaggaaatttaacatgaggttctacctcatgttaagaatcctttgagtctctctctctcctcaaattcctgtgtttttcctgcggctcaatcaaatggtcattcctatgttttttctgtgttttgcaatcctctgttttacacttgtattcctatcagaattctatgtttttcctattcccccgttttttcattcctgtgattcaaagggggccttaaccaaatttctaaactattttgtgtataaacccttgtctaagaatcaagacaaggtacacaaaacgataaattaatatacagatctaaacgtaaataaaatataaatacttacagaaaaggcacttaggcctcacacaaaaaaaaaatcctcacaccaaaaagaaagcagcaatggaaaaatgcaatcctatgaaggcttcagctccactccccaagcaaaaactcaactggagtataagccttggtcctttaacaccgtctttagctcagaaagcactacatttctaaaaagagagaataatagcaagactgagtataatgatcgtatccagcaagccacaccaatgattaatttgtttgtcaatttttttaattgattatatgatgtatgtattattagaataacttcttgagctctcaaaattcacagaaaatttcaaatagtattttagggcatgaagaatattacaaaagtatttctagccatgatttttaaagaaaattttaatcccctcattaatttcacttgagaatttgctttaactttaatataaattctcgaaatgcatcatttaatattttttaatcctgaacgaaaatcgggcatgataaatctacccctacaggaatcttatcccaagattctggatggctagaaaaaaaaactaggtgtggacggtgttgttgttcctttctgttccaactgaccgattgattaaccaaacctcatgactgaactggctggattcaactatggtgttctgtcactccataaaattgaattgacttattatgcttttatctgaccctagccttgactgtaggtgctcatagatcttactttccttggactaaactattagcgatggcatctttgataacctgaccctcaggctctgttcgtttgtgaggttcccaactcctcttcctcgtcttccacgtgcacgcttttcaaactaaaagttgcttaaaaaatcatattaatccattttttaaaaaaattagctaatacttaattaattacgtgctaatggaccgcttgttttctgtgcataggttcccatcccccaagccagcctcaccttgctgactagaaattcgataatgattatgctcgggcgaccgggcgggagaggaaaaatcgggcgctccccctgccccccgtgcacgcacatgcctgcgctcccctggcccaccacgtgtccaaacacaaacaactctattgcaacaaaaaaaccccacatattttagaaaccctctattaagtgaatttggtttttttccaccaaaaatgtttcatctagtgcattcacaatgtttcattatgtatagatctaatgttgcagtgaactaaaatactccattgtaacaaaaaaaccgacatattttggaaaccccctattaagggaatttggtttatttttgttccaccgaaaaatgtttcacctagtgtactcacaatgtttcactatgtatagatctaatgttgcagtgaactgaaatattatttcgctatttgctgaaacattgtttttatataaggtgaaataacacccaatttaaacgagtgaaacattttcgatctacttagtgaaacaattccaatatacctggtggaacatcgtgtaacatttaaaaataattcaataataagctaatttttttcgtcggaatatatccatgtgtggtcttgttttgaagatttaattacaacaaatttaatggtacaatcggatcatgattttgataagtaatttgagagaaaaatcagtttaaaatagctttccatgtaaatcgggtgctgacgtcatgctgatgtcagcgtccgattttttggagttttggatcgggcgtcaccccctataagaggaagtttaatagtatagcccacaactagctccaaatcatctatagacaatgtaatagccaattcatacaatagttgcttactatactattaatacttggtcccacctgtcatatacacattaagtattgatgaaccctgagttccactcgtcactcaaggctgttgttggcccgatttttcggtgagttgagataactacgatttgtggaaaaacattgacgatccgactacaaccgtacgagacgttgtgttgtgccttagcgatcgatacacctctccgtgggttgttgatcttgccggtgaagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatttaacaaaacccaagaaaccctgaaggggtacctagctatataaataggggtgggaggacgacctaggggtgcctagggtagtgctccacctggctggggcacaccccacatgggccccacctgggccaggatcccaaatgaagttacaagcccataggcccattataggtgacgcagcaccttgtgcgtgtgattccggccacacgagatggaattcggagatgaggctggatccgttggaaagagggctccgaaagcttttcatcaagtactcacgggccaaaaacggaggtcgtatgcagattcggcggccgtttgaagtcagcagtgtagcaggtggccgaatcggattccagcacttgaaggactcgaacttgatatcttgttgttcatccatgatgtgagcaacggatgtatccgtagtagccatcgtcacatcatcctccccttcttcatggaaaaccgtcctcggtttttccatatggtgttcttcacatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggatatggcaaatcagacttagcaaataatttctccttcaaattatcgagctcacaaaaatcatcaaactgaacatagcccaaagtatttaaagaagatcgcaattcgcattcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagcaattgattccactaatggttgctctactatagcatgaaa

SEQ ID NO: 89385 - DNA, 4342 bp, Oryza sativa
acaaagaaatagtagaactaacatgttcattcactagttgtggcatggatataagtgaaacattatcacacaactcttctttatcacaaggaacagcaagtaaatcaacttgtgacaaaggcaactcagcaattgattccactaatggttgctctactatagcatgaaaagtggacaagtgtagctcaccttgagaatactcaccttcatttctctcagcaccatttaatttaccttgcgaactttctttagacatcgcaggtgcttcatcctctttcttctcaagtataccattcaccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacactatcaagcaaaacctgaatttcagaactaggcccattgaaaaatctacgcgttgtattttcattgcactctttgagaccactgtagatgatacagaccttaaattcatgaatgtactccctaacagttctgtcaccttgtttcagatgttctaatttctcccgaagagtacatttgtaataagatgtcacaaagcgttttctcatcatggttttcaattcatcccaagtttcaggtttattactaacataagtccaccaaaataaagcagaagaggtaaacttattactagcagccttaatcatttgagcatcagaaaaatcatatatatcaaattcattgtctactgctagctcccaatcaatatatgcaacagaatcatacttcccatcatagaatggtaacttagatgcaacttgttcaaaattatagtcatgtacctcatatgcataacgtggagaagtcgtcatatctcgtcgaaggtgtagaagttgatgttctcgtattcccttacgcaatccgggcatggttagtatgaaacaagaaacacacaaaaatatgcacgctcctatcaactactaggtagtggcagctcaaatatcacacacactcaagctcttacaagtttttaccaaagcaagcggaatggtgatgtacaccgacttaaccaagcaccccaatggaggttggatgtatcgatgccttggcaaacacttgttgtacggctgcaatcagatctgtggagctctgggtaggcttaaatatgtagccaagggatagcaaatgctcaaatcagagaatgcaaagttgaataatggttcaaagtcaagtaccgtgctggtcctaggctagaacgtactagagacgcgagcctagacacaaacgataccacaagatagcaatagtaacaactcatgcacaactctgatatatgaagttcagctcaaacataacagtattttctcttttctttctttattctttcttcttttctttttttttctttccttttcttttctgttgttttttttggtgcggcttttcttttcttttcttctttttatgcacctttctgccttttttttctcactttttttcttgattttttttaacaaaaactgactcaaggaccttaatgtaaggttacagggactcaaatgtaaatataaaatttacagggactcaaatgtaaaagtctaaacctaaaattaaaattatacaaaaatggaatgctgaatttatgccggttccgtttttttcaaacagatctcgaaaccgacaccaaacgaaatttcaccaaggtgtttgacacaactcagaactgagataacgtgatttggagagggaggagggagtcggactgtcacggtggtggtgggtacggtaggtgggagggttcggcctggcccttcacaagtggaaaccaaatccaataaaaaaaaactttccttttcttttctttcctttttttttccttccaccccaccgaatccaaactgatctactatattcctttattcttcctcgcacacatgcacggcacagccaccgaacagaagctatgcaactcaagaactcaaaaactaaccgacaaaaacttctgaaaactacaaaaatagaatcgtggcagcgagctgattccgttttcgtaggtcccgacgacaacagagacacggaggcgacgacgactgtagtataaaacgtgaccagaactcgaaactctaaacggactaaacgctaagaccagcaacacgactcgacgatgcaacacagattcaacaaagcaaaaactgaaaagaacaatgcaatggcacaatatggctaggtaaatgatacaatttttttgtctggctattttttggttataggtagaagaaaactcaccgagaaacgaaagctctgataccacctgatgaaccctgagttccactcgtcactcaaggctattgttggcccgatctttcggtgagttgaaataactacgatttgtggaaaaacgttgacgatccgactacaaccgtacgagacgttgtgttgcgcattagtgatcgatacacctctccgtgggttgttgatcttgccggtgaagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggcaaagcgtgacgaccgcgggcacatcgtcaagcataaggcccacctcgtcacgaaaggctacatccagtagagcggcatcgacttcgacgatgtgtttgcgccggtcgcaagactggaatctgtgaggctgatccttgccgttgctgcgcatcaggtctggcaagtccaccacatggatgttaaatccgcgttcctgaatggggaacttcaagaggaggtatacgtgcagcagccaccaggattcaccgtcggcaaggaaggacaagtcctgaagctgaacaaggctctgtatggactatggcaagcaccgcgagcctggtactcgaagcttgatgcatgcctcgtctccctcggcttcacccgtagcgaccacgaacatgcgctgtacacacagcgatatgcgcacaagccgctaatcgtgggagacgacctcctcatcactggccaggatgctggtgacataaaagagttcaagttggagatgctgcagcaattcaggatgagcgatctcggcatgctctcctattatctgggaattgaggtacgccaagatcacaacggcatctctctctctcagtctgcatatgccttgaagctcttggagaagactgggatggtggactgtaatccctgtcacgctcctatggaggccaagttgaagctgagcaaatccaatactgcagctcttgttgatgccacatactatcgcagcattgttggtggcctacgatacctcgtcaatacaaggcctgatctggctttctctgttggctatgtgagccgtttcatggcggagccgcgcgaggatcatatggctgcattcaagcacatactgaggtacatcgccggcacccgagatcatggtgtgtcgtactcaggaggcaagacagaggagctgaagctgattgggtacaacgacagcgacatggccggcgacgtcgacgaccgcaagagtaccactggcgtgctgtttttccttgctcagatccccatcacctggcaatctcaaaagcagaaggtggtggtgctctcttcttgtgaagcagagtatgtggctgcgacaacggctgcgtgtcaaggggtgtggttgcaggggctcctcagcgaaatacttggagcgccagcgacgacgccaattctcaaggtggacaacaagcccgccattgctctatcaaagaacccggttcaccacgatcgaagtaagcacatccaaactcgttttcatttcattcgagagtgtgttgatgccgggaagatcatcatcgagtatgccagttcagtggagcagctagttgatctgcttaccaagtccttgggaaggcagcgtttccaggagctgagcgagcttgttggtgtgatcaacacaaaaggccaaagttgaacttcacaagatttagggggagatttgttacaaataaacttgtgtcgatctgctttgtgtttttggttctggtagtttttccctcccctgtttttctgttgattctgttagagtcacgcacatgacctcgctggtttttcggccgtgtgcgacgttgggctcgtcgtgtgcgtttagttcgcacgggagcgcg

SEQ ID NO: 89386 - DNA, 1100 bp, Oryza sativa
cgccctttgaccccgaggctaaccctgtgctgactcgacccgggagagagcagggagaagaggcccccgagccgaacggtggcctaaggcccctgacgaccggagttggccctttgcccgtttgtccgacgacgccaggagcccccgacccccgggacggccccgaggccactgtgggaaggccgcccctgtcatcctccgaccccgaggtcatcagcacagaagacgagtgcgccccacgaggccgcttggacgaagagcgccccggggatgcagcccctagcgaagaggatcggccccaccgaaaggtgcagcggcctgtctactttgttagtgaggccctccgggatgccaagacccgataccctcaggcctagaaaatgctttacgctattctgatggcctcgaggaaactgcgccattatttccaggcgcatcgggttacggtggttacgtcttaccccctcggtcaaatcttgcataatcgagagggtacaggacgggtggtgaaatgggcgatcgaactttctgagtttgatttgcactttgaaccgcgccacgctatcaagagccaggccctcgccgactttgtggcagagtggaccccggctcccgagcccgtctcaatccccgaggccaactcgggcccctcgcagttgcctcacaccgcccactgggtgatgcagttcgacggctccctgtctcttcagggcgccggtgcaggagtcacgttgacctcgccgagcggagacgtcctcaaatacctggttcgccttgactttcgggcaaccaataatatggcagagtacgagggactccttgcgggactcagggtggcagctggactggggatccgccgcctcctggtgttaggcgactcccagctggtcgttaaccaagtctgtaaggagtaccggtgctctgacccgcagatggacgcctacgtgcgccaagtacggcgcatggagcgccattttgacgggattgagcttcggcatgtgcccagacgggataacatgattgccgacgaactctcacggctcgcgtcctcgcgagcccagaccccaccgggcgcctttgaagaaaggcttgcccagtcg

SEQ ID NO: 89387 - DNA, 548 bp, Oryza sativa
  unsure (1)..(548): unsure at all n locations
atctttaggaaattgaaatactgaaataagaaaaataagaatgtgcatgtgtggcagcccccggccaaccctgcacgcccgagggggtgcggggttggcccgagcccgaaacctgacacccgaccccccttaggggtagaagcgacgaaggtgttcgatgttccacgggttaggcagctctgtgccgtcgcccgtggccagccgtacggaacccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtaacgcgcggctcggagggccgcgcgccgccttcgttctttcaagtaatcgaggtcatctctgcgaagctgatcttgatcagcctcgcagtacatgggggcccgaggagacctcanggtgaggtcggatgggagaaccgcttccgcgccgtaaacgaagaagaaaggcgttttcccgg

SEQ ID NO: 89388 - DNA, 576 bp, Oryza sativa
cacggggctccgctctgctcgatggtagcgtgctgccgccttcccgcatcgtgagcgagaggcaggctgggctgccacgccgcttcatgccggaatctgccaccggccgggagatagtcacgctgggcgagggacgcccggcgccagtctacccggggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcatcggggtgcgcccatcccttcggctgttctggtggttcttcaccgtgcagtcggtgtcgccgccgtcggtggtcggtggctgctacttccagccgcggaggccggtgttgaaccgctacatcccctgcgtcctccgcaagaagtgggatgactggaagagcgactggttctacacccccctcgccgacgaagcgcgcctccgacttccgagccagcccccggcgcaggcctccagctggcgggcgccggtagatctgg

SEQ ID NO: 89389 - DNA, 1163 bp, Oryza sativa
gcaaaattagttgaggggaaatattcctcttatcctcctctatctttacccccaagaatcggagcaaactgttgagtattttatccgaatcgaactcgtttttgagtttatctccaaaaccgagtttttgatttcccggatcgatttattgcgggaggagtccgatctcttcaatccaaggctataaataggaccccctagtcctcctctttcgttttccctctttcccgtgctctctcgtgctccgtagcctcgtcgccgcgtcgcgcaagccgccgacgtcgccggtcaacgtgcagccgcgctgcgccgtcgccctagccgtcgccgctgcctcctctcgccgccggcgggtgcgcgtgaccgagggctagcccggccgccccttcccggtcgtcgccggccaccggagcccctccgccgccggtcaaccgagccgccgccgtcgcccctctcgtcgccggtcgtcgtccgacgtcgtttgtcgttgtggtgagtaccgttgggttcgtctcgtcgtcctctacgtgtacatgccctcctttttcccggccgaccaccctagctccggcgaggtcgccatccgagccggtcgccatggatgatgtcagcatgacatcatcatcttctccttttccagttttttctaatagattaaatcttcggaaaatcataactaaataactgtagatccgattcgagtggttcaagttgctaaatttttctaaaatcaagatctacatgttaaaaatattcacatgtactgtttatgcttgtttttgtactgttttgttgatttttattctttcgctttagtttccgacgttctgaaggagagcgttttcgttgagcaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttcccaattaattaatggccgaagatgatcttattttcctatgggttataatttgattagcatgaaccttacatattggattggttcagctaaatgttatatgtatgtttgcttagccatgcttatatttaatataaatataaattatggtgatatttaaatataaactatat

SEQ ID NO: 89390 - DNA, 608 bp, Oryza sativa
ccccgcatctaaagcaatcaccttgctcttccccatttggttcatctttttcctcattggcttttcctttgcccttgggttttccctttcctttgcctttgaacatggcacctcctttctccttccatttcccgctcctacggcctctcttgcggttgcaagaactctcagcaacattagcgtgtgcttcaggcacagctagagaaccagtaggatgaggagaatgattatccatgaggacttgattctgttgttctgcaaccatcagtacttctatcagctcagagtacttggtgtacttagagtttctgtactgttgttgcaaaaccatgttaccagggtggaaggtggacagggttttctcgatcatatccttgtcagtgatcttctggccacatagacttagtctggacacaagcttgtgtaaagcggagttatacgctgtcacagacttaaagtcttgaaagcgtaaggtgatccagtcttgttgtgctctggggagcataatagactgttgctggccaaaatggtccttcagggactaccataggaccagcggatccctctcagtcatgtactcagacttcaggtttgggtcaagatggtgg

SEQ ID NO: 89391 - DNA, 696 bp, Oryza sativa
aaactacaaggcctggtgttcaggctttgcgccactgtgcgtaggaggggacatggaatcagtggcagttcaggagtttagccgcacactcttcaacatacgtccagacatagccctgagtgtcgcccagacaatcttccagagtgatgtgcgaagcctcctaccacttgtcaccgtaccatgccacattgttcagagcaccaaagatcttgctgtgccggttgtggtgtctgagtacctgcacaagcacctcggtggcgactcaatcgtcgaggtaatgccgtctgagggccatctaccccaacttagctcaccggacatagtcatccctgtcttgcttcgacacatccagcatgacattgcggtctaggtggtgcaaccattccgcctagagctgttcatcagaagttgtataatttcagtatctgtactccactgaatcacccgacttaggatccatctactgttgttgtaataagattctccatatgttgtaaattgatggcggtggagaagtagtctatggtgtttgtaaaccactgcacgtatgatgttcattataatgttggatgttttaacgtaaccgagtccttcagaattaaactcatcatgtcagtgtggccgctaccacgagctgcaactctgttttatggttcttcatgtctgttgcaactctgttctatgttactttttgga

SEQ ID NO: 89392 - DNA, 1074 bp, Oryza sativa
taacgtatccagggcagagcagcatatcgatcttagaattagctttcagttcacgcgcatcatacaaaaatggtgaccaacatgacccacgatgactacgtctccctctgcctcatggcgctcgcccaggcgggcgtcgggggtcagtggccggcgcagaaacagcagatcgacatggcaccgccggcaccggaacgcgagcttcttcggttccggtgctccgtctgcggcaaggccttcccgtcgcaccaagcgctcggcgggcacaaggccagccaccgcaagccgcagacgaccgcgttgcccatgcacgtaatcgacgcgccgccgccgccgtcggctgaggacacagcctcgtcgtcgacgacgacaacaacgtcgggcggcggcaggcacaggtgctcggtttgccaccgtaccttcgcgacggggcaggcgctcggagggcacaagaggtgccattactgggacgggctgtcggtggtgtcggtcacggcttcggcgtcaggttccgggtcgtcgagcgtgaggaactttgacctcaacctgaaaccggtgccggagacggtggccgctggcgtcacaaggtggggagaggaggaggaggttcagaaccctttgccgttcaagaagcgccggctgtcaagcccatcattggagcttaatttatagtagcatgttaattcatcgtaattccttactgtccagagattcattcgtttacttttttttcttgttaaaggtatcctttgtgattaattatctcttcgaccgtctttatattcgtgaccaaggaagaaataatttctgaatcatgattgatgaagcatctccattcaagagttaagtttatgatgccccaagttgatattgtcggcagtattaccatatgcttttttctccaatttatatctactagaaaaaatatctatgcgttgcactgggtgaaggttatcttaatcttattattgttatacggtttagctaaagtgaaattcattgtaggaatttgcttggatattgtttttacaatatcatgagctacaattaagagtccgatcgtcttaaattagc

SEQ ID NO: 89393 - DNA, 639 bp, Oryza sativa
aataccaaataaaagaattaccaattcatatatcaagcagtgcccgtaaaggacacaaatcaattagatccaatgatcaaataatttaaactaacaaataatgatctataattcattctcaacttgattaattttaatggttctaatcatttaaatgagcaaataatgatccataaaattcattctccacttgattaattttattcggttctagttttttgtagaatacagcattttacaacatgtaaccttgaaagcaatgtttataatggaactaaattcgggagcaatttggatgaatggcatagaaaacaagatgtgcaataatataaaaaacaattgaacgcatcatgggacaatcttgaaaaccttcatcttttctatccatgtgttgaaggaattcaccgtgttccggaagccaaggaatccatgttccttgctcttgttcatgctatccaaatgctcgctgcggacgccgaacacggcatcaacaaaccaccaattggtgatctcttcaagctcggtgtccatgagatcattctctttgacaatctctgcccacactgcctccttccccgacatggcatctgcaagcttgaagctgctctcttctccctcgtagccagaccattcgacgcc

SEQ ID NO: 89394 - DNA, 1097 bp, Oryza sativa
ataatatagcgtctatatatattgagcagattgagtacattaattttagattgaacaaatatacaaagaatcaaatgaatcaacactcctagaaccatatatgtcccttggcgacaatcaatcttggaagatccatggtcaccagcttagcttgttgcatactcgatgacagaaaccaaacaattagtgagttgaaaagaaaaaaaaaatcaaagaatagactctgttcaatagagtcgatcaatgggcagatctcttgtttttacaagatggcgtatgatgaattagttggacatcctgagcttcttgaccggcagtggactctgcacctcctcctcctccgcccacctcttgatcccggcggcggctgtgctctccggcagcggcatcaggttgaggtcgaagttcctgacggccgacgaggcggccgacgcggacgccgagacggagacggacaccgacgtgccgtcccagtagtggcagcgcttgtggccgccgagcgcctgccccgtcgcgaagctcctcctgcagatggtgcaccggtgcgggccagtgctcccggccgctgacgacgccgagtcctccttcgagtcaccagcggatgccagctgctgcgccgcggcggcggcgccgtagtggtctcccggggaaggcggcttccggtggctggacttgtgtccgccgagcgcctggtacgaggcgaaggccttcccgcagacggtgcaccggaagcggagctcctcaggcgccgcgggcgctgggcacagccacttattgcaggcctgcacctgctgctggcctcccactcccaccagggccttccccgcccgcgtgcaggcgagcgcggcgaggcagatggcgaggtactcctccttgttgatcgccggcgtgggcaggcccaaggacagcgccgtcgggtcgagcagcgcttgcagggcggccgtcatatctgtccccgttgccgtcgtcgtaaaacctaattaatcaagctgtatagtacgtagcagcagcagcgagcggtggatgatttgatgggattgattgctaacaagtacagtacgtagctgcagggagatggatggatgatgagctagcct

SEQ ID NO: 89395 - DNA, 690 bp, Oryza sativa
gaacgcgctgcggctgtcccgcaaccggttcgcgttcgacctcggcagcgtggagctgcccgaggggctggacatcctggtcatcgaccacaacatggtgtacgggagcatcccgccggcggcggcggcggcggggaggaagtggctggcgttcgacgtcagctacaaccagctgtgcgggcccataccgcaggggcggtacacgcaccggttcggggccaagcacttcgccgggaacaagtgcctctgcgaccgcccgctgccgccgtgcagcagctagcttaagcacgaacccaggcactgcccactgatcgattggttattacgtaatttgcgattgttgctgcatcgcagacatccttttcctcaatttactttgagatcattaatcatcattaataaattgtcagtgataagctggcttagcctagaacggcaagataaagatgcgttatatgcctggccatgctgtccagaatgtgtattcagaggatttgtggtgcgtgcactacttaaaagacgttttttcacggcgagaggcttatacattttaccggcggaccatatttttagctgtgattatccatatatgaagttatcccgtgaaaatagattttagcaggtggatagcttactctttttaccgcgtcgatgtaattggatttggttcggtaatttttcccttttttt

SEQ ID NO: 89396 - DNA, 3071 bp, Oryza sativa
ttgaagaagtagaacagattaggcaaaggggtatatcggctatccagcactatttgtctcggtgactttttgtgcaatagatcttagaaatttttgtaatcggctaagatactctagtactttactgtcttgacaatcctttgtgccgactaatataacttctaaatttgctcaaaaatttgcaattttccgctcaaaaatttgcaattttcctgtatgtgcccccctaattttacaatgtcaaaacattgataaaattataaaaacaactaagggcgatataaccatatcggccattgtgcatcggcaaaccacaaccgattacaatatggaaacaactaagggtgatacaaccatatcggccattgtacatcggcaaaccacaaccgattacaatatagaaacaactaagggcgatataaccatatcagccatctcaaggcgatgtaaacacatcggctatcatgtatcagcaacatcagccgatcatgcattaacccaaacacttgggtaatatttcttcaagtatttgccattcaatgctctgccatagacttccccatcaagtccttgcaacatgtaagctcctttagacaccactttatgaatttggaacggtccttcccaatttggcgaccacttgccaaatttgctacccgagttccaatcggcaaaatcaacttccatacaagttcaccttccgaaaaatccttgggcaccactttcttgttatagtgtcgagcaattcgctctttatccttggtaacctttgcaagggctcttaatctggattgaaccaagtcttccctttcattagccataaggttataatacttatcggttgttaaattatcttgcactcagttctccttgagccgattctaacctcccatggcaaaacagcttcatgtccgtaaacaagcttataaggagggacttggatcgatccataacaagccatccgataagaccacaatgcctcgaccaaccgagtatgccattgccgaggataatcagaaatcttcctcttaatcaacttgatcaagcttttgttagatgcctcgcttgcccattagcttgtgcataatacggtgaagaatttaacagtttgattcccatactatcagcaaattgaacaaactcatcgggcacgaaaattgaaccctgatcagttgtaatggtttgaggaataccaaatcggtagattatatgctcttgaacaaaccgtatcgcatccccagaatcaaccttattcaaatgaatcgcctctacccatttggtgaaataatcagtcgccaccaatataaacttatgtcctttactcgatggtggattaatcatgtcgatcatatcaattccccaacctctgaatggccatggtttaatgaaaggattcatagccgacgctggtgctcgctgaattgctccaaatttctgagaatcttgacatcctttgtaatacctgaaacaatcttccagcattgtcggccaaaaataccctgcacgccgaagcaaccacttcattttatgagccgattgatgagtaccacaaatcccttcatgaacttcgccgatcgcaactttagcctgatcggcactcaaacacttaagcaacattccatcaatcgtccgataatagagctcatcatccaataaagtatacttcaacgctttatatctcaatttccgagaagccgactgagatgtattttgtaaatattgatgtacatcatacctccaatcatcggctgttaatgcagcaaccttaaccctgatatctttgatcatcggcttataccccgatgccccttgggccaaatcattagcttcaatattttgttctcgagatacatgcctcagagttactagccgaaactccttcatcaactctcagtacttctcattataaaccattaatgtatcattcttgcactcatattctcgtgtcaattgactgatcactagcaaagaatcccccataatttcaatagcatcggcttcaacttccttgaataactgcaaccctttaagaactgcctcatactcagcttgattgttggttgcataaggtttaatagtataagcaaactcaaaacatgccccccgaggggaaattataaccaagccgatgccacaaccatgagtgtatactgatccatcaaataataaagtccatggcataatctcaaccgagccgattgaatcatcacgatgttctacagtaaaatcggctatagcttgtcctttaatcgccttcggcgatccatactgaagatcaaactcagttaaggaaaatatccactttccaacccttcctttcaaaattggagccgataacatgtatttaacaacatcggccttgcatatgacagtgcattcattggacaatagataatgccttaaccttggacatgaaaaatataagcacaagcataacttctccacgggggaatatctagtttctgcatccaagagccaatgacttagataaaacacaactctctctttcccttcaagctcctgaatcaagatcgaaccgattgacttcttaccggctgacagatatagctgaaaaggtatccccttctatggaggaatcaaaactggaggagagctacgatattccttaatatcgtccaacgctttctgttgctctgccccccaagtaaactgttgatcggctttcaatctcaacaatggtgtaaaaggctctaatcttccagacaaatttctaatctcaacaatggtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcattcaataaaaatctaagcagcggaaaaaaataagataaacggcgcagacgactcactccacaggcagcttgaccagggctacacctaatcctccacaccatcagcatcactgtagaactcctcctctgatgaatgattgcaaggtgagtatatgacat

SEQ ID NO: 89397 - DNA, 1790 bp, Oryza sativa
ctaccgacggcgacaggcgaaagcaagggtggcggcgggtagcggcgggcttgggggtccttttaaaggggcaaggaggtggcggcgaaggcccacggcgaccgccgacgcgaaggaaagtttagggttcgaaggagagggatcgatccgaatcgaactcgaatccacggatttccaaacgaaattagccgacgattccaaaagagaaaaggtagaggagatctcgggaaacatttcccctcaattgatttcaccggagaaggaaaggcgcggccgaatttggaaagagacggcggcacggctcggctagggtcgggcggcggctggccggaggtagacgacagccttgacaggtgggccccccctgtcagcggtcgcacgcgcgcgcgccagcggacggctcggctgcggactagcccggcttgggccggggagagagagagaaggttttggggcgactttcggcccaaaggcaaaagagacttttaaaaacctttttcaatttaaattattcattaaatgcaattccatttattaaaaatacttccttagctcaaataaatcctagaaaaatctaggaattatagagttaagcaaagtatttaatgaaattttatctggcccgattttatattggaatttattaattaaaactagatcttcttttcaaggcttttaaaatcatttctaataattccaattaaacaaaaatttatatatttaggatttttagggtgtgacagtccaacgctttctgttgctctgccccccaagtaaactgttgatcggctttcaatctcaacaatggtgtaaaaggctctaatcttccagacaaattagaaataaaccttctaacaaaatttatcttgccgataatctcttgcaattctgtcttgctctccggaggctgaatcttcttgattgcattaacactcctttgagttacctcgattcccctctcgtgaacaagaaatcccaaaaactggccagccgatacaccgaaagcacactttgtcgggttcatctttaggccatatttcctggttctctcaaaaatctttctcaaatcggctatgtggtcctctatctctttagatttaacaaccacatcaccaatgtagacttcaaccaaccagtcgattagatcatgatatatataattcatgtctctttgatatgtagccccagcactctttaagccgaaagtcatcacaacccattcaaacaagccgattgcaccaggacacctaaaagctatcttatggatatcttcttcagccataaagatctgattgtatcctgcatttccatccataaaactaaaaaaccttgtgccctgacgcagcatcaaccagctgatcggctaccggcattgggtactcgtccttcggggtagctttattcaagtttcggaaatcaatgcacaccctgaccttgccgtttttcttgataacaggaactatactagaaacccattcatcatatcggcaaggacgaataaaactagcatcatacaatcgtttgatctcagccttgacaggttcaagcgtatcggctttacatcttctcggtggttgttggtgtggcctaacccctggtttgatgggtagacgatgttcaacaatcgatcagctgagtccaggcatttcataatactcccaagcgaagcaatctctgaattctttcaacagctctatcaacttggttctaaattcgtactaataaatgtcggcctcagtcgatcacctggacctatatcaatttcttccaaatcatcacccgacatgaaa

SEQ ID NO: 89398 - DNA, 1103 bp, Oryza sativa
taattcgtactttttccttaaaaaaatcatctccacatagatcaatgacatctttatactgatactaaaaccgtctgtaagactgtgattattgattaatatcatttcacatatataaatgttcgataaacttttgaatattcgtggcacgtttttcaaactgttaaacagtgtatttcgtgtgaaaattttctatactaaagttgttataaaatatcagaataatctattttttaagttcgtaataattaaaacttaattagttacacataattacaccttgtttcacgtggaacacttactagattttaccattaatcgtctttacaggagcccacaccatcgggcgggcgcagtgcgccaacttccgggacaggatctacaacgataccgacatcgacgcgtcgttcgcggcgtcgctgcgtgctggctgcccccagtccggcgacggcagcggcctcgcgccgctggacgagtcgtcgccggacgccttcgacaacggctacttcggcggcctcctctcccagcgcggcctgctccactccgaccaggcgctgttcgccggcggcgggggctccacggacggcctggtcaggagctacgcgtccagcaacgaccagttcgccagcgacttctcgacggcgatggtgaagatgggcaacattagcccgctgacggggtcggccggcgagatcagggtcaactgccgggcggtgaattaattcatgacgcatgggcaatcatctagcttgcagagtttatatatatggaaatgaaatggcatccaactatatatactatatttatttattattttattaattattagtttccgacaatgtgtgtgtgcatatatagcagaaatatgatttggttccattattgttatctggaaggtgaaaattaaagaggaaatacatatcatgtgcagaaattttcatatattgccgcaaattaagatggagtcttcatagatagaaaaaaagtacgaattacccctccccttcctaaactatcacggtagaccgaattaccccctaaaccaaaaaatcagacatcgctcaccttgaattttcaattctggacgaataaccccccttgac

SEQ ID NO: 89399 - DNA, 714 bp, Oryza sativa
tttggcccaatctttcagtgagttgatgataactacaatttgggagaaacgttgacgacccgactacaaccgtacaagatgttgtgttgtgcctttgcgatcgatacacctctccgtgggttgttgatcttgtcggtgcagatcaaccttattcctgcaagcaaattgaagaaacaagcaagaacaagataaaagcaatctgaattgcaaataggaatgaatacacatgataagttggggttttcaatacaagcagatggacggtctaggtgccacgcgcgctacaaggaagtagcaatggttaaactttcttctaaacaaaacccaagaaaccctgaaggggtacctaccaatttataggggtgggaggatgaccaaggggtgcgaagggttgttctccacctagttgggccgcactccacatgggccccacttgggccggggtcccaaacaaagttacaagcccataggcccaagataggtgacgcaacaccttgtgattgcagcaaaacgacatggaatttggcaatgaggctggatccgttggaaagagggctttgagagctttctatcaagtactcacgggctaaaaacggaggttgtatgtagatttggcggccatttgaagtcagcagtgtagcaggtggccaaatcggattccagcacttagaggacttgatcttgatattttcttgttcatccatgatatgagca

SEQ ID NO: 89400 - DNA, 1498 bp, Oryza sativa
tgcctcgccgccgcctcctccgcccccgccgctggcctctccgccgccgcctcctccgctcccgtcactcgcctcgccgccgtgcctcctccgccgccgccgccgccaccccgcctcgcctcgccgcgtcgtggcctcctccgccgcgccgatgcctcctccgccgcggctcactgcctccattgtcgccgtctaaggaggagagagagagtgagagatagaagagagagactgacaggtggggcccacctattttttaataaataaattgctgactgtattgccacgtagaccaaaccaccgcggattgggttgaggggggtaattcgtccagtttgcatagttgggggtgaagaatgtccggtttcgtggttcaggggtgtaattcggacgaccgcgatacttcggggggaggggaggggggtaattcgtactttttccatcctaatattatctcgtactccctccctccatcccctaatataagatattttgatattttgcttgcactgtttgaccattcattttattaaaaaaattttagaattatttttttacttactttattatccaaagtattttaagcacaacttttcgttttttatttttgcacaaaatttttgaataagacgagtggtcaaacaaaacaattcaagcaaaatatcaaaatctgttatattatgggacggagggagttgatagtttattcaaaaaatttttgaataagatgatccattgccatgtcttgaatggaaagggagttgtctaggtatggaaagtgagatgattggatgaagagaaatttttgaataagatgatccattgccatgtcttgacactatatgtagaatctataatggatggtatcttcaaattaaattcctatccaagtatctctcttctctcttcttttatccacttatcctataattttcattcttaccttttatccacttatcctataattttcattcttagttattgtatagagagggtttcttacatgagaaatgatttcttcatctttttacctctcttctcattaactctattgccacattatattttgcttatgtggtaatgtatttaatactatggacactggatgacaaggagggttggaatggcctaatgagatactcgtaatactatttacataatacacacctactaaatattatacgctagctactaagggactgtttggttggttgccacactttaccacgctacactctagttataccacactctcttaggtatgtgtttggtaccctatagcaattatgtcatgccacacttttatagcttgggacccacatgccatactctcaaattcaaatttaaagctaattttgccacacttatgatcaactatttctaagccacactattgccaccatccctcaactaacctaaacttagttatcgcaaggctatccattaaccaaacatcccctaattacagagaccggccggcaaccttgaagccgccacc

SEQ ID NO: 89401 - DNA, 870 bp, Oryza sativa
atcgtaccgtgatggaatatcttcatgagttcaatcgtctagctcgctatgctccagaagatgtgcgtactgacgaggaaaggcaggagaagtttttggaaggcttaaaggatgagctatcagttatgttgatctctcatgactatgaggattttcaggagttggttgacaaagcaattcgacttgaagacaagaagaacaggatggataaccgtaaaaggagaatgactgtattccaggaggcacaaggtagtagccagaggcagtgtatcaagccactccaaattggtgaacctttttccgctggtcaaggacagtcgcaaccgttgaacatcggtggtgagatcaaattagagactaatgatgaacttaacatcgagcaggctaatcagctggtgccagttcagcaggatcagtctcaagtgaataacagtagtggaagggagcagcaggtatgtttcaactgttacaagccaggccactttgcaagagagtgtccgaagccgaagcatcagcagctgcaaggtcaggtcaacaacattgttgtcacaggagccaatgcagtgccagttgcgtcttcaagagttgtgtcttcaagtgttacaactcagccaccagtttcaaggcagcagtagttttcttcaaagccttataataattatcggagttatggaataagatagactgcagtttacctatccctttttctttctagccgttccgaatctcgggacgagattctttgtaaggggggtagtttgtcacatcctgattttcgtttcaggatttataaattatttaataaattattaatagaatttatattaaatgttctttaatttacaagtgaagtaaaatgtgggaaataaa

SEQ ID NO: 89402 - DNA, 3546 bp, Oryza sativa
  unsure (1)..(3546): unsure at all n locations
cagaggccaaatcgagggaggcggcggggtaggtcctgccgtggaggtcgaatccccggaggggaacgagccggcgaggtgggattcggccggccgcatacacgcgcctccaagtcaaaccctcatctctcggttgctgcgaaatctctccaatgcgtctcataatctccgtcctgaccggctcctgagaaatggttgaaatccggtataaagtatggagaatttcagcattccaatctaatcctgcatgacgattctcatttctcaagtcgtacaatagaaattttggaaatgtgctagtcggagatgatttcacctgtgttacttgtattgcttgtagcagttatccctgcacataactctattgatggttaataagatataagctcttcttctagtttcaattacacagtcatgctattgatcttcctatgtactgttcctttgatgaatgatcagtatgtttggcttctttcagtccactttacaggaaaaagacttgatggcacttggtttgcatccaccagagaagatggtgtgcctctgacttttatattaggacaaggtataactgtacaccctgaatttaccttttagtaattgccgggttaataaatccataacacacacacacaccactcgatcagaaccaacggattcaaaactatgtaatgttcatggtactttctatttaaccaacctatggtattcttaatcttcttagatattgtaatggctgtgaaaccttgtgagttgtgatcacaaaacttatgattaaacaccagtatgccactaaccaggaatcttagggttttctacatccgtcgccacaaaaccattgattttgtgtaatttactcaaacagtactcccagaaactattatggaaaatgcatgtttagcacatgggccaagtataatttatttttttccttttagtttgtgataaatatttaaattgcttcacgaacttatttatattttttaatgagtaaatttcatagaactccacctattgtggtccaagttgcacaaaaccacaaggattttggcatttggcacataacttgtattatggttctaaagtttcataaaaccacactgttaaccaatttgacatattcctatatcaaattttataaaagctttacttatatcaacgtaatatgtattatattatagataaagaattcataaatttgggatgtgattgtagaactcaaaagtgtggtagatgaaagttaaaataatgaatagtgtggttttgaaaactttatgaccataatacctagggttacttgaaatttactcttttttaatccatcatgaaactgtcatgtatgtagttttattgatcttaatctgatcatctagtcatatattaattgttttctttatatggatttgttgatttctgtgttgtataaacttctccacggacctatatgatcaaacagcgggatttgtgtcaagactcttgttaaggactgaatcttttaaagcaaaagtgactgttaattatttggtgtctgacatttttgtttcaagccataaaagattctagtagaatgcagtagataactagattacatggctcatctttcatgtgtctttgtttttcaaaaaaatctggctccttgggtgtttgtactactgtaaccatacttttctcaaaaacgagccacactccaatgaaataaaactaaatgctgcttatagagaatgtgatgcgaggcttcagtatggctgttagctcaatgcaagcaggggagaaagctgtgttcaccatccctccagaattagcaggcaccaagtctcggtgtccagttgatatcccagggaatattgcccccaatgaagcactgcggtttgatattgagctcatctctcttgtcaccataactgacatcctcgatgatgaaggcatactgaaaaagatcatcaagcgtggactggggagcgataagccttgtgatttggatgaagcacttggtatgcaatactacattagttactccctgannnnnntgttttctttagttttgaatttgagaaattaattgtgccaatatttttccattatttcttcgatactgcaacagtgcccgtgctgtgagttcattgagctaatacttttacattttccttttccttttgtagtgaactacaatgcttgcctggaggatgggatgtcagtgtccatgtctgaaggtattgagttcaaccttgcggaaggtaagaatatttttcctttaccatgattgaatacacttaactatagaagtattattttactatgtcagtctaatagaattgtaaaatccaggcttcttttgtcctgcatttgcacgtgctgtggagactatgacagaaggagaggaagctgttctcattgttaaacctgaatgtaagctcccctccttgtatgtaaccttctagtagttgagtaaaattaacaatttgtgtcttctcatgcaacttatatcttgtaataaattcaatagtcaaagcagatagtggcaactaaatagtcaacaatcatcatctcaaatcttcctttctttgcgtgcatgcatgcattaggaatatttacaagcgtgtctttccatgtgtcattttttgaagaatacactcatcaattaatcttgtagttaatatgtattcgttggtgctctctttctcttgatccctagatggttttggtgaacggggtagaccatccataggggatgaagccggtgtgccacctgatgcaactctctatgtgtaccttcaattgatgtcatggaaaacagtgaggcacattggagagaatgggacaatcctcaagaaaaccctttgtagaggaaatttggaaggacagcagacagagaatgaagcagtggtcggaggtaccttcaagttagctcctaatctgaaattctgaagaacatatgtaggcatatagctcattacctcttgcttgcatatcaatattcctaatgttcgtttgcaatggcagttcgactgattggtaaactgcaagatggggctgtatttgatcagaggggccacgaaggagatgagccgttcaagttcatggttgacgaaggttgaatttctacaactcgactaactaaaacttgcttgtttctgataagtgtcagctattacttttgaaatgcagagcaggttagcgaaggcctagaggaagctgttcttacaatgcgggagggagaggtctccttgttcaccattcccccccatcgtgtgcaggatcaacttttggttgtccctgttggctcttccgtgacctacgaaatcgagcttgtctcagttgtaaatgtgcgtatatcacttgacttagttgccatgatgtgaaaaattctatattgttaatgcgtgtatgcagcttgagttagtttccatgatttgaaaatatagaaccaatcttttggaaactctacatgacatattggatctgaattaaatttaggacaagcctccccggctcatgagtcaagcagagaccatcgaagctgcagctgaaaaggaaaaggagggagac

SEQ ID NO: 89403 - DNA, 2520 bp, Oryza sativa
aaggggaaaaggcttcgtgctcctccagtcgggcgcatttgccgccattccgcccgcgctcgccgaggccatcggcgccgctgggtagggcgcgagtgtcttggaggtgatgggcggggcgcgcagactgctcgtgccggacccgaccgggacctgctcccaactcccgtggcatgcaagttgagtggtgccagatccggcggctacgactgggcaacggctgatccggggaaggcttcgtgctcactggtgctgccttctcccatgactccgacctccctctctagccgccgccggcgtcccccgctggatgcagtcaatgtaggctcgggactcgcctgatctggggtggatcgacgaccattgggctgtcgaagcatagcagagacccaggcagaggtgtaggttgctgcttgcaggtccgccactgcccgtggacagacagtgctcgtcgatcgcattgctgtaggcgccagcgactagtcctgccaggcctgactggagaacggtgggatttggtgctgctgcaccctcagcggcgctggttagttccttttttttttattggatcgatggaagttctgagctaagcttgttactattgtgcttttggctttttgtggtctcgatctagttgaacagagctgttctaagagcatcttaatattattcccttgcttagcagtaaccaagtattacaaatgaatagcgataagtgtatgacatgaaaaatttgcccctttatatctttgtagtttgtaataagcctgctaaattctcaatgttcatgtgttctgttcaaaatttatatgattcagaaactatccaagccacttgtgctagcgttattcataaattaagatgtcatggctgatatgatctgtgtatgtttgaatttcgacagtaatctcaaatttatacaactcaaaacttgtataaaccaccggtgctatctgttagagcttgcattttcagaaatagctgtaattggacatattttcataaatgatcatgtattcttagtgaatttggttctatgtattgttgtgatgattgctgcttttgctggatcaagcatcatgagtgaatagccctgataccagagggtttttttgcaacgcatgaagaaccatgctctcatcttaattttcatttgttcagtcatgaattgtttgtgcaatatattcagaaaagtgttcccatgtgaatttcatttgtttagtgatatatttgtgcgtgcaatatttggaaaactgccaatagcatcatcatcaggttctctgatatgtttgataaatgaaaactctagaagctcaattcggtagcagttctatgaagttttgtggttcaacagagcatatcaattgattttctctgaactgctctgaaattttgtggttcaacagagcataggtgtttgaataaaataatctacaacctattaacgtgatgatggtaacattttttatcagtgaaggattaaaactccttgattcccatttatttatgcgaatgaaaaaatgagccattttttatcccagttttgcatcgcggaggaaaaaaaatctatttttcaaatgttatttactaatgtgtcatgattcatgatctgagaatttatcattgttttagacggatctatttggttttacttaaatgctcaccctctagttttaacccttctagaactgtgccatctgcccatctgtaatatagtgcagcggaatgattcattcggctcagttgaactagaaaatctagaaaatgaaccttgcagctgaatgatttattccgatcatcttgaccaaatagatttatttctggatttggtatttgctttctcattccgctgagttgcacaatgttcaattgtaggctgggagtaaggcaagcccaagaacactatagtccggatttaatttttgctttctcattttcaggtatatgctcatgtgaatacaaccaagtacattttcagatccggttgctagccagtgccatggaggagcagcaacaaccacctccatgacgcgacgccgtcaatgtccagccagcgccagtcatctccgccaccaaccaccgactggtctctagatctatgttatattgtcatggagtaaaatgtttactcacaccatatgattgtttcatggcgtgtaggcttattgtaaaaaagttactattctcatatttctcattgtattcatatcgtgtaggcttattgtaaaacatttaccatgtgctaataagtgtccgtgaaaaatacttgagtctatttaactatatttaactaggtagtaaaattattactcaacaataacgaattaatctaacaatatgttcacgagtaattgatttacttagtgaggctccagtgtgaacaaaaaccaataacttattgacgaaaacaatattgggcgcagacgtaatctcctattaattcttttacttatggctccacgttggaaggaaaacaacagaaatcaattcggtgtgcggtagtgttagtaactcgtttac

SEQ ID NO: 89404 - DNA, 7219 bp, Oryza sativa
aggtttgcacgggagagagaagaggccgtgcgggaggaggaagacgaccggcgcatgggccccacgcggccaggcgcgcggtcggcgcacgcacgtgcgcggcacgggcgggagggcgccgctcagcttgggcccggaggcggcccaggaggagaggagggagaggcagcccgggagagagaggggaggagagggagctgggccgggagggggagggaagaggtgggccgggaggaggaggagaggcccgggagaggagggaaagggagggaggagagggagactttgggctgggcttggcccaaaggaggaaggaggattatttttaagtttttctttttaataaactttgatcatagttgttgttgcttaataaatatttccggtactctaaaaattcaagtaaaatttgagggctcattttagaccagggagaatttaacaaaaattctccgggccacattcgaaattttcttgtacgtattttagtgtttgccaatttcttttcgaattttaattaattctattattccttttagaaaatgatttttatttcgggatgaatttatcaggacgtgacagcttgattattcgtcgcataagatttaatagtataagcaaactcaaagcatgcctcccgaggcaaaattataactaagccgataccacaaccatgagcacaaaccaacccatcaaaaagtaaagtccatggcacaatctcaaccgagccgattgaatcatcacgatagtcaactatgaaatcggctatagcttgccctttgactgccttcggcgatccataccgaagatcgaattcagttaatgaaaatatccattttccaacccttcctttcaaaattggagccgacaacatgtacttaaccatatcggccttacatatgacagtgcattcattggacaacagataatgccttaacctcgtacatgaaaaatataggcatagacataacttttccacagaagaatatctagtctctgcatccaagagtctacgacttaaataaaacacaaccctttcttttccttcaagctcctggatcaaaaccgagccgattgacttctcaccggctgacaaatacaaccgaaagggaactcctttctgtggagaaatcaaaaccggaggagaactcaaatattccttaatattatccaaagctttttgccgctctaccccccaagtaaattgttgatcggcctttaatcgtaataatggcgtaaaaggctctaatcttccagacaaattagaaataaaccttctaacgaaattaatcttgccgatcatctcttgcaattctgttttatccttcggaggcttaattttcttgatcgcactgatacttctttgggtaattttgatctccctctcatgaacaagaaatcccaagaactgaccagccggcacaccaaaagcacattttgtcggattcatcttcaagccatatttcctggttctctcaaaaaccttcctcaaatcggctatgtggtcctctatctctttagacttaacaaccacatcatcaatatagacctcaaccaaccagccgattaaatcatgatatatataattcatagctctttaatacgttgctccaacacttttcaagccaaaagtcattacaacacactcaaataatccgattgcaccgggacacctaaaagcggtcttataaatgtcttcttcaaccataaaaatttgattgtatccagcatttccatccataaaactcaaaatcttatgccctgacgcagcgtcaaccagttgatcggccactggcattggatattcgtcctttggggtagctttattcaaatctctaaaatcaatgcataccctaaccttgccgtttttcttgataataggaactatactagaaatccactcagcatatcggcaaggacgaataaaaccagcatcatataagcgttgaatctcagccttaacaggctccagcatatcggctttgcatcttctcggcggttgctgatttagtctaaccccgggtttgataggtagccgatgttgaacaatcgattggctgagtcctggcatttcataatattcccaagcaaagcaatctctaaattcttttaagagctctatcaacttggttctgaattctgcacataaatttttactaataaatgttggtcttggccgatcgcctggacctatatcaatttcctccagatcatcggccgacataaaaccttgaccttgtttgtcatcgagatcatctactgtatccttggtgtagacgttcgaaccctccacgacgccctcaaaataatagcttgggttcttcatcttcaattggctatatatcagaatcggatacttttaaaaaatctccattccaaacttttccagataaacaatcaaggccatccatctcccaaagagctaaatcggcactagcaacattaactgacctgtcggctggcacgatctctatgttgtcgccttgccattgaatcaaacattggtgcatggttgaaggaatacaacaattagcatgaatccaatctcttccaagcaacaagctataagaacccttcccatcgatgacaaaaaatgttgtagggatcgttttactgtcgactgtcagttccacgttcaaaacccctttggtttctgatggattaccaccaaagtctttaagcaccatgttcgtcttgatgaggtcttcggcgttcctacccaattccctgaatgtagcataaggcatcaagtttactgcagccccaccatcgaccatcatcttagacatcggcttcccattgacataaccgtttatatacaatggtttaagatgccgattctctatcccctcaggcttctcgaacattgctcgctccggtgacaaaaccaacttagccgattcctcttctatctcatctacatcggcttgatcaatcccgaattcggctggcaatgtaaagaccatgttaactggtgctgttacaacactcttcccttttgccaacctttttgcctcttcgactgcaacatcatcggctacaggaacctagctcttaacacgccattcctgtcttggctttgctttctttagccgatggttaatttcctattcaacttcttgaagctgctccctgtttctcaacctttgaacccttctcttctggttctttgtgaaaataccagaaggacaccattgatttgtcctaactacctcatccttctgaccgcgaccttgattcactaggcccaatctttgatgaacagacactctttcctgccttagccgattattcccattatatgactggcttgagctctcaatgataccattgcacccagggcagttttcgatggacggtaacctcatcccttcattccagcagaatctaaagaactcacaaccccaatgaggatcaaaaccatcatcgtgttcttcataatgcttctcctgctgcttgtcatacttcctctgatatttgttgatcatcttagccgaattcacttgaaaaccctttgcacggaccctatcagctgtatgtaccatattaataggaaaaggattaccatcgaccttcattggtttcttcgaatcatcaaacttgatttttcctccctcaatagccatttggatttgctgcctgaagaccttgcagtcattagtcgtatgagacccagaattatgccacttacaatacctcttcttgcccaactcttcagccgatgggattgtatgtccggtaggaaattgaatctgtttttcttgaagtagcaaatcaaatatcttatcagccttggttatgtcaaagtcatacctttcctcttttcctgagcccttcacccattggcatggtataacctttttattcctgacccactcggctgcagctattttggaatcatcatcctcatcatccgatccatacatataaggatagacatgattaatcttcctagagttcttcctagcatccgtgaacctttgttcatgcaaagccaccttctgtgtaagatgtaacaagctttcgaaatcttcagatgagaatttttccctgatcggagaaatcaacccttgaaaagccaaatcggctagctgggcatcagtcaaactcaagctgtaacatttattcctcatttccctgaacctttgaatatactcatgcaccagctcatcatgcttttgcttgattgacgtgagatcagacagcttcatctcatgaaccccactatagaaataactgtgaaactgcttctctaaatcggcccaactgttaatcgacccatgtggcagagaagaaaaccaagtaaaagccgacccagctaatgacaaccggaataacctaaccctcaaagcatctacagccgatgcctcaccacactgagctaagaatcggctgatgtgctcataggttgatgtagtattctgtcctgaaaactttgagaagtctggtactttaaaccggttaggtaaaggaactctttcaaaccattcaggataaggttgtcgatacaaattcccagtctcttttggtttaagcccaaattgttccctcattacatcagctatcacgtcggcccatggtcgctgctgaggtgtttgttgtggtataggctcaaactggttgtagaattgaggcggcaccgatcctgtctgttggtactgaacttggggtgatggaggctgatattgataactcaaattgcccccttggcaattgtgaaggttcggctgaataccacgcgccaaatgctcaggaataacttgagccaccaccggaccatccggttgcatatgatgaaccaagtgttccgggaccgcctgatttgcagtgtactgcacaggctggacaccaggcattgcaaacccagccgatgcgttcattgaggcttgctactgaatcggctgaatgacctgctgtctcaacggtgtctgttgaatcggctgtaaagccggttgctttggtggcgtctgctgaactggttgcacggcctgctgaattggggatgcttgttgaataggctgcacaacctgttgcctagacggtgtttgctgaatcggctgctgctgagccgaattaatagcattctgaggaggtagaaacatagatgcaacctggtcttgtgttagctgaatcacattcggtccaggatactgtgattgctctcttaccaataattgaggattgattaattggcctggagccgacgacggcgctgcaggtgctggagctgatgctggcgccgttggctgagctgatgatgcaacaggaggaactccctgagtaagtggatgaacatcggtgatcaaagttcgataatttggaaaagtacccccttgcaagtaagctgggcctgcagcttgatgttcagctattgagccatcggctaccgatttcatcatatttgacaaggtattagtcaacactccagattgattaatcaaagcacaatacacagcatagtcaactcgatcttgaaagttattgaaaaaatcttggaatgcattgtcattctgattaagatttcccccttgcggtccctgagtgccgtcaccttgaaccccatggtccccttgagggtcgtcgccttgatctcctggagagccattagtagcacctttgttactcggctgggctgatccgtctggaatttgtttcttttctccctctttagatgaaccgatcccaaaatcctcaggaaccaccttcaacttgtacttctgaaaaaatgtgcccttgcgagtttgcatgaatgaacttaaaaattgatctcgtgcttgctgcatcattgcattgaagtatttttctgttcatgagtgaacttctccggatcgatgggtacaacgtttccttcatggacgtcaatcagaccgaatttctgggtcttttccttaccactacccgggctggccgacgacggagacagtggtggtttctcagccatgaaggaagctgttcttctgacttctaatcagccccaccgggcgtgccaaaagcgtgttgatggaaaacacgaggcctgggagatctgcttaactccaatgcaggtccaaaactcaccttcggatgtacgagcgtgccagttgatttgatcctacaatcaacaagaaacaaagataaataaaccatgattaaatccataaatgatagccgatcggctagatgccgatgacatatcatttatctttgaaccgatgtcatatgtgaatcgatcggcaattgttaaggaaacaagacggaactaaatctgctcgatcggctgtagatatcaatgatatataatccgtatattgacatatacttaaatcaagtgattaggatagatcggtcaccttgccgagacagtataaatcacttagattgaaatatatattaataatgagattatacatattcatagcatagccgatcaaatagatctagtatgtatcggctaatactccgatactactttatattaagatattaaagcaaataaaatatactaaacagagatctaatatacttaaatgccacaagatcttaacatgaagggcagatctaacatattaattgagcatatagagcaagagcaactagatcagataagatcggctgaaactccgatactaccctaatcggcaaccagtaggcaggctagagattgaaattctaaacacgacttaatagatcaaactcaactgatacagcattaagtatgaaaagaaggacaatatctagacaatcaagccgctggatgtttcatagggtggtggatatctcatataatctaagccaacatcattatttaacctaatcggctgtcttctgctagcagatgttagctgattgtaggttagatgacgatattgtcaaagattatgtaagatatatgataacttgacggattacataaacaagattagagtatcataaagatagaagcactaatctcgagaaccgatgcaggttttacaggttttacctcttgttgaagatcgaaaccgatgcagctcaacccgaaagcaagaactcgtcgaaataaaactaaagcaaaaagggtggcgatgcgccgaaattgtattgaacgtgtgtgtgttcctcattacattgggctcggggactatttatacccgagaattacaagatatatccatattggacacgactcttatctctaacaaactctaagataccataagtctttgcggcagacttttgcccacatttatctctaaggaat

SEQ ID NO: 89405 - DNA, 1857 bp, Oryza sativa
ggtaccggaatcaccccataagggagactacggggaaagggaactcccggaaggaaagcaattatgacggtagacaacaatttattccgtaaagcccatttcactgttttgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatattaaatcaatgggtacacattctacacgagagcccaagacatgaagagcatgaaccaaaacagcgctgttcgtgtcgatgccatgggacatgatggaacaactgccacgtattacggtgccatccaggacatatgggaacttgactatggtcctctcaaggttcctctgttccggtgccaatgggttaggttgactggtgaggcgtaatgattgatgacagtgggaatgacaactgttgaccttaacaaggttggatactcggacgaaccttttgtccttgccaatgatgtaacgcaagtctttttcgtgaaggacatgtctagcaaaggaaagaagggcagagggcctgatgagccggaacgtcaagtggttctcccaggcaaaagaaaaattgcgggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgctgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacaggtggcaatttcatatgtacgttaattagagtttttaacatttaatttactagcattcatatgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttg

SEQ ID NO: 89406 - DNA, 7638 bp, Oryza sativa
  unsure (1)..(7638): unsure at all n locations
acgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattatgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatatacatatatatatatgtatgcatatatatgtattgaaacatatatatgcatggtttatatatatatatatatatataaactatatatatatataaaccatgcagcaacagggccatgcaaaaaaaaaaatggtcagctcgatctttagtcccggttatttcacccgggactaaagatagcgatctttagtcccggattggtactcccggtttggaaaccgggactaaaggggggttacgaaccgggactacaaagggtttctccaccagtgatatatcatctgcacatcctttttccttctcttttctccttcttctcctctcttatctcgtttctctcttcccttctttgggccggcggcgggcggaatcggtgagcgcggatgagggcggcggtcgagcgttggggaggctgcggtgggcggtggcggtggggaggagccgttctacgtgccgtggtgcaaacggctgtcggtggacggcaaggcatccaccacgctacggatatgcatctgggagtgagacggtgagggcagggacaacacctgcgacattgtcgccgcgccgctccgccgcagctgcagcgccaaggcaatgccgctgccagccccgctcttccgaatgatgacgccgccgccgaggccgcagaaaggggacggggagtaggccagnaggcctggagaggccatccgcaaggggcaccggagctacagtctcatggtcaacctgcagcttggcgtaaggtgataccaattgctctatcccttcctgctcttcctcccactttctcaaatactctgtcccaatgtttggtttggttttggtccctgtggtgagctgcagctattcggtgggggaagtcgtcggcgctgccattccagaagctcgccacatcggactttgacccgtgggagaagctctgccgccacgctcacccaccgtccgctccgcccgcagcccgccaccgcgctcacccgccgtctgctccgagcacaacctgccgccgctctgctgccacactcacccaccgccgcgctcgcttgccgcccacgtccgggctcgccgattccgctcgctgctagcccgaagaaggcaagagagaagaaaaaaaaaagatgtgcagctgacatgtggaccccacctatttttttattttttttattgactaggatgccacatcagcgaaaccacccatatattgatatatacttgttaacgaccaaatttggtaattcaagtatgggggattgttggcgatatggcatgaggccttcgaccaaatctgctgaaaccagtaaggattcaagcccgaaacgtcaagtttagtcagggcgaagccccccatggcgtagactaagaagcaaggaccgcgagaggcagggaatcgcgcgggtaccttgccaggccagaggcctcctgggcgaaggatgcagggcgaagagtatacgcggaagggggacaacttcgccatagcaaattcgaccccgggaggaccaaagaagccatcctagcccatcaagcctaagggctaattgggtcgataatcgcttgacggcccgctaagggcccatggaccacaattacactatgtacccatgtaaatgtccctttcataagggcaaccatgtaaattcctctgtataaccaaaaccctagtagtaagaacctgtatgctataaatagccccataggaccatgtaatagggggatcctaagaaaaattctcaatttaatacactttacttctttcccaactactgttgagtgaccacgtgtttcgacgtatgcggttgtcgtttcgatcacagggatggagataaaaccgaagcggaatccaaggtagagatcgttccggaaacagagcaagaatcagctaaagtccgaatcggccgcgaccaggatcggcagagttcgagtcggacaagggtagtcgattgagtcgattccgacaatgtgatttggtacacgttgtcagattgggttaatgtgcttcatatggattgccacgcacggactaagtcctgaaaaggcaattgtatctattagttaggatattttatgtaatttccttagagataagtttgggcaaaagtctgccgcaaagacttatggtatcttagagtttgttagagataagagtcgtgtacgacaagaacatagtttgtatctcgggtataaatatgacccgaacccatgtaatcaaacaatctcggtgcatcgccacccttttacttttgtttactttcgacgagttcttgatttcgggttgagctgcatcggtttcgatcttcaactagaggtaaaatatgttatggcggcttgcgttctcaggattagtgcttctatctttatgatactctaatcttgtttatgtaattcgtcgagttatcatatatcttatgtaatctttgacaatattgctatctaaccctcaatcggcgaacatctatcattgaaaggcaaccgattaggttaaatatcaatattgactcagattatataggatatccaccaccctatgaaacatccaacggcttgatagtctagatattgtctttcttttcatacttatagctgcatcagttgagtttgaccttataagtcgtgattagaatcttaatctctagcctgtctttgcttgccgatttgggtagtatcgtggtttcagccgatcttacttgatttagccttatatcttatgtgctagattgatatgttaaatctaccctttatgctaagatcttgtcgcatctaggtatattaagcttcatgtttgatatattttgcccgatttaatatcttaatatagagtggtatcggagtattagccgatacatgttaaatctatctgatcggctatgctatgaatgctataatctcctttttaatatatatttcgatctaagtgatttatactgtctcggcatggcgaccgatctatcccaatcacatgatttaagtatatattgatggaagtattatatatcattaatatctttagccgatcgaatacatttagtcctttcttacctatttatgattgccgatcgacttaaatatgacatcggctcaaagataaataatacatcatcggcgactggccgatcggctatcgtttatggatttaaccgctatttttctatctttatttcttgttgattgcaggatcaaatcaactagcacgctcacgaacctaaaggtaagatttttggacttgcactgaagttaagcagatcttccaggccagtgtgtgtttttcgcatcaacaatactgccataggatgccctcccggacatagactcgggccccacgtgcggggccatcctggaggccctcgtcggggtgggaggcgaccgtgggagcggcgccgacgaggtcatggtggtcggcggcggagtcggaggctgcggggacgaggaggatagggttctggtggtcggggaggagcgggacgagaagcttggttctcacaatggctacgtcgaggggatcagggaaggaatcgctggttcggatcgcgcaaaaggcaatggagaagaggggaagaagatggaggtggtggtggttgctgtggagaagacgatcttggtggaagatttctcgtgtgagctcgattggtaactctagtactctactactacatcttcgcacaatgatgtgagtttttttttcttttccagtttgtttggttaaactagtctcttagaagttagatgtactacgatttactgtatttttttctcggttgttgtttgttagaatgtgatgcttggcttttagatcagatgagatcccatgaagtcatgtttcactgccgatggttgtgaatgtggctgttccgctgttcccctttcaggatatttgttcaacttaggtatatgtacaaatccatacaaagacccgtagaattatttgggacattccaactaatctagaataactttgttaaggtcaactacagccaattcgatgatgatttaatgttttattcacgtggacaaagaggctctaatcaacctctctaagcatagtgtgaatatcgtacacctaaaagagaaatccgtgctttattaatgtggccttggagaatgatttgttagttaaattcacaatcgctgatgcaaacatataccagaaacattcggtttgcagcttaggttgtctgttagatattgaagtgtcacataaaagtgacgaacaggcctcaagtattcattgacagtacgtaccatgatggtttaataaaaggaaattaacagggtctgaatgttaaaaatagaaataacaaaaagaaattacaatatctgagctgagcacagcatgtagctacatattttttcgaatcaaatattaattctggagagatatcacgtgaataatgattggcaactacaaatatagattaaatttcaaacttactacatacttttggtcatctctctgtctctctggtcgggtgcatctaatgacgactcatccatgtcttgtgtgcccatcttttgttgaaatcgctgcccagccaaagattatcacacagggccaatatgtaattagcgttcgaataagtagaatctgtgcaataactagcaatacccgattgcccctcctaacatatagtgctattgcaaaacgaacgccatttaaaggctccgtatataagcacagtgatgcaatcatcatcattgcacagattgcaattgcagtgcatcgagtcactggggccagcactaaatacatacctagtgcaaaggcagtacccaaacttgtcactgaactgaaggccaggagtagagatatgttaaagtgccgacggcgaagtggtagactaaccataggcattccagagtacatgaggttgatgatagccaagctcgagcaaatgaatgctattgtgttagccatgatgaatgcatcaaatatataacttccagcaagtgttggtgtgccaccattattgtgatcgtctgctttgtaacctcctggtatggcaaacattacgccaaacgtgacagtaacaatcagcactgaggcaatacccaaagtttgtgttgaatttgtcattttgtccgattccctcacttcatctacttgtttttgatgaataatatattgttcctgcaggtgatctacccgacgacaaccacctcttgcattgcaaaacgttagtgcccgcaatatcagtttgttagggttctgcaaagcaaacataatggatcagtaggtcagtactctttatttttcttgagtaaattacactcacggtacatgaatttgtgtggtgggtgcaaatagatataacagcttgcaaattgctcactttgatataataacttggctagtaggtgcgaaccgggccaaaatgatccatacaagtaaaattgttctaaattagtgcacaataatgacataacagcatatacgtacaactatgatttggagatcttatttcgaatccaaataaaaagaggaattagatgtccaaaagtttatttttcatgtataggatacaatatttatttcattttttggaaaaaattgatcatctatataactcgtctaatgtttatttatctattcaagaccaagataatttttatatgtacaattaactactaaaagaacattttaattttcattttcatgttccgacactttcattgaaagtgtattttaatgattaggtatttttaattattttgtttttttttctaaatcttgaaagtatcatgcgaataatagtaataatatgtgtcagtataaaattttgatgtgtaacaacaattacaccagtagtatgtatcatattagatcaattttacttttgcggatcggtttggcctatgtttgcatgaactagccaagttattgtacccgaataagcaatttgtaagttattgtacctatttgcacccaccatacaagtttgtgtaccatgaacgtaatttactcatttttctttgttaatcaaaaagggttaaaagtgtaatcttacccatccatagaaatatcctgcaagaatcttactctgcgatatatctaaagcagtttgccccttattatttgatatatttaagtttacctccttattcatcagtagagaacagaagatagccttattcccatgcttcactgctatgtgcaatgcagtgtttccatcgttgtcttgcatattcaaaatcctagccaacgattgagtatggcaagcatacacaactacattccatctttccctttcaacggcaacatgaaggaaagtcctccccttagaatcgcgtaaaccagcgatct

SEQ ID NO: 89407 - DNA, 505 bp, Oryza sativa
gacgccgccgtatttcgccgtcgtctcgagctcgtcgtcatagccgccgcctccgcctcctccgctgccgccgcatctctggggtgagagccgccgccgccagatctccctttatctctcgatctctccgatctcagctcgatctctctccgtctctctccgtcgccgccgccacgccacgccgccgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacgccgccgccgtcgccacggcgccaaccgccgccccgatgccgccacggccccgcaacgccacgccgccgccgccgccgtcgccacgccaccgtcgccacgccgtcaccacgccgccgccgtcgccacgccgccgtcgccacgccgtcgccacgccgccgccgtcgccacgccgtcgccacgccgccgc

SEQ ID NO: 89408 - DNA, 1071 bp, Oryza sativa
tgcagccctgcggcggcgaagctaacggcggaggcggattggcacggcggcgactctagcggcggcggcacgcggccgaaggtggctgcaagcggcggcgctagcggcgagcggcgcgagcatgataggaggcacgtgagagggcggcgagagcggaaagggggaaaggaggctcgggggagcgatttctagggcacgggaggggcggaaacggccggggatggcccctatttggccggagacgtggaagagtggagagagaaaggggacgggattcaaatcgaatcccgccgatttgcgggcgcgcgcgtgagcatgaaaggcggaggagcggcgggcgacgatgtgggcacggcgcgtggacgcggagtgggcgcgggagacgcggacggcgacgtgggagcggcggttggagctccagcttcaacggctggaggtgggagacgaccgacaggtgggccccacctgtcggcgcccgaaggagagagggaaggagggaggacttctgggagggaaagggaggagcaggccggcccagcaaagagggcgcgcaggagggaggttgggccgacggcccaacaaagaaaaagaagggaaagaaaaagaaaaggaaaaaggaatttccctgggatttaatattgcagtttatgaattttaatgggttaaaattatttatagggctctgaaaattccactaaaatcccgttaatcaattgtgacatgtggaacccaagaaaaatcccacaatgccatttccaattattaattgcatttattaattagggattcaactctaggttaattagaacaatttctccggacgatttatttaacaaattttttttaaagcaacggaaaggggaaacttccgggcgtgacattaaagaagttgattggggaccaaaccaagaccttctccaggtccacttccatctcaccacttcacttttggtccatagaagacaagatataaagttctacacgttttggattcggattcgggcctcctgacagcatgaacttcaaacggacctagcagctgatctagaaggaatttggagcccatgagta

SEQ ID NO: 89409 - DNA, 1378 bp, Oryza sativa
agattttggcagttatcttccagctttctcaaggaatcatccttaagtctgatatcctgtttagccctttcaagctggcatacattcacagaaggaaaagtgtggaggagtttatgtcattggctcagtttcaaggaggttcagatagccagcttgaaaggaaaggcagtattattgacacttaccatctgtttgaccttttgaagttctgcagtgtcaacctgcttctttgctggacccaattctatacgacgaacacgacttgcaaagttcaatgagctcaaagtttctgacacatcgttgttggatgggctaatttgcacaaacattaaagcttttgagtcccctcctattatcagtatgaagaagcaccaaaagagcaaattaatgatgtagctaagtgaaagacacacacgataattgctcaaaaaatacatagaagattggaaatattgaagtgataaattatgaagatggttctcttccagaagaacaggtcaggttacctagagaatcttgcagcaagtgcgtcaactttgaattcctgcccagaaaaggaatataaacagtgagaaacataaactgatgggttaaacaatattcctttatgaagaccacaaacctgtagggaatgtgggaatttttcgttgcaagagctgaaatcacatcacccaaagcagaaagtgatctgttaatgttttgtgcttccttaagcctttcaccttgcacatcggtcttagctaatcgttcacttccagccaaatctacaagccaaagcttacttcttgtacattctccattcatcaggttctccgctctcaccatgatgcaaagcatactgaggtacagatataaaggtcaaaacattttgaccagaagcaagtactctagaaaagaaaagaataataataaaattttgaccaaccagtgggagcgactgctgtgctcattcacattgtttgatcctacagcccttgcattgcttccagcttgcaagacatcccaaacctccttgatgttctcaactttggcctccacaatgccagggacatgatgggacccttcacttgcctgtttgatttccaacctaaaataccaagattacaagttatcacaggatggcaatattatggaacccagcacagatcctaaaagaaacggtcatacttcttagacgaaggggatgatgcaagcaggtctctgatttgctcattgtagacctcaagcacgctgacagaaatgctgtatgtgacagtctcttttctctcttctgcgattttgaacaactcctccagagttctataatttactccctgttcctctcagttccttccatggtaaaagtcttccctgctcctgtttgtccgtacgcaaatat

SEQ ID NO: 89410 - DNA, 1193 bp, Oryza sativa
gatgcttctggtggcgaggaggtcctttggtctgctacctttcagtgaaaccttgaagtgtttcgccaaaagctacactgactgtcattgcctttgatccggaaaagacacatctgaaactcttagtccaaacaaatgtctctttggttaatcacctgattttcttttccatcctcaggttggttattagctcgaggttagaatatagttcctctggcacgagaccctaggtctcctttgtcagtaaacaattatacacatgatcacatatccgcatcttccgaaagaatcctcttagaacttgtttttattaccaatttctcccatattacatgaatacaaggcactgtcttaaacaaaaagggacggtacttaacatcggtacattgtttctactatgggttagaattaacatgaggcctcacaggtacggcgtttgctccagtgaccacaaggcgagtgacttgtcttcttcttgcataatggccggagtgatggcgcaggttacgcttcggctgtggacaatctctggagaaatgacctggttctttgcagttgtaacaaatcaacgtcttctttgctgagttgtccgtctgggaacgatcgttctgactaggagttggaattggtggttggaaatccttgctaacattggcatcagtggtaccgtagttgctatcacaattggagtctttctcagtgtcaaaattgcacgcttgattcgagtggtcactaatggggcaagaaccatggttgttggtggtatcatcaccattagtattgctagggttgttgtctgtattgcgtccgtcttcttggggcaggaactcttgatgcacaacagaagatccggtgatctgaagtggctcagtgcgctgtctttggttaccacatggaattactgggatgttgacaatccttctcttgcagttcgtcatccgattatgctcactttcgagttgcatggctttgtccacaagtttctcaaaatcttcataatcctctaggagtagttgcacttcaagctcatcttttaacccctggagaaacttctcttgtttgtcttcatccgtttccacatcttctggtgcatagcgagccaaacgatagaactcgtgcaggtactctgtgacggtcaaatgtccttgcttcaggtagcgaaactctcgttttcttagtgtgatcattcctgc

SEQ ID NO: 89411 - DNA, 1514 bp, Oryza sativa
gtgcctggagcgaaatttgatcgacaaggatcagccgctgatttcaaaggttttttcttttcttatttgaggaagataaggactacatttaacttgtaaaccgttggtagaaacaatgactatacatactcttgccaaccatagatggaaatatttgtctttaaagtggtatactatgtagttttcttatttttaatcgagctgtaattttgtaatttgcactcatttgtcctgcaacctccgtaataactggttgtagtttttctttaagcaaaagccggaatgaatttcattataaaaaaaaactacttcaagggtcactgatcttgccgatgcaaaaaaaaaaatgttcctatgatcaatcgatgagtaaataagtaaataagaacaacataaaaacaatctgaattagaaatacgaaaaaacacatacgataagttaggttccaaagatgggaaaacaactatctaactgttcacagcttcatacattaaattagcaataataatgatttaaaaacccaagacaccctgaagtaatacatagctattggaagaggtgggatgatatccaagacgtccctgctacctaggaacatcctccatcagaacatggtctcactttggccatggtcacagatgaagttgcaagaccaaacaaccattaaggtcacgtggcatcttgtttgttaaattgctgacacctcgatctaaatattaatacaaagtcgaatccgttggaaagtggacaacacacctaccgcactgtaaccataccatgtcagtgtttataaacaattggacaaaattttacctctgcattgcactgaccattacagataaaaggttatctattaacttttttttttgagtagtgaatacaccacagttattcaccatttacaaattattaggagcaaacttttgttaccaggaaagattcaggataagtaattccattgtttgcaataactcacatcgacacaaaattacaaaattatgtaaaaaaaaggagttacaatatcgtcatttcaaaccaatatagatggcccatagattttctacattaaattcacctcacctggagagaaacttcagtgatctctttttgcctactcaactcagggttgctagaccatgcgtagctgctagtggtgttgctgctgtacccaccacccctaagctgccactcagtgatgtagcttggcttggtgaccaccttagccacatcgacatctccagtcaacattgtcacgaccttcgacattggcggtcgctggtgcggagagccctgagtgcagacaagtgcaacatatatgactctaaaagcttcatccttgtcaaattccttgagacttgggtcaacaattccaagtgcttgatccatttcatacaggccccatgccttttgataaacatagtttgagtaagcaaaaggcaatttacaatgaattgaagttttctagtatgggaagaacatagaccagcatacccattcaaggagacagatcttgc

SEQ ID NO: 89412 - DNA, 745 bp, Oryza sativa
gaacagccaggcgagcacccctcgtcgaactcattcagttcggtgaacatgcttggggcactggcgggcagtacaagattgcttaccccctccacaaaaggaaggaggtccgctcgcgtctcgaagtcgccaggggcgaagcggggtaccgagagcgaatattccaaagcggacgtctcagcgaccgctctctttcccttcgcctccatcagcggcgatgcaaccggctgatgcggaggattgccgaatactttcgccgcggccgtcacaatcctttacgcagaagccgaagccccagcggcggtactaccatccactccagcggcgccaattggcggaatgggggcggccgaaagatccaggctgcgaccagtgggcgaagtcggagtcccgtcggaggactcgttgtcgctaaaaacgcgagcgacatcgacgagtcctttcgttttagccacctttttgataggacctcccttcgccgccgcgcccgaagagaacgcaactagggccttcgccccttccaaatccttccgacgaaggggggagctgttcgactccaccccggtttcgttgttaccaggacttggggtaggagtgtaccctggggtgtcggcgcggtttcgaccgcctcacccgcggccttatcagccacagcctccacctcctcctttccttccttcctcctcgccatcacattcttcggcatcatcctcgtcgtcggcgtcggagtcagacgaagcaggaa

SEQ ID NO: 89413 - DNA, 1566 bp, Oryza sativa
tgcaatgctacagaaggacgacagttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcacggaactgtaaggttgggtgagagaatctgcgtccccgacaacaaagatttaaaagatgcaattctgaaagaagctcacgatactttatactctattcaccctggtagtactaagatgtaccaggatctcaaggaaagattttggtgggcaagtatgaaacgtgaaatagcagaatatgtagcagtatgtgatgtttgtcagcgagtcaaggcagaacatcagaaacctgccagtttgctgcagcctttaaagattcctgaatggaagtgggaagaaatcggtatggattttatcactggtttacccagaacgtcatcgggtcatgactctatttgggtgatagtcgacagacttaccaaagtagctcatttcattccggtaaagacaacctattctggaagtcggttggcggaattgtacatggcaaggatcgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagacttcggtggaagttgggataagagtctaccttatgcagaattttcgtacaacaacagttatcaagctagtcttcagatggctccttacgaagcactgtatggtcggaagtgccgcactccacttttgtgggatcaaacgggagaacgtcaggttttcgggacggatatcctaagagaagcagaagaaaaggtgaaaatcattcaagaaagattgcgagtggctcagtctcgtcataagagttatgccgacaatcgccgcagagatttgagttttgaagaaggagattatgtgtatcttcgtgtcacgcctcttcgaggagttcgtcgttttcatatcaaaggaaaattggcaccgcgttttgtgggaccttataagattgtcagtagaagaggagaggttgcttatcagtggagttacctcaatctttggcaggagtccataatgtgttccatgtgtcgcaattaaaaaagtgtttaagggtacctaccgaagaagctaatcttgaacagatagaagtccaagaggatctgacctatgttgagaaatgtcacgtcctgataaattcatcccgaaataaaaatcattttctaaaaggaataatagaattaattaaaattcgaaaagaaattggcaaacactaaaatgcgtataagaaaaattcaaatgtggcccggagaatttttgttaaattctccttggtctaaaaggagccctcaaatt

SEQ ID NO: 89414 - DNA, 6652 bp, Oryza sativa
  unsure (1)..(6652): unsure at all n locations
cctcttatatgcaggaatggtaaagaatcagaagctatctgcaaatatacttacaccaacaactaaagctgcagatcatgatgttcctgtcactcctgaagaggtctttactctccttcacttttatgtcaacataatcttaacagtctaactccataatgattcccctcaaaatagacactagcttatatagggaaggggataaacagatgctcttggtagtctaacattggaattacattggtgtattggagaaaggtggaaaattaacgatggcactagttgaagcctgtcattctggagtcacaaaagttaccgtactgtctttagtcagttattgaagtttctcctttgcttataagtctaattatcacagttggcagtaatctagaagtccttgaatgattcatggatctcattttcctttttatgagctattttagttgcactttgtgcctccttggtgtttattcttcagcatgtaaatgctaccgtatttattcatcgcctccaaagaggtcatgacattgcattctgcagattatcaattcaggactaatgtcaaaggaagattttgatgaagcaagaagcaaagccttaagcttatttgcatatgggcaggtgattaattctcatatcttctggttcttgtaaggtgtcagttgcatgcctaataatcttctatagcaatgtcactggcaatgttaacattggacctggaacatctcaaatttagccttgatatgcctttttatttaaatctctgcaggaagtggccttagagaatggactgattctagttgacacaaagtatgagtttggaaaaacagctgatgggacaatcatgttgattgatgaggttacatcttcttacatgattttatccttgtgatatgttctgccttcaaattttatgcctgtcggtctcaggaaacagaaagagcatggctgatccaaccttagataactatgcctgactagcaacttgtgctagctgtgctcactgtttctctctataaacgtaacatgctcgtcatgacatcactttagtgtgttattgtgttggaactacccttacataagtacatgttttgttttcatatttggtaagtgatttttgcacaaaaaccaagccaagggatttttgtgctggggcttgttctaagggtttgagttaccatttcgccaaccggttcccattcccagaaatatagtttctaggatttttttatttttttaaaaaaatgttgcatgtcttaatctctttgataatttctaatatatttaatgatgatttctaacagaattccaaatttcctctttttgacaagcaggtacacactcctgactccagcagatattggattgctgattcttacgaagagagattcagttctggtcttgagcctgaaaatgttgacaaggtagactgctcctgaaactatacatgtggcagcgttatgccttaaacttattatgcttttaatttacaatggaattgctgaagatgtgattttattttcaccaggagttcttaagactctggttcaagaacaattgcaatccatacgaagatgcggtataccatttttccttaaaccacttaagcattttccatagtaagcaaatgttgataattagtgaaatatgagatgtccatgaataggtccacgtataaattccatgtccattgactgcatgtttgtttgtcttttgaaggctctttgtttttgtgaaaactcatttcatgtttatctgttactttaaaatactcaggttctgcctgaagctccagaagaactagtttgtgaactagcttggcggtatgtctatttctctgagtttgttctagtacttctcatttcagagcatgttcaaccaacaactttatgtgcttctctatgtacatgaatctcgtacaaacatgatatcatattggttgaattatagtttgcttaaatatccaccacaggtacattttcctgtttgagacaattacaaacacaaagttcgagatccccaaaactcaggtatgtgacgacagtttggtgaatttgctgtaactgacaaccatatacttaaaacatttttgttaaatgcaggagccgattcacgaaagaatatcaaggaatgttgcacaagccttgcagaacctttgattgtggataaggaagaggatttccagaacaaaaacttgcttgctgatgagaataagaggtgcacttctggacttctggtaccggcattactaataataatatcagcgtacgttcatgccgtctatcattcaaagtatacgtgtgctccgagatgtaatatggttggaaacaactatagccagaatcgcctggcaatactctctgcccttaatagtttccctgttgtgagggtcagtgagtgatagagcgccatacacggtatgcatgattgcgtgctaatatttttttcaccctgtgatgtaacattttctggggttcacatcgtttatcatgatgacactaccattatactccctccgttctaaaatataatcatttttagctatgaatctagcatgtccagattcatagctaaaaatacttacattttgggacggagggagtagatattattaacgtgtgggataataggagggatggtgagacctgcatactagtgaccataatgataatgatattatattatactccctccgttctaaaatataagcatttttagctatgaatctagcatgtccagattcatagctaaaaatacttacattttgggacggagggagtagatattaacgtgtgggataataggagggatggtgagacccgcatactagtgaccataatgataatgatattatggtaatgataatgacattatggtagagtattctcaccccattttctgtgtaacaaacaaataatatcgaagaggctgagttcaagtttgctccgcctctagtgaaagtgtgatcctatacttcagaacacttcagtttagaaacaaacaatttctaatgatgccaagtcgtttgttattactagcacnnnnnnnnnnnnnnnnnnnnnngtcaaactcccacaaaatccgtacagatggaccattcattttagaaagtctctcttgtcagtgtcactgatcgatatatcgatagaggaaagggaagaagaatcagccgcttaaaatgtagagtactcccaagcaacgttgacttgacttcccaactcccaactcccaacttcccaagcctttttaatcccaaagaggggatcagcagctgcaagtgcatcagcagcgagttccagccatggcagcagacaagggagtgaaggtgttcggcatgtgggcgagccccatggcgatccgtgtggagtgggcgctccggctcaagggcgtcgactacgagtacgtcgacgaggacctcgccaacaagagcgaggcgctgctccggcacaacccggtgaccaagaaggtgcccgtgctggtccacgacggcaagcctctcgccgagtccaccgtcatcgtcgagtacatcgacgaggcctggaagcacggctaccccatcatgccctccgaccccttcgaccgtgctcaggcgaggttctgggccaggttcgctgaagagaaggtataatccaactttctctactgatgactcaaatccaaatccaatcctttttttttctgacctcttagttagattgattggctttgcattggaaaagtgatttcatcactcggggatatcccctcccctcgttttttacatgacatctaaatagtcataagaaaatttggtaacatagattaatataaaatatatcactccacaaacatgcaattttaaatttaatttctacaagttgtaacaaaaataacaaatatagctgcgaatgtacgataactattttcagtttaatttatttttttttgttgcaagttgtataagttgaatttattgaattttgtatagcatgtctgtggagtgatatatttcatagtattaatctatgttgttaatttttttaataactatatagatgatatacaaacaagaggatattcccttgagaaatgaaaatccacgttcctttacgttgcattggatgttgttatagtgcaacgctgctctgtacccgatcttcatgacgaccggagaggagcagagaaagctggtgcacgaggcccagcagtgcctgaagacgctggagacggccctggaggggaagaagttcttcggcggcgacgccttcggctaccttgacatcgtcaccgggtggttcgcctactggctgccggtcatcgaggaggcctgcggcgtcgaagtcgtcaccgacgaggcgctgcccctgatgaaggcctggttcgaccgggtcctcgccgtcgacgccgtgaaggcggtcctgccgccgagggacaagctcgtcgcgctcaacaaggctcgccgtgagcagatcctctcggcgtagagagcacggtcacttcagctccccagctagtacgtttcatctccatggtccatggttaaacaataagttcgtcacaagcacattgtgcagaagtagtagatgctcgaagcatgatccgtcttagagagacaaacttaatgctctatgatatgttatccagtgtacaatattgcctacttaattatttcctcaagaggaaaaatacagtacagttttgtacttttgtagtgatctgatcattctaattaagggtccaaatggtccggttttgggggctcgtcggagtggcggcggcgatgcgccgccttggccgcccggacctcgccgtagaagtaggagacgaagccccatagcgagagagcgagcgcgacgccctttgtgccgttgaatggctcgtggaagaacatgacggcgagcacctcggtgaccgggatgagcacggtcatgatgacgccggcgagcagcgccgagccgtagaagatggcgccgatcgtgccgaggaagaagcactggtacatggcggccgatccggccaggagcaggtagtagcccgcttggcccagaccgaattcatgggcttctcctgggattgcctgcgtttggttgctttccagcttaatgagaaatactactgcatatatgatctaatgtctccaaaagagcttgatcaagaatttactaaacataagctaggcctctagttccctttagtatatttattaatttcaaccggttgcacaacaaaatttaattgaagtgttagaaatgaagaagtcactaattaggcttttttttctagaattaaaaacaccttcatgatagcatgtatttttttttctatgagatagctggaaatatggatattcaattaattttcctcttgtttctgttgtgaagaatattcttgggctatatagactttgattacccatttgttaggtctaacggtagacagactcgtcaacacaactagctttccttgttcgagaaagagttacatcttattgcaaacatgaacaacttgctaaatgattggcttgcaccgatctaccactacctatcctatatagcccacaagtacgacttgctgctgctgggcttcagtgtaagtacaaaggccaaatttgatccaaaaagaaagaaaaagagggtccaaaatgaaaagaataaacaaggggatcaaagtaaaactttgataagaaaaaggaggtacaaaatacaattcactctctttttttattgtctattaagatttgattatgtcattgtgtgccaatctttcagaagcgtgctctgatatacttaaatttcttttcaaaaaagcttggaacgtgctctgatctattggcatagttacattcatttctgagtggggttaaatagtttataatatctcagtagcctgtagattgcctttcactagcagtccactgatcagatcacttagcatgacaaaaggtaactccactcctgtgcattaccatgtcagcctaataagtactctatacagttcagaactctgagaaaagggtagacgtcattgctaagaactctatcagaacacagctaatatctattccatcccataatataaggcatgatcaaacttggcacaatgttcaaaactaatttttgacttataatttctcatatataacaaaattttaaccatcttaaagtaaatttaaatgtcaatccaatgatattaattttagttaaaaaattaatttatattataataattgttggtcaaatgtttttaagttgaattttgaaatgtgtgcatgtcttatattatggaatagagggagtatatgaaaaatgtgttgagtttttggatggtgcaatacggctaagatcagtgtgctgtgaagaactgtgagagtagaggttgaaatcttacgtggaaatcgttgttgacgagcatgccgacggcgctgaaggccgtggcgacgaagccgatgacgagctgcatctccatgacgagcgtgtacgtgacggcgccgcgcgcggcggcgtggtgcgcctggctgagctccatgacggggagcacgagcccgtacagcgccgcggcggcgagcgtcatggcgaacccggcgcagtactgcgcgcgcgacacccccgccggccggtccccgccggcgttcatccccagcatcgccgcgccgacgctgagcagcacgacggcg

SEQ ID NO: 89415 - DNA, 4709 bp, Oryza sativa
accgcaacagcccatgtcgagaacactaacgcgcgcccaggtgaccaggtccagttgcacctagctaggctcgtagcgcgaatgtgccttttctcattgtcaaggcccaattaatggcttggcacaaatcgttctaccatctcggtgcccgagagattgcttggcacaagagattcgattgagacccatgcatttgagagctatcccaatggtgatgtctaaaagtagagctcctcgaagagaaggatactaaagaaaaccgataggttgtttagcaactttcacgtagaaagttttcacacaaaatatactaatataaagagtactgtttagctgtttgaaaaacgtgttaaggaaaaccgagataaaatatatatttcatgttttcattagcacattcttcaaactgctaaacgatgtattttgtatgaaagatttctatatagaagtttctttataatatcaaataaatcaaaatttcaagtttataatgattaaaacttacttaatcatgcgctaatgtctttcttattttgcgcgcccacacttaatcttcatgtttggaagtgtatgtccaatcgtttgttttgtaatcaagtcttaaatactaattaaatagttataataaatctgaaaaaaacgacaacattggtacattagtcatctatcaccatgcaaaatatcaacttcaagtttgatcacataatgagaaaaataacaaattacaccctttcttttatccccacaaaaaaaacaccctgaatagtacaagtaatcagatttgttatttttcttcaacttgtttaggtcgaatttaaatttgcatgttgtgatagtgatatctctcataattatctatgttatcgaatttctataatttttcatacccatatacattacatgcaaagaatgagcatgtacatgcacacaatggtcgttaatagcggtctcttaccggtactaattaggaataattgctgacatggaagaaaaaaaaaagagaagagacaaaacatcgttgctatgggtaacaaatggcttaacaatgactcttagcctctgtaatatggaaacatggttgtatgagggttaaaagaaggaaataatagtaatataaggaatattttttgagttaatggttagagtctttatcgtctcaactattaaaaagacacgatatttaaataatcttgtattgtctaagagacgatagttgtctctaccattgaatatgcccttaagtgacaacatgactttcccttaacctaagtgccatatcatatattttacttattatgtgataatggaattaattatatgtaaatccaacaatgagtatcgggatttagtcagtcgtcatgaaatacacggagaatgcttgtaatcggccatccgaataaaacaggaaaatcggacaccacgccgatgcttcccacgttggagtatctgcaaccaactaactgctaatttcaaccatgcatatgcacgtgtcaattttcaaaatattttttctcctagactacttatccgatctaaaatccgattgcaccgttatattcattggaattaaatctttataacaagatgtcacatgattatattccgattaaagaaaaacatatgtttcaaaccattaatactttatgtttcatacgttatagcaacatgtttcagcatatgtttttattgtgtttcataaaattcacataaatacttgccactaccctcccatctctctctacctcatacatgcatacatgtatgcatttttgcgagctttaaaatgatttttctcataaattaattatccaatctatgatctgatcacaccattgtattcgttgtaattaaatctttacaagatatcacatgaatatattttgataaaaaaatatgcttcaattcgttaaccctagttgtttcatatgtggtagcaacatgtttcaacgtgtatcttcatcatcatgtttcataaaatttttaaatgtttcaattgttgattttttttgtttcgccatatataatttgatgtttcactcaatggtcaactaggaacatttgaccaaccaattttttttgacatgagacctcagatgggaagattcctcatgattgtggagtgaaaaatgaagtgtagcaatatgcacatgcacatacgctcagaacttggctgggcgtccgatatttgatgggatatttggtgggatatcggacgtccgagccgtagcgctctccgaaatacacccctaaaaactaaaaaaagcaaaggctcaataaagtactccctccgggctgataatacttgtcgttttagataagggtgaggtcaaactttaaaatatttgattatgaatcattttcaaaatatttgtctttcaaatatggtgaccacatgtatagattagtcttaaaaagtactttaataagatcatatatttgttaatacttttttacatattatgatagaaaataatggtcaaagttgttttttgaagaccgtgcccttgtctaaaacgacaagtattatcaacccggagggagtaggagtatacagtccctccccacaagtctacttggttgtcaatatctcgatcctataattcgattttactatcctaattaaggtttctaactgtatcatcatactccctccgtttctaaatatttgacacaattgaatttttagtacatatttgaccgttcgtcttattcaaaaacttttatgaaatatataaaactatatatatatacatatatgtatatttaataatgaatcaaatgataggaattacttaagtttttttaataagacggacggttaaacatattttaaaaagtcaacggcgtcaaatatttagaaatggagggcgtatatatgtagaatttacgattttttatacatataattctatgattgtgattagtatggagtagaacatttaatttcgatttaggatcgcgatttaacaagaagttggtccattccccgtgatatctgagatgcatctctacagctcataggtacggtgtatatagagtttggttttggtggcgtcatgttcgcacacaccgagaacgagcaggtccagccgtccagggaagaaaacggcaagaagaggacaagagaaaccggtgtgacataacgtgcgtcaatctgcaagtcaagcgttatccttgaggaaactgaactgatcgccggatacgcccaggcccagcaactgcaggtgctgtagtgtcagggataagaagtggtgctctgcttctgcactgatcatgaaactcacctctgcttcttttcctattgaaagtgtatgcgtcaattatcttgttcatggtagttgattttatcggttaataccgatacaattaggaagaaaataattttattggttttcctgccctaacaaaaaaaaacaagtaaaacatgagagataaaaaccgtcgtcgtggtcagtggcaactacctatattctaatcgggattagccccccgagtctcaccagtaaaaataaaaggagagtagcagttgagaagaagtaaagactaattcctacgctaaatcctaaaatctaatagagcccgattgatctatcatactgtgagggattcgtagtgctgtcttttattcaattcttgtgcaggagaaacatcaagaaagaagcaggtgttcctgcagcggtgttgcatcctttacccgatgtccagtacaccgcgtaatctaagaaaatgagtaagaactggtaagaacagaaaaggaggaacagatataacacttatggcttcaattcatccagtcagtaatcatcccaatttcgtatttagaattggtaatcatgtgttaagctaagcaattagatcccgagaataaataattccaacaggtcacaatataggcttgcatgtagtccagatgtccacattcactagagtacacagtacacaaaatggtagattggtcatggacatgcatgaccagattaataagaacaaaaagtgagtacaagaacaaacattgcaccgtactcagtcattacagatacagtgaagtagcttgttttcgccgacccacaaaaacagcctcgatcacatacagtacacaaatagtgcaatgtgcacacagtctgctattttgctccacgagcagttgaactgctgcagatgcagctcactttatggcctataaaaactaataaatccgtggccactggcacaacaaaagcaaagtaagcaatatatacacacggattcatgaggcttcttcagcttccaaagccgctttcttcttggccttggcgtcggcgtactcgccgtaggagtaggaggcgaggccccagagcgagagcacgagcgccacgcccttctcgctgctgaacttctcgtggaggaagatgacgcccagcacctccgtgatcgggatgaacacggcgatgatgatcccggcgagcagcgtgtgcacgcagaagatgacgccgacggcgcccacgaagaagaactcccacaggacggcgttgaacaccagcaccacgtagtaccgcgcttcacccagctcgtactgcttcgcctccctcgggatcgcctgcgtacgtacgtgttcagtttcaggggtgatcgatcgttagtaggcaacacaactttgaaagggccaaatcaatatggtagtacgtatacttgtcacgatctgaatatctgatggatgttcacgcacataa

SEQ ID NO: 89416 - DNA, 2070 bp, Oryza sativa
acccattaaacattcgaagcccctttcgagattcatcactaaccgtgtaggagaactactcagtcaccacgagatccaagtatctgcttcttgatggagccaattctggtgatcaattcatcccgattttcctgcacaaaaaagtagtacaaatatgagtagaagtccatttaataggggagagtgttcagaacagatataaaactaatcaccttaaaaatcaaatatcgcgaggtgaaccaaactgtgaatccaaggccgacaacttccatcacctggggaacctgctcatgacagcgataatcacatcgttatgagttgtgacatagtacttccatatataatactaacaaagattatgcaatgcttctatagcttgttcgagaaaagtcctaaaattgccaaaggcaagcatgtaactgcgagctgctccagtcatagaaagtaagtgtgagagaactggcactaccgaaataaccaacaggtggcaaaatttggtacagccagcaactgtattgccttcagaaactattttttcttttgacttcctaatttcaaaaataaagcactgatctgttttacatcttatcatacaatttcaaacaaatgaaattgtgatgagtgagtgagtgagtgagtgagtgagagagagaatcagagttgcataccaaagggactgaatcaagtgcagaaacaacaattgatgaaatccagatcgtaacaagcgcagatgtcccataaacaagagcagtatatgaattttcagagtccaactgcataagagtggtttgtagaggtgagccacagtaaagcgcatcattgatagatgaaacattggatgaaatactctcaggaaattgcatattatgcatagcatttggaagatacaagataaacaaaaacctggtatagaccttatgagcctgagctctcttgaaagcatgaagtaacaaactaacaatatacttatgccatcaaaacatatgaacattttggacaaattaaacaggagtcaagaacaaaaggatttttttttcaaaaataacagtagggtgacaattctgaaagtaatcttacaatgataaatgtttactttcatctaatacataggctgatagcattctgaatgagaagaacaaggccgtccttgtgtaagatccaaacagtaagtaaatggcagatgttttctataaaacataaaagatagatactgagaccaagtaatcggatatctagagacaaatttactttttgctttgataaagagcctacagagtacagaccatttctagtatcccagaaagtgttactccctccagtcaagtatacttgacatttaggacaacttagttgtactattatcaagtatattctgatgccataaacgtcatgtaaatatgacgagaggtagtatttatttcctgaatatatgtacttcaacaaatatatggcttctatgatagtttacaaagcaaacaagaacatctacaaattagcactcatcggacaactaaaacaatctactcgcaagactgttattctacatgctgaactagagcagtagcaacatttactcctgtcctattaatcagtgtaaaaaagagaaaaaaaactcatgttatgttcaaaccatgatcaagattgattgaaaaagaaatgagatcgaagaaatggtgatcaagacgaaatcttcaccacccgcacctaaatcattcgtttcagatcagaaatgcaacaagcaggcaggcacgcgtgctcacctcgacgccaatctggttgagaacattccaggaagtcgattccccctgcacctggacctctccatccccatcacccacctcccggccaaacccctcccacccctcccgcttcgcaggcgccggctccgcgggcttctccgagatcagcactctcagatcgtcggagtccttcgcccgcacggccagcgaagacgccccggcgcggcggcggccaaaaccttggggggtgaacaaaactagggttttagctctcccatcgcccatgcagcggaagattcgaggtgaatgcaccgtgtcccggcgggcgtgc

SEQ ID NO: 89417 - DNA, 675 bp, Oryza sativa
ttgctgggagggatgcaactcgggcccttgcattgatgtcgtttgaccctattgacctcactggagatttggatggccttggtccagacgagctagaggtcttgcaagattgggaagataagtttaaagagcggtatcctacggtgggccaccttgcttcagaaaatgcagcggatggtaaccacggtggcgcagcttgatcacgaggaaggaatgctttactccatcggtttgtcagtttctctgttcttttttactggattgcaagtgggtagatctgatcatatgatgctctggtaggctctgttgcttgtgtgctgtgtcgtgcgtgactaatgtaccagctttccccatctgcttttattttggtttgcagtggatgaggaggaaattttgagcgacttgactaaaaacttgagctgtgactctcttgagtgctcagaccatgtgtatatgctttcaagtttatgccataatttgcggcttacttctcgcaagtcgcaacaattatcttgctggcagctaaagcacgccatgatttgccaaccatacttaagctccactccttttaacattgtcggagaacagcatcagcatcatgtccactctttaccagattttcgcgcccttttcacacatgatgcctgtacgatttcttccctttctttcagcacc

SEQ ID NO: 89418 - DNA, 3554 bp, Oryza sativa
atcaattacccaattaaatctaacaatccccaccaaatttcaaggctcatgagaatgctctctattccatagcagcttttatataccagtgttttggtgaagactgttaagttgaactttcacctagaaaaggagctacacctgaccacaactgaacaatggactatgccttgaattggtagtcttgtgcagttaggtttcactcaattccataactgatactaggcaaccattagtattccctcgggttggagcttataagtcatactccaggcctttcatgagtatctagagatcacccaaatctcatagactgtgactagcagtcgaacttatataggtgtgttccttctaagatgttctgcaggtcaacatctctgcttaatgaaagtcactcggaacacgttgaggcataagccatccttccatacagaatagaagagaagtacatcatgaaaatgagcccatttaagggtctcttctctcggttacacaatagtttgtttcgccatccaaattcacgggatctccgatcacaatggacaggtttccactattgtgcaactctaagtgggtctcaagcccatttccctcgatgcactgtctatcacattacgtggtagccccttggtaaactgatctgccagatttttagctgtctggacatagtccagtgctatcactccggagtttttctgctttctgacatatttcagtcttttctttacatgcctagatgacttcatgttgtccttcgaactgttcaacttaataatcactgtttgattatcacagttcattaggatagctggcactggtttttttttcaaccaccggcaaatccatcaggagttcacgaagccactcggcctcaattgtggcagtatctagtgctgtgagttctgcttccattgttgacctcgttaagatggtctgcttgcaagacttccaggaaacagcgccacctccaagtgtgaacacatatccacttgtggcctttatctcatcagcatcagatatccagtttgagtcactatacccttccagtacttttgggtaaccagtatagtgaattccatagctcattgtaccctttagatagcgcatgaccctttccagagcttgccaatgatcatctcccggatttgaaacaaaccggctcagcttgctcacagcaaatgagatgtcaggcctcgttgcactagccaagtacatcaatgaaccaatgatttgggagtatctcaattgatcccttgctattcttcggtttttccttaatagcacactggagtcataaggagttggagctggcttgcagtcactataaccaaagcgactcaaaaccttgtccacatagtgagattgcacgagtgtaatcccaccctcatctcctctcagtagcttaatgttaagaataacatcagtcactcccaaatccttcatttcaaagcttttggacaaaaagtccttaacctcctcaatcacattgaggctggttccaaaaatcaatatgtcatcgacatataaacacaagatcactccctctcccccatcatagcgatagtacatacatttgtcagcttcgttctcaacaaagccagcagatgtaagtgttgtgtcaaacttctcatgccattgttaggtgcttgcttaaggccatataaggatttcaacagtttacacaccattccctcctgaccttctagtacatatccgtctggttgatccatatagatctcctcttctagctctccgtttaggacagctgtcttaacatccatctgatggacgagaaggccatgagaggctgccagagcaagtagtactcgaatcgtggtcaagcgggcaactggtgagtatgtgtcaaaaaaatcatcgccttcttttgggtataacccttggccacaagccttgccttatacttttcaattgtaccaccaggcctaagctttttcttgaaaacccatttgcattctacaggcttgcacccatatggacgctcaacgacttcccaagtaccattagacataattgagtccatctcactgcgtaccacttccttccaatagtcagcgtcagtagatgaatatgcctcttctatggttcttggagtgtcatccacaaggtatacaatgtagttatctccaaaagactttgcagtcctttctctcttactctttcgagttgctacaatgttatcctcctcaggattttcctcaggcgtttgatcattgtgttctatcggtgcaaagtgctcatggggtaaaacaggttcttgactagacgtgctaggtgtatttttcatgggaaattcattctcaaaaaatgtggcatctctggactcagtaattgtaccaacacgcatgtcgggtactccagagtttactattaggaacctatagcccacgctgtggatagcataaccaaggaacacacagtctacggtctttggtccaagtttacgctttttggctataggtacatttaccttggccaagcagccccatgtgcgtaggtatgagaaatttaatttcttcctttcccattcttcgaatggtattacttccttatgcttcactggaattttattcaggacatgacaagcagtcaaaattgcctcaccccaccattccttggaaagtcccgcagtatctaacatggcattcaccatctcagttagagtgcgattctttctttcggctaccccatttgattggggtgaatagggaggcgtcctctcatgaataattccaaactcttcgcaaaaggacgtaaactcattggaaaaatactctccacccctatctgacctcaaccgtttgattttcctttcaagttggttttctacctcagctttatagatcttaaagtaatgcaatgcctcatcctttgttttcaataggtacacatagcaatatctagtgcaatcatctatcagtgtcatgaaatatttctttccccctttagtcaacacactgttcatttcgcacagatcggaatgaactagttctagtggtgccaaatttctcgcctcagatgccttgtgaggtttgcgaggatgtttcgattgaacacaagtatggcacttggaacctttgaccaaagtgaattttggaattaaactcatgttagccaactacgtcatacaaccgaaattcacatgacaaagtcgcgaatgccatacattggactcatcattcttgctaatatggttcacaacattattattattattacacatgtcatccaaagaaaaacagaacagacctccgctgtcataaccttttccaataaaagtttcatatttagatacgacacatttattggattcaaacacaagtctaaaaccatctctacacaatagagagccgctaactagattcttctttattgaagggacatgctgcacgttctttcccgaagtaaacttcagatcgaccgtaccaacaccatgaacagccgcaagcgacccgtttcccatcaacaaggaggaacctctcccgacctgataaaaagaaaacagggaaatatcagaacacacatgaatattagca

SEQ ID NO: 89419 - DNA, 1339 bp, Oryza sativa
ggtcgtcgttgccgtagccgaaggcgaaggaagcagcaggcagcgccagcaccggtgccagccggaagcagctgctcgcccccctcagcggcatcgaaggcaagacgacggcatggccaagatggtgtcgtggaacaggcgatcctcacggcagggatgtagcagcgatgacgaggctagtggcgccttggcggcggcggcggaggagattctgtggaggaaatgtcggccgctccagttccctggccgcatcacctatggctcttatggcaaccagctgcaaggcttgccggccacctctccccctctccgcttgcccgcccgctcgaccgggctcgtcgcttgcctcttccccatctgttgccggtagctctgttccctccttttgtcacgaggcgctcagggtggcggcgacggagcctctcaaaacggcgaaggtcttgcgtgctcaccggccggctctccctcatcgccgacgccctcccaaggagggtagagtagagtagagtgagaagagaaaagaaaagaaaagaatagaagaaagaaaagaaaagagaaaatataagatagaagagatttggggtccacatttttttctttacatgtgggtttcataatttttcatatcatttttctgttgactaggagccacgctagcgaaaccagagatctatactgtctcaggatcttttgtgcacggttttgtagtttaggggtggagatttctgatattgtggactagggacctcagacagacttgacataaagtcgagggatgttaggtgaagttattccttatggagttgggcttcggccgtcccgacatctgaattcgtacaaggatcctagcagcaggagaaatctacaccaaacattgttctggcttcaacggacaagatgcatgatcctatccgtagttcctgaccataatagagcacacgtccttggaattccaatttcgagatccgagtctccgagacaagaacattgcagcagcagaacacgcgagaaaattaagcaaagcgtcgctagtggcacgtgtccgcttaccacgcattcgcacgctcccgggcgacgtacgtgtcactagccccagcctactcacccgaggcacacgtgtccacctcaccggggcacgtgtcgcgccgtcccctctcgctccgccttatatagccgcttctgccatcgccggtgccgagctcactcgtgcactgcgaagctacacttaccactgcaaccactgatcacagagctagaggttcacttaggcgaagcttaattacacagagcgcccatggcgtccgggcaggacaggagggaggcgcgggccgaggccgac

SEQ ID NO: 89420 - DNA, 1081 bp, Oryza sativa
aggaggtagagctcgattttagaagaatttatgaagaagaatgggtcaaatcggagttcaaacggaaaagttatagcctccggaagtttgaattcaggaaaaatccgaggataaaagaaaaaggaatattccgagaatattctctggatatttaatttcggaaattgaattatttttagataaggaaaatatatgtgggcccactgtcagtggcatagagtgtatgggtgaactcggtgtatgtagactcgatgacgtggaacgacacgtggcgacataaggcgatgaggtggcactgacatggatggatctaggctgaggtggcataagttagggattatgtagatccaacggttgggatttgatctaaggatttggacgactgtgattatttggagtttctagatggcaagtcccacacgtcagtgtcacaaggaagaggacaaggagcagctgctccaccacaggcctgggcgtgcccggccattgcggcatggcgactccggcacagcgacgtcggcggcgttctccggcgacggcgcgcagctgcagtgacgagcagcggcgtcggcaagaggaggcggaggcgaatccggtggcgcagcaccgagctccgggacgaattggagatgacccatcaatgacgagcggcggacaccggagttgaggagagaggaaaacggcgcggaaggaaaagaggctcggcctcagggctttaccagcggctgcggtgcggtaggaagacggtgacgataacggcgcggctcccggcggcggctgctcacggtggagatggcggcggctttggaaaaaaagggggaaaagggggcgggggccgacggtatttatagaggagggagtagctagggttagggcgcactgcgcaagctttggaaaggcggcggctccgaatttggcggcgcggcttgcgggatttggcggcggccgtgtgggcttgcgggcggctggcgcgggctcggtcggcggtggcttgggctggcgacacagagaggaggaggaggccaggccgaggcggcacgtgggcttggggcttggcttccccaggcttgcagctcaagaa

SEQ ID NO: 89421 - DNA, 1295 bp, Oryza sativa
cctctggacgagcacggttatgaacatacttcttcaaaacgcccatgtacctctcgaaaggaaacatgttgtttaggtacacaggcccgagaataccgatctctttgacaaggtgacaaagcagatgcgtcattatattgaaaaatgacggtggaaatatcaactcaaaactgacaagacattgcaccacatcattctgaagggcttctaatctatccggatcgatgaccttctgcgaaattgcgttcatgaaagcacatagctttgttattgttgcccggacattatctggaaggataccccttattacaactggtagcagttgtgtcatcaacacgtgacagtcatgagactttaggtttgtgagctttgttattgttgcccggacattatctggaaggataccccttattacaactggtagcagttgtgtcatcaacacgtgagagtcatgagactttaggtttgtgaacttcttctccttcgtgctttttattcgctttatattcgtggagtatccagacggtacctttatgctctccaagcattcaaacatactttccttctctgccttgctaagagtgtagctggctggactcaagtaatggcttcctttctcctttggttccgggtgaaggtcgctgcgttgttccatatgcttcagatcattacgtgcttccagtgtatctttcgacattccatatacacctatgaagccaagaaggtttacgcaaaggttcttagtgatgtcgattgcgtggcggacgtccaagaattctcaatagggtaactcccaaaatatagatttctttttccacatctccgcgtgaccatcttcgctctctataggctggcttctaggcccctttccgaacactactttaagatctttaaccatagcaaacactgttttcccgctgcgatatttaggcttcgtacggtggtctgccttatgttcaaagtgcttgcctttcttccgtatcgggtggtttgcagcaaggaatcgacgatgacccatgtacacaaccttcctacagtgattaagatacgtactttctgtttcatccatacagtgagtgcaagccttgtaccccttgttggactgaccggaaaggttgctaagtgcaggccaatcgttgatggttaccaacagcagcgctcgtaggttaaactcctcctgtttgtcctcgtcccacatggggacacctttctttttccacccaagtttaagatcttcgaccagtggtcttaggtacacattgatgtcgttaccaggttgcttggggccttgaata

SEQ ID NO: 89422 - DNA, 660 bp, Oryza sativa
ttgttcgtccgcagcgtcagttcttcaacaacaatgctggcaacaacatccgtaatcaagctccacgccctgttgtagctccaacacagcaacaacctgccaagagggagcaaggcagcaagcccgtggtgtgtttaactgtggagacccaggacattacgctgacaagtgtccgaagccccgacgtgtgaaggttgtccctgcccagagcaactttaccgcaccagcgccaaaggcccgtgtcaatcatgttgctgctgcagaagctcaagatgctccagatgtgattttgggtacatttcttgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacatagcccctctgtcagaatagaaattcaaggagtaccatttctggccaatcttatcttgttagaatccaaagaccttgatgtcatcctagggatggactggttagccagacataaaggtgtgatagactgtgccaatagaaaagtaactctcaccagcaatgatggtcgagttgtaactgttcatgcattgtcttctgagtt

SEQ ID NO: 89423 - DNA, 1196 bp, Oryza sativa
taaagtatatctttactcagccggatctgaacatgagacaaaggagatggctggaattaattaaggattatgacatgggaattcattatcaccccgggaaaggctaatgttgtagcagacgctcttagcaggaaaggctattgcaatgctacggaaggacgacagttgccattggaattatgtaaggaatttgaaagattaaatttgggaattgtcagtagaggtttcgttgcagcctagaagcgaagcccactctaattgatcaagttagagaagcccaaattaatgatcctgatattcaagaaatcaagaagaatatgagaagaggaaaagctatcggtttcttggaggatgagcacggaactgtttggttgggtgagagaatctgtgtccccgacaacaaagatttaaaggatgcaattctgaaagaagctcatgatactttatactccattcaccctggtagtacaaaaatgtaccaggatctcaaggaaagattttggtgggcaagtatgaagcgtgaaatcgcagaatacgtagcagtatgtgatgtttgtcagcgagtcaaggcagaatatcagaaacccgccagtttgctgcagcctttgaagattcctgaatggaaatgggaagaaatcggtatggattttatcactggtttacccagaacgtcaccaggccacgactctatttgggtgatagtcgacagacttaccaaagtggctcatttcatcccggtaaagacaacttattccggaagtcggttggcggaattgtatatggcaaggatcgtgtgtttgcatggcgtccctaagaaaatagtgtctgatcgaggcagtcagtttacttcaaatttttggaagaagcttcaggaagagatgggttctaagctaaactttagtactgcttatcatccgcagacagacggacagacctaaagggtgaatcagattttggaagacatgttgagagcttgtgctttagacttcggtggaagttgggataagaatctaccttatgcagaattttcgtacaacaacagttatcaagctagtcttcagatggctccgtacgaagcgctgtatggtcggaagtgtcgcactccgcttttgtcggatcaaacgggagaacgtcaggttttcgggacggatatcctgagggaagcaaaagaaaaggtgaaaatcattcaagaaaga

SEQ ID NO: 89424 - DNA, 2491 bp, Oryza sativa
atcttcttcgtcaggggccacatctccagggcgctctccatccgagaggccacgcggggcgcactcggcttctgtgccgacgacctcggggtcagagggcgacatgcgcggccttcccgcagtggcctcggggccatcctgggggtcgggggcgccaggcaccgtcggacaagcaggcggagggccagctccggccgtcgggggccttgggccgtcgttcggctcgggggcctctcctccctgctctctctctcttcgggcagaatcccgacggtcgcaaatcgcgcgcatcagcaagggaaaaccgaccgacaataatgagcggcccctcggctcgcgtttgccttcaactccgaggaggagtgcggtgacgacggtgcgtacgacagcgacggcgaggccggctacccgggcgcgtcggagtgagcccccaagcctccgccaatcttaatagcttttccttcttcttccgaggccttcaggcccccttcttgttataggctgatttaatctgcaatcaaataaagaggaaatttttgtgtcaatttcatttgttctgtgtatgagacgaggatggtctgtgccacagtccttctgtgtcttggcttgaacaagggctcgtgcccaggtcccagcctcaaacggcgcgggtcaaggctagtgcctggggagatccacatgtcgagactggccaggccgggaacgtggtgaccgagggttatgggtgacccgattgtgggtttttgccgattcccccccggagttcaccacgccccagggcacggctcggttctgggccccgtttggcgaatttagccgacccgagcccccgagggcaggattgagcacgagtgacctatttcaagccaagattcttcaaaaggaaataacagcacagatacagcctttaagaaatcgaaaatgcttttattgaaatacggaagagaaaaaagataaacccccggccaaccctgcacgcccgggggggtgcggggttggcccgagcccaagacctgacacccgacccccactaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggaggccgcgcgccgccttcgctcttccaagtagtcgaggtcagggagcgtcggcttccttctttttgtcgctcgcaggcctcccctttcgggtggccagcgaaacgccttcgacggcgaggacatgaccctcgtcgtcggaatgggccaacctcttcttcctcctcctgtcccgccgccctgaccgagcggcggacccgggggcggccgaagctgccataccggaaccgggggggttccaagtccaggcctcctccttgcgagccactcggtccgcgagctgaaaaagctccgcggtagtctggggctctttggaggcgatcttttcgagcatgcggttgtgccgcacacccctcctgaacgcgtagatcaccgcgtgtgcagggatgcatggtatggtgttgcggacttgacagaaccgctgaatatatgagcgaagtgacttatcatcccttcgctgtattgcgtgtaagtccgcttcttcacctgggcgcggatatgtgccctgaaagttcatggtgaactgttggcacaaatcctcccaggagtggactgacgcgggtggcaagttcattagccaaccccgcgcctgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctggtccctgcgtccgtgtcgaggtgacactctggacgaggaagcaccctccgttgcgtgggcagcacgtcggtcattacgccggcgctcgatgctggcgcgggcgtccggccccctacgcagatcttcccgggtcgaaggagtcgacgaaggagtggcggccgaatggcgaacagcggctgccactcgtcgtgcccttcgtcttgacgacgcggagccggtggtagcagcaccagaggccttggtggcggaagaccgcccaccagcatctaggcgctgccgtgcagtcatgaccaatttggccacatcgtccagccagcgttgggctggagactccgggtcatgggcgacgggcgggtgacgtaggagcgcgcccgcagcttggagcgcgcctggggc

SEQ ID NO: 89425 - DNA, 723 bp, Oryza sativa
cacgtgggcgatcgtgtctgcctcaaacctctagtcatgatactcccggtcccatgtcaccgacatcctataccaaatttctttcccgtacgaacatgctaagtgtttcatatgtaatgcatccgacgcacattgcagattccactgggtccttttactcttcgacttggaggcctgccccgtcaacgtatatgactcaatggataaaaaagagtctacgtttgacaagattttcgaactgatagacaggtactgtcataagttcctatgctaattaagaatcttgttataattaattgctactatgaatcatagctttaaactgcatgtagggcttggtatcggttccgtcatttggtccgcggcaagtggagagaaagacttaggcggaagtttaattttcctgtgagtacacatgttctacatttatattgaatctccaactcaaatacatacaagtgtatattaattaattagatctctcgccgtttgtcatttatttatagtgcgcaaaacaagcccagggaactaacttgtgtggctactacatgtgtgaatattgccactgccttgcagaccaaatcatcaccacaagagagctcgatgtacgtacaaataaattcaaaatttcattgcatacgtatcgatttgttgtttactaattaatttcatacattcatatagtttattcacatgagggataacctcacgggctgcaggaat

SEQ ID NO: 89426 - DNA, 770 bp, Oryza sativa
actatctgcgagacgacatgctgttgaaagtcacagactttgacccgtggtatgcagccatcgtcaactttatccttgtgaggcatgtaccaccgggagaaaataagaagaggttgatctacgagagccgcaggcacttgtgggatgcaccttacttgtacagagtttgttcagatggtctactacggagatgcgttccggtagatgaaggcatgaagatcattgagaagtgtcatgctgccccatatggaggtcactatggagcatttaggacatacgcaaagatctggtagagtggattcttttggccatcaatctatgatgacacaaaggaattcgttcggagatgcacaaggtgacagaagcatggagggatcactgatcgggatgcgatgccactgacacacaaccttcaagtcgagctttttgatgtatggagcatcgacttcatgggacctttcccaaagtcctatgactgcgagtatattctggtggccgttgactatgtgtccaagtgggtagaggcaatgccatgcagggccgcagacgccaagcacgcccgtcagatgttccatgagattatcttccctcgttttggaactctggggatggtgataagtgacggagggtcccatttcatcaataagacctccgaaactttttgcaaaaacttggggctcaacacaatattgccactctatatcatccccagacaagtagacaggtagaaacgagcaacagacaaatcaagaatattctgcagaagactg

SEQ ID NO: 89427 - DNA, 1968 bp, Oryza sativa
aagtcgaaggtaacgccagctaacaatctgagcttctctccttataatgcaacagatgctcatcatgaatgtgttttgcagatcgcaagatcaaatctcaagctcagtttgacgtcctggttggtaagatcaagaggcttgaaggagcaagggataacgtcgccaacgccgctgcaccaattatccaagccatgttcctcaataatggtggtccgagtgcactcgacgcaaccgaaatatttgacaagctgagtgttgctccggaagtatatttcaaaaatatcaagaaagctggaagtatgggagctggcatggccttggcgatgacaaaatccttgtacccgagaattgaagtcgacaccattgatggatttgcagacgggacaagtgaagaagctgcccttgatcttatcagtaatgctcagagtgcggctgacaagatcgcaagtgatgttgtagaacaattccgtaacagcgaccttcagccgagcgataataactctgatgatgaaagaactgattctgactgagtgtaaatgtaatacatggaggctcaatttgtcaatactggtgtatttatgctgtgcttgatgattcttgcgaagtttttgatttcttaaaagtttttgctaagctttgttgagcctaaaacccaaagaagctattaaaaactttcagtcctcgcaaactaagtagaaaaaccaaacaaggcaatgataaaccaagtaagcaaactgaattgataaaaaatcacactccttattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacccggccgggtaacttcagagataataaatgggccttcccatagaggagataacttgtgccgatctcgtgtggtttgaattttccgtaaaaccaggtcgccgactagaaaggcacgagatcgaacattgcgattgtgataacgtcgcaacccttgtaagtaccgagctgactgaatcaaagctgcttcgcggacctcttccagtcggtgcaagtcgtccactcggtcttcttcgtagcgttcttctcggaaattacggaagcgcaaagactcaaattcgacttcactcggcaacattgcctctgccccatagacaaggaaaaaaggtgactggcctgtggcccgactgggagtagttcgcaaggaccaaagtaccgatggcagttgttgcacccatttgccggcatagggttttagccggtcaaagacacgcgctttaatcccttgaagtatcatgccattagctcgctccacctgtccattgctcatggggtgtgctactgaggcgtagcaaatcttaattccaaagtcttcacaaaagtccttgaaaactccgccggtgaattgtgtgccattatcagtgatgatccgattgggtactccgaatctgtgcacaatgttgatgaagaaatcgcgagcgttatctgctgtaatcgtgataacaggcttagcttcgatccacttggaaaatttatcaatggccacaaagagatgcgtgtaaccgccgattgcctttttaaacgggccaaccatgtcgagcccccaaaccgcaaacggccaagacagcgggatagtttgcaactcttgagctggtagatgaatttgtctggcaaaaaattggcaaccttcacatgtgcgcacaattttgtcggcgtcggacactgcagtaggccagaaaaaaccctgccggtaagctttgccaacaatggtgcgtgctgcagcatggtttccgcatatcccagaatgtatgtctttcagcaattgtctcccttcctctaaagatacgcagcgttgcagaattcctgaagggcttttcttgtata

SEQ ID NO: 89428 - DNA, 1811 bp, Oryza sativa
ttcatactcggcgacgttgtgagacgccgaaaaatgtatcaaagcacataacttagtctttctccagtcggggaaattaaaaccactccagctccagtgcccgaaagtctttttgacccgtcaaaatgcatggtccagtgctctattttctccacgggggtatcctcttggcactcggtccactcggcgacaaaatcagctaacgcttgagacttgattgaagtgcggggcttgaatgatatgtccaaagacatcaactccaaggcccacttagcaatccgcccatttgcttcgcggttgtgcagtacatcgccaagtggaaatgatgtgaccaccgttaccgagtgaccttgaaagtagtgagacagcttcctgatagtaattaaaataccatataacagcttctgaacctgagggtacctcgttttggagtcggccaggacctcgctgacgaagtagattggtcgctgaactttctggacatggccttcttcctcacgctcgaccaccaagactgtgctcacgacctgggaggtggctgatacatacagcaacaacggctcctgcggatgtggtgaggctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgacatctttctgggtacttggcggtttcatgttgaggatagcagtaactttctccgggttggcttggatgcccctatgagacaccataaaaccaagcagcttccctgacggtactccgaaggtgcatttttcagggtttaacttcatcctgaaggcgcggatgctcgcgaaggtctcttctagatccaagatcagatcatccttttgcttggtcttgacgactacgtcatccacataggcttcaacgttgcggccgatctgtgttgaaaagcatctctggatcatgcgttgataggttgctcctgcgttttttaatccaaacggcatggtgacgtagcagtatgccccaaaaggcgtgatgaatgaagtcttcaagcagtcggattccttcagtcggatctgatgataccccgagtagcaatccagaaaactgagaagctcgcagccggcggttgagtcaactacctggtcaatgcgaggcaacccgaaagggtctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagtgggcacttctccttcgctcactgtggttgcagccagtcggatttcctctcgggcagacgccatctcgcgggtttgggccatgtcgcaactctccttgtcgcatgtgacggcttgcttgatgtcgctc

SEQ ID NO: 89429 - DNA, 1109 bp, Oryza sativa
atcatccagggtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccagggggccgccgaagatatggttgagctccttgcggtggtcttgaaatccagccggggtgtcgccgtcgtccttcttccttgacgtgctttgttcctcgtcggagttcttccgagtagacttggtgtattgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatactctcgaagggattctccggacttctggataacgttgtaaagatcgtattgtgtgccaggacgctcgaaggtgccttggaagttggcgatgaagtggtcgcgtaattcagcccaagatccgatcgtaccacggggcaatccatggagccaagatcgggcggaatctgctaaagccaccggtagatagttcgccatggccttgttgtctcctcctgctgcgcggattgcgagaccgtagacggtaagccacgattcagggttagtggtgccgtcatacttctctattccagtcg

SEQ ID NO: 89430 - DNA, 1732 bp, Oryza sativa
caaaattctcaactccgcctttagcttcggtgtactttgtgttgctctaaagtcacactttacctcttcatatcttttatctcccaccaatctgtcaaagtgctcaaaaaaagtaagcatgtcatacttcacactaatataaccctttaattcattattcaggctttcatttctttgggtggtactcatatccgcagaaaacgtgttccggccatatactaatgcccattgctcccttttcttaaaaatccgttgcaaccatgtattttgctggagcttatatttttcaagcaattggccccatgcacgtaaaaattcttcttcctcttcctgatcatatatgcagttctgaaagtcagcattaaatttcttatagtccttaacacacccagcaaggtgcttgcaggcattctgattcatgtgccatacacatatccgatgatgagtttatggaagaactattttaattgctttagccatagctgcatcttcatctgtcaaaattgtttttggcttctttcctgacatgacatttagaaaagttttaaataaccagacaaaactattagcggtctcatcatatagaagagcagcaccaaaaatagtagtcttcttatgattattcactcctacaagcaaaccaaaagggcgtccgtcatccaactttctatatgttgtgtcaaagcatacaacatcaccaaaatcttcatagtcggcaaccattttagagtcagcccagaaaatgtttgtaattaagtcatcctcatcaacctgaatagaataaaaaaacttgacatcttctgatgctttcttctccatatattctaacactcccccagtatcaccttgtttggtttgtagtgacctcttggagtataatttattctttatgtcaacacgagtaaacccgagattctcaaatccacaagcttgttttgccatcaaatcaatagctgctttagtagaaatccctatggattttgcgacttcaatgcttgcaacttgagcttcatttatcttcctttgtgatcttaactgatgagcctgacttctagtggcaagattatggttatgttcaggcacaaagtgatagatagaatagaatccatctatgagacttatcttcatacatgcttggcatttgcatcgagtttctggcttactaaaactatcgccatagcctgaagcttctgctcttttgtcaatacctctacttcctgttaatacagtgcactaattgaaacaaaatgtctctaattgaaagttaatgtaactataaaaagaaacaaagaatttaccttgacgagaacaacaaaatgtcatgttttttataattttagtatttccaatgtaatgatagctgcttcttctaatgctgaaacctttcttaagagcataagcattgtagaaatcataagcttcttgttcagagctaaatttcatgccaatctttggcaccaagtcttccagatattttgttgtatgagcagcttcatttgttccttcatcctaattttatccgtggtaatagtttccatcaaaaaattgcaaaaaaaaaaaaaggaacgatgaatatagttgttcatatgcacgtgcacatgtccggatcttacagtttagatgcaactaatttaacaaaatgtaaaggagaatagatagggatcttacagcttctaattgatttcttctcaggccatcagagggatctgtggactcagcaggatttgatgat

SEQ ID NO: 89431 - DNA, 1875 bp, Oryza sativa
gacgcatgaattcctgcctttgcaatcgtcacagtttgctgttccataacttcatgaatagccactcggtcctgatcattcatcttatcaaactcatcaatgcagacaacaccacgatcagcaagaaccatggcaccagcctccagccttctctcacctaaccacaagaaatcgctcagacctataagaatcaaacaaatatgtatgaaacaagtttcaataattaccagtctcttgatcagaagtgacagcagcggtcaaaccaacaccagatgaaccccttccagtagttgaaatagccaaaggggcaatgttcataaccgctcttaggagctgggacttggcaactgaaggatctcctaccatcatcatgtttatatctctgcataccacataagtaagatatatttacactacaatcattgaaagcaagttacaacagaagcaatgatacgaagaaacagcactgaccctctcaagtgagttccattcttcagattcttctctacaccaccaagcattaatagaactactgctttctttatccacagatggccatatatagatggagcaagtgaatttcctagtaagtcaaatgtgtcatttctccttgatatttctttcatcctcttcaaatcctcccgagtatagacaggtgcatttgcttctttgttcataagtgaaacattgtttgcaataaggacagtcctataggcattgtataatataaaggatttcagaaaacaataaagtttagttcaggaaagtttaaggtcatagaactcacctgaacacaccactaacactgcccttgcttttccctggaagagccttgtaaacaccaacaattgatactcggtcacctggcttgcaagaatctactaggtcatcttctacaataatgtccactgttcttgggagctgtccaggggcagaattttcaggcacttcttgcatggagagtgtttggtgatccttgtattcacacatcccgtactcagtgaccaacaagttaccattttcatcctaagtattccaaattagcagcattacaaacaaaacaacaaataggtttcattgaatagagtagcaaaaggatgatcaaaagaatgtacccttgttggataaaccgaaccagtaggtaggcctacgaaagatgtgatgtccctgtattcacgtgagagagtacctccatagcagggcaatagtgaacactcttaacaactttcggccttactagtgaacctgaattttttaagtaaaatagcattagcaatatatctttaaatgattctgaactgtgaagtagcaggcagccaggcacagagtaatgatgtgataggcctaatgagctatcaacttaatatatggaatatgcacaactaaattgaatgatcagttgaacactaaactaaacatagatacacatagtattacttaatcaagcataagcaacaggtgaacattcttatccctaaatttttcgctgcctcagccagagctaatattcgcaatttctagtcacattcttagctatgctttaccatcactactaaccgactggactgtgatatatactttttccaccagcaggatcaactgtagaacattataacttaacttgaacttcttaaatcataaagaccacaagttaaacccagatcagccaactgcaaccggaaaatctatgaacaaactagattatgtccaaaattagggagattcaattacatttcgtgacgatgccctcgacgcagaccatagtcccgatgaaggacgacatgaggtccctgggcgtgaccctgtggaagccgaagggccccgagaatcccaccagcacgcgctgcccttccttcaagaacttggggtccaggt

SEQ ID NO: 89432 - DNA, 814 bp, Oryza sativa
tgcatcaaagtgcatgagcttggatcgagaaggtccatgatgtgatcgatgctgacatcgtcaagtattacgccaacctgtggatccaatccagcccgtgtgaggtattggttcagtaagatcccaatcccaatgttgttgcctttgtttttcagctctgttcaatttttggcaacttctgaatgctatgcatgatttagagagtatcttgtggcctgaagaggattgctgtatagtttgcacatcgtttattcaaaatctgaccaaaaacacatattactactaataagtaaacttcattgcagtgttcagtaaattaaaaatacgaaatgttgttgcactaaaagaaattaatattgcaagtaggtcaggggaacatattgtggaaatcagtgtcaaattgttgaaatggcctcccttggtgcagcccctgactttctggagtcactgagataggagtatgaaataaagggtgtgttgacgcttccagagcagcatagtactgtgatacatgtaaaaaagtttggttgctaggaacctccagatggccctaacataacaaaaaaaaaacagaggaaaggtcagggatgataacaagagcatgcgattttggagattaattatgtgagaaatataccattactgtagcaggtggttgtgactgcatctcaggttgtggttctagcacatggtccggaacatcgtcatccttcttctttctcttcctctgcgatgatgctttctctaagccaccaacacgtctagctgaaccatggatgcccttttccttgagcttaatgcctcttggcttttt

SEQ ID NO: 89433 - DNA, 5524 bp, Oryza sativa
atggtcttatccacactgcatgtgaaactccagcttatgttgctccacaggtgctcagtaggaaaggcagcaatggctcaaaggcaaatgtgtggtcttgtggagtgattttgtttgtgcatgtggcaaattatcttcctttccatgatagaaatctcatagaaatgtgtaggaatatcacaaaggctgagtacaaataccctcgtcatttttaggctgagctgaaggagctcctttatggaatccttgatcttgatcctagtactaggatgtctatctcaaggataaagagaagtgcttggtataggtagcccatctccatatctgcactgaacagcgaaacaggaaagaagagttgtataagtgaggctccttgcatcagttctaggagaaatcaagagccaccaaacctgcacaacttgatgcatttgaaatcatctctctctattgggttcgatctatcaggtttatttggtgaaaggtatggctgaagagaggcaagatttacatctagaaagccagttgctactgtacttgtgaagctgaaggaactgaccaaagccttgaaactcaaaggtacaaaaactgacaatagagtgcttaaattacccatgacgaaggaaggaaggaaaggcagacttgagcttgatgcagtggtttttctgaggttgctccttcttttctcttcgttgagttgaagaagaccaatggtgacacattggagtatcaaaggcaggtgaaagaggacattaggccatcactcaaggatattatttggtcattgcaaggtgatcaacagtagtcactgcatgctgcatcatgcacctctgtcgccaacttaccatctccacacggaaaagacatgactaattgtgaatgttttgttttttcccctccatccccatcacaaaccaagctaaaatcatggaatgtcaataaaatcgaaggcacgttttgtcctattgacatgggccatagattagagaatttatctatagttcttgcataaatgagtaacatggaagcttcatcatttctgatgtttctttcttccccatcccccaagttctgagcactgcaaaatgtgtcggctggcctgttatgtaaggaaactctatcgagctgccaaatgatgaattgacagtccaatgtagtgaaggtgaagcacagaagcaatcaaggctaccaagtatcaaggttaaggtgttctgttgtgcatttaatctccctacttggtgtgaatcaagtgtgatcaagatggccaactactagtaggaagttgtactgaaaattgcggctatctcaacggaagcagcaaatatgaccaacgccaagtttgataatggcatgttggccttttctcagcagagtggttggtaacatagtaacactcttcttattccactggtagagtggctggataagattgaaactcttaaattttctgactttggattaagtgcgttagccgaatcaaggaggcaagatactcttctccacaccgcatgtggaactccagtttatgttgctctagaagtgcttagtaggaaaggctacagtggctcaaaggcagatgtgtggttttgtggagtgattctgtttgtacttgtggccaattatcttcttttccatcattgaaatctcatagaaatgtataggaagatcacaaaggctgagtacagatgccctcgtcatttttcggttgagttgaaggagctcctttatggaatccttgatactgatcctagtactaggatgtctatctcaacttctcaaggataaagagaagtgcttggtataggaaacctatcgccatatctgcactgaacagcgaaacaggaaagaagagttgtgcaagtgaggctcctttctctggcccaacaacctgcatcagttctgagagaaatcaggagccaccaaatctgcacaacttgaatgcattcgacatcatttcactctctactggattcgatcgatcaggtttatttggtgaaaggtatggtcgaagaaaggcacggtttaaatgatgcatcaacattaaatttcatgttgtatgtgtcgaaaaaaaaagaaccgctgtatttcaatgtttctatcgaacattgctttttgctactacttggaaggagccacaaaaacaagatatgcatcccgatgcgattcaattgctcgcataagatatttggacatccatttttgtcacatgcacagatatattctctttagttcttttttccgtcctatgtcagaggagtttctagccatcatggattccagttgtagctgtctcatttggtgaagcttcagttctgatatttgatcacagctacaccccatgtactgaatctatgggaaacctcttcccttcccattgtatcgttagtgattttaaatcaaatgtactgcatttttccacggatgtgagaaaattggattcttctggaattggatgccatcgatccacaattgtagcgtctaaaaaaatgtcttcttgatgtttccgattcgtgtaatacttgtgatgcagccatttgcgttatagacattggactaatcttccattcttggcctgttcatttttccggtagcatcttggtgaagactgaaagtgattcacctggaaatgcagagatatgtgccagtcagtaacactctgtagattgtagacccatttttaattttggcgtggtgctaatataatggaagataggagtgtgttgatggaacggtatgaaattgggagacaattagggcaagggacctttggaaaggtttactatgctcgtaatcttagttctggtcactccgttgcaataaagatgattgataaggagataattatgaaagttagcctcgtggagcagataaagagggagatctccataatgagattagtgaggcatccaaatattctccagctctttgaggtaatggctaccaagagcaagatttacttttctttggagtatgccaagagtggcaagcttttccacaaaatggctagggcaaagctcaatgaggagtcggcgagaaagtattttcaacagttgatctctgcagtgaactattgccacaactgaggtgtttatcatcgtgacttgaagacggaaaacttactgctagatgaaaatgaaactcttaaagtctcaactttgaattaagtgcattacccgaatcaaggaggcaagatggtcttctccacaccgcatgtggaactccagcttatgttgcagtggctcaaaggcagatgtatggtcttgtggagtgattttgtttgtgcttgtggccaattatcttcctgaaatttcatagaaatgtataggaagatcgcaaaggctgagtacagatgccctcgtcatttttcgactgatttgaaggagctcctttatggaatccttgatcctgatcctagtactaggatgtctatttaaggataaagataagtgcttggtacaagaaacccatcgccatatctgcactgaacagcgaaacaagaaagaagagttgtataagtgaggctcctttctctggcccaacaacccgcattagttctgagagaaatcaagagccaccaaacctgcacaacttgaatgcatttgacatcatttctctctctactggattcgatctatcaggtttatttggtgaaaggtatggcggagagaggcacggttttcatccagaaagctagctgcagctgtacttgtgaagctgaaggaaccacccaaatccttgaatcttaaagttacaaaaactgacaatggagtgcttaaattagccacgactaaggaatgaaggaagggcagacttaagcttgatgcagaggtttctgaggttgctccttcttttctcttagttgagttgaagaagaccaatggtgacacattggagtatcacaggctgatgaaagaggacattaggccatcactcaaggatattatttggacatggcaaggtgatcaacagtagtcacagtatgctggatcatgcacctctgtcaccatgttaccatctccacacagaaaagacaggagtaattgtgaatgttttctttttgagaacttttacgatacgatgtattgctaatatatactggcagtataaatgatccaatggtatagattaatttgctttctccacttaaattgatttcagtgtaaaattaaaaagaatatttttttctttctactttagaatgtgttggcgttttgtgtttccatccactccatccaatctcgtcatcagcacgagtgatggcgtcgctccggcaaccaactctactgaccatgctaccgccagcacgcagcaccgtcgcctctctgaaatcaaattgattttttctcatcaccttctccgttcctcctcctgtcgccctttccatctgcccaaaatccttgctaggtcatttacatggaagtagaagcaaccatggcagttcacctgctgcaccataattagtttgatcagatcacccaacaaatcattgttatgattagttaattactgtggtttaatttctaccagtgaatattgctaccaccgagcacgtagccggtcgagaagtccttgttctcccagctggcgtcgcagaaggaccggcttttgctaatcctgattggattgaatctaatccaataaatcactagaaagctcttttcaattttctatcgaattcctagtatacccttttatatactgccagtatatactagtagtatattgtactataaaaattctattgttttccccctccatgtccatcacaaaccaaactagaatcatagaatgtcaatacaatttctttgttccctttatcttccatatatctatttgcttctctagttgtgtatccatgaagagacaacccctcttcttaattgtcactactctatttagctgatgtgtgtgaaaacagagatgacttatttagctgactaattgtcactactctatcactagggataaaaacggagcggatacggacggataatgctcataccatattcgttttcatattttttgccggatacggaaacgaatacggatagctcgaatacggaaacaaatacggactatctcgaatacgaataagaatcgaatatgatcggatacgaatacggaaacaaatttttctcggaactcgaaaaccaattcaacttctaatacaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatgggatatgtcttgtggcttctgcggatatccgaatagcactgttcaccggatatccgaattattatccgtatctgacggaaactctgataccatattcgtattcgtatccgagagaaaatatccgtatccgtatccgaactatccgctccgttttcatccctatctatcacacctccatgtaaacccccct

SEQ ID NO: 89434 - DNA, 3144 bp, Oryza sativa
agctcgtactagcgccgtccgacgaccacgacggctgcagccaccaggagccgccagtggccgatgcgtccgggagctcccggtgccgtcgcgacatgttcatcgggagagatggcggccggggcgtggagttccggcgccgggcgacgacggtggatggtcctgaggaggacgccgccgtcgatgtcaaggtgatcacgtcggacgcggacataatcatcgacctcggcgctgacgacgacgacgacacgccggagagggtgctccggcctgtcgtgaccaggcccgcgaggagggagctcgactggtgcgagccggcggaggtgaagcacgtcgacctcgccgagctgatgacaccgagagcgagctctgcctctgcctcctcggagaagagcatcagcacgggcaagccgaggcgttcgtccgtgtcgtctcgacgccgcctcaagacgcgcaccaacagcccgcgcctcgccgcgtgcaggaaaggcaagccgacggcgcgggcaacgacgacgacgccgacgcagccgccgctcgcgcacagcttcgcggtggtgaagacgtcgtcggacccgaggagggacttcctcgagtccatggaggagatgatcgccgagaacggcatccgcgacgccggcgacctggaggacctcctcgcctgctacctctccctcaactccggcgagtaccatgacctcatcgtcgaggtgttcgagcaggtctggaccggcctcgccgctgcctgtggcgtcatgccatgagaaaacgccaagagttcatcgctcaccaaagcctccatgctcattgattgctgcttggtgaatcgctgaatcttgccatgaattattatagtagagtagtttagttctttgatttctagtagatgatggttaattagcagcaagaaattagccataaagcaatagaaataaaatcgatcgaaaagtttggttcttttcttgctaggtgatttgcctgattctcctcgcctgtcagtttgctttcctcagtgtcacactgactgtagttatgagctgcactgcactgcatcaccgctagttgattaatacagctaatgatgaatcaccagtacattttcagctactgcaaatcttccaaggctgtccattttctgaaaaagaaaacgaaaaatacattgtcttagcgtacgttctaaacatcaatttggtatattttgtgcaaaagttttttatatagaattttcttaaaaaatcaaatataaatgcattttttaagtttgtaacatttaatactcaattaatcatgtactccctccttccctaaatgtttgacgccgttaacttttttaaacatatttgaccgttcgtcttattcaaaaacttttgttaaatgtgtaaaactatatgtatacataaatcaaatgatacgaaaataattaataattacttaaattttttgaataagaggaacggtcaaacatttttaaaaaagtcaacggcgtcaaatattttgggatggtgggagtattagtggtttgacttgtttttagtgttgccgacaatcttagcccaacctctgttccgaacaaagccttaagccttgtacgatcaggtgctcaggacagtaggctgaagtaaagcatgctaggtacaggtgctgaaagtcaagcaagcaactgaatgtctggatccaatccgccgtagcacacgttttgacatgattaaccgacgtgtcgctgttacttctgacatgataatatccaagtgatttgtacggcgtcagatagtaatatgtcggcgatcgagggtagtgtaaccacgtctcgaaatccttgtgttcttgtggatgttgaacgccgtagcagggatcttggtgaccagttacaagtcaccaactgttgctacaagctgggagatgtagtggtagtaggacgacagggatgcagctgcagcagctagctcctgacaagaaaagcctagcatgtagcaagacaagtatcgagcaatcatgcctcatatgcgtttcaactcgtacagggagtaacctgtgtagcaaatggagatgccactactgactaggagtagtaatttgcttagctaatgcaggccaagtaggagcaattcagctcaaatcatttgagaagatcatatctgtgattgtcctcatggttagtatatatatgaaatgatcgagatgccattacatattgatcaaaacatagggacccaaggcaacaaaggagcagtggtgaaaaacctgaaattgaaagattcttttcttttgtgtggtcagaaacatggggtgatactccttgaatggtccaaggagtagccccttgtcgagacactggagtaagcaagacgaggccgattttggaagcccagcggttgctgatccactggcaatgctggctgcagcataagaacggtaagtcagtaactaactcaagatttgtgcaactgcctcacataattggtaggacatactctgaaggtttcaggctgaaattacccaatccaattcattcatactaccacaattgaccgttggaggaggaatgattttacattcattaataagaacatactagggaatactctgaaattttacacacacacaaaaaaaaaacaccaagtacgtagtacaataaaatttctcttggagaatacagtatatgatatttgctgctaaattgattcagaaaaaaaaaaacattgactgcactaggaaaaaatagattcagagatcgtgctaaagtccaagaaggaatcaaagaacctcttcatttctgcaagtcaattactacatgttttctttttttcacttcagacatactgctactgtattaacgtatccacaatgcagaggctggatgtaaattttgttgtatctaaacatttctgcaagctgcatgtctcaactctcaaagatctcttgcccctcgtgtcccctagccaaatcaccccgtcacctcacactgctccatcttttgtcccgtgctcttggctgggctcccaggtcaacacacatgtacgtgcacaggagaagctatagcctcctgtgatcttcagatactgccctgtgcctgtgtctttctcgcccagagtgcaagacagcaaaggcatcagctgctcatgcaatgcaggtcactgttggccg

SEQ ID NO: 89435 - DNA, 640 bp, Oryza sativa
gtaaaactactgatattttgaccaaactattgtaaaactacatatttacgacggagtataaaaaaactacagatttaatgccgagtttaccacgaaactacagatttaaggtataatgtgtaaaactacatattgttaatcaaatcaaatcttaaattttcattcgaatggaatcatgtttggatcattttcaggtgataaacatgcataccagccagcatcaggatcttggttggaattgcagaaaccaagaccaccaagctcatttctgctagccttgcagctgacatggttgatttgtttctgccaaacagcaatgtcacccatctgctgcaccttggtccagcaaaggctcttggcaatggcctcaatggccgattgctcggagctcaagtcctccggcgtcctcttccaccccttgaaatgtctctcccagttcaccggcggtcctgacaggacccagtacccgccgggccggagaacccggtccacctcaatcatgtagagcccgtctgaaatgcaacaaccattgttgatattgccatgatcaatcaaagctacccctccgatcataaatattcgatgtttagaacaagatttaatcaaacttcgaaattcccgaccaaaaatctattatatt

SEQ ID NO: 89436 - DNA, 1210 bp, Oryza sativa
tctctctctctgttgcacaggtggtgtgacgcagatgcaatcgttcctgaccaagttcttcccggaggtggtgaaggggatgcgtggcgcgaagcgggacgcctactgcaggtacgacaaccaggtcctgacggcgttcacctcgtcgctgtacatcgccggcgcggtggcgtcgctggtggcgagccgggtgaccaggatggtgggccgccaggccatcatgctgaccggcggcgccctcttcctcgccggctccgccttcaacgctggcgccgtcaacatcgccatgctcatcatcggccgcattctgctcggcgtcggcgtcggcttcaccacgcaggtcgcggcccatttaaatttagcccaacaaatatatcaggcttagacttggcccaacccactaagataaacttattgaggcccaccatattaaatgggcccatttggaaaaaattgcttttgcgtcgcaggcggctccgctgtatctcgccgagacagcgccggcgaggtggcgcggggcgttcaccgccgcgtaccatatcttcctcgtcatcggcacggtggccgcgacggccgccaactacttcacggaccgaatcccgggctgggggtggcgcgtctcgctgggcctcgcggcggtgccggccacggtcatcgtggtgggcgcgctcttcgtcccggacacgcccgctagcctcgtcctgcgcgggcacacggagaaggcccgcgcgtcgctccagcgcgtccgcggcgcggacgccgacgtcgacgccgagttcaaggacatcatccgcgccgtcgaggaggcgcggcggaacgacgagggcgcgttccggaggctgcgtggccgtgggtaccggcactacctggtgatggtggtggccatcccgacattcttcgacctcaccggcatggtcgtcatcgccgtcttctcgccggtgctgttccggacgctcgggttcaacagccagagggccatccttgcctccatcgtacttaccctcgtcaacttgtgcgccgtcgtcgtgtcttccttcaccgtcgaccgcgtcggccgcaggttcttgttcctcgccggcggcaccgccatgctcctctgccaggtagtaccatgcaactcactctccattgttacgtcacaagtttcagatagttttaattaacttttaaaccgtgtgtgactaaaatcaatcaacgagtcggggcgggg

SEQ ID NO: 89437 - DNA, 1213 bp, Oryza sativa
attatatctcagactaagatgatgctagggaaaacaactgctgtaaaaacttacaaagcatacaaattcaagagataaaccacttcagtaatgagcaatcaaaacaagcaacccaagatgagctgaagcctgaagtgtcactttccaaaagaaaagggcttttactggaaatacataacaaccaggaggttaaaaattcatgcagaacaatagcacatttttcccatagaaagaaaacataaacacagaaatatctgtggtggcaggaaactagaaaaacttacaacatcacccccatcattaacatactctatgaaagatccaacagccctgttccacagaagacaaaactcttactcacagctaagaatatcaaaccagaatggtcagaatagcatgattaaacttagcatactttaaggcagcaattctgacacgagagctagcctcgtcttgcaggcatttcagtaaaataggttgcaaatcattcagatgagattgaaaagtagttccgatagtttcagtaagggaactgaacagtatcaaagctacctgttaagaaaaaagtgagcgagtaagcattgacattatccaccaaaaaatgctgcaggttatagaactaggaaattggtccggatcatcagacttgtcaatatcaaatattgtactattagtatgttgctaaccaaaaaaaaatacaacttttatattcttatagcataaatcaagttcataaatttataaaaacagacaatgaaaatgtaaagcacaaaaggctcttcttatgtttaacaacaatatgattcaaattgccaattctcaggttgattctatggtcctagacaattacgtagtataagcatgcataactaaacataatatcggaagtaacacaagtttgataagaacactgaaactcgggatagacttacttctctatgatcttcctgtggactttggctgcattggaaaataaaaggtaacaactcaggccattctcctgcagggacagcgtacttagctataatactcacaacatttgcgctagctcgtcttacaagatggctgcataaaagtaagattcagtctctaacagaagtacatgtcaaaatacgatgtagtttgaattgtacaagtaaacagcatttgcaccaaatggaagggattctagcttgctaaggaggctcttttaaatttatctacttggttacat

SEQ ID NO: 89438 - DNA, 5039 bp, Oryza sativa
ttttttgaaaaatatggcgtcataaatatagctactcccccttttaaaacctaatcttcctattctgcccttgtccttctcctcctcctcctaacagtagtttgggttgggttgtcccagaaaataaaatacatttgcaccatgcaattttccaagctgaaacgttgaaatggcgagaacatgcccgttttgtactggagagcgtgttacccccagctagatggaaatgggcacacaccttcccaaaatttcccaatggaataagcatatgtcatggagggtcccccacgggcggcaaaagtatttgttccctctattctagtggggtgcgtgctgagccgagccggagcacgaaagcacacaccccacaacccccccgtccgctccctacaaataccccccgctctcccgttcctcctcttatcatcggtgtgcgctcccatctgaactgaagcctcttgccatctcccccagccgagtgagtgatctctcctctccatctcttagccgccaaagcagaagtcgtcgttgtgaggcttacagctagctgcatgcgctcgcgtgtgtagaagatagcagccaccaccatcaccagacaccagcaaaaacaagagaaaaattccaccggcgaaacacggaacaaaaccgagacgcgcgttagagtctaccaagcttatctccccaaccccaccccgccgcgcagcccagcctctcgttcgtttccacagcttctcccgtcaaaccgcgcacatccgcctatatatcgcgcgcgcgtgtgatctcccggtttttgtttggttttgctccccgttctcccgttgccgtcccacgaggtaaaaactaaaccaaatacatatataaaaaaaacgcggtgctgcgacgaggacaacgtagcggctagcgccatcactcgtggtgttactgctttgccactgtactgtgtactgtggtgtgtgtgtggggggttgtgacttgtgtgacgctacctgcgacaagaggaccaagggagacatggcagtgacagtgttcgagaccgccgagcagcgactgccgtgccacgccgccgctgccgagctgggcgccgacggcgggaagaaggtggcggtggatgatgatgcgagcggcggcgggcccgggcaggccgtgctgctgctgcaggagaccgatcacggcggcgacgacgacgaccggccggagagggacgacgtgtggaacatgatccagtcgcagaggccgccggtggcggcggggaagcagcagcaggcggcggcgccgtacgtgcacccgctcgtgcggaggtcgtcgagcctgctcagccagaagagcctggagatttgcaccgagagcctcggctccgagaccggctccgacggcttctccgacgccgatgggtccaccgaccgctcgtgccccgcgtcggacgatgactccgacgggggcgcggaggaggtggccgcgcgcgccagcccgccacgcgcgttcccgccgccgctgccgtcgctggcgcggcgcacggtgggggcggtgcagatgacgcaggaccgccgcgacggccgcctcgtcgtcaaggccgtccccgtgccgtccgccacgctgttccgcgcgcagcgctgcggcgggcgcctgctcctctccttcgccgacaccgccgctccctcctcggacgaggacgacgagaacaatgaccaagaagaacccgagcagcaggccgacgaggtcgcgcacgacgaggaggaggaggaggacgacgaggatgacgaggaggaggtcgaggtcgtggacaggggcaccatcgtcgaggtcaaggtcagcacgcagccgcaggcgcgcagcaacggcggcggcagtgttgggccgcgggtgcaccgctcctcgctcgtcatcaacaagttcgtcaacgccgagccggccatcgccgcctccgacatcagcgacaccgccgccaccgcacccaatcccccgagacgcccgaccgggtccaccaccacggcggccgcagctctcgtcgcagcctcatctctgagcgcgacctcggctccgtcgggcagtgacaaccccggcggcgagagcaagctgctgatgacgacctgccggcgccggcggagcaaggaggagctcatgaaccacatgcgccgatgcgggcagctcagcggcaagctcttcatatgggagccacgcatcgccacctcctcctgagccgacgagcctcgccgccgcctcctctgctcgcttgtgccacgagtgctctgctctgctctgtttgttcgtagccgttgtaacgtaaacgtgcgtaatatttgtgttagtagcaaggtgatcgccacgtgattggcttagccctcttgtctgtgtctccttccgtgagtgagagggagggagctagatttgctttcgtttatctccatccgtccccgtgtctcgttgcatgctgtatctactacgaatttgcatgcattgcgtaccagtggttgctgctcgctaattgattttagattgtgccatgtgtctgatccgattacgatgtgtagtaataatgttatggcacaagttatggataatgctggttcatcagttcatgcgaacaaaaccaaatcgctactagatgcacgacaaccttgtgatcatcgctcaggcagagcatctatccgaagaaaaacagagtcaatccaagatgaggaactgtccaaaaaatgattagtattcttggcaccagcctaaacgtacgtcggtggctgttctgttgataaccttcggaaattctcagtgaacacagcatagattggcatgtttatactgaattaaacggataattaccctgcaactcaaagtctcaagattggcatatctccatcggtccaagttcggttaattgcattgaacaaatttagtttactcgtacatgttaggtgcgtaccagcatttgtttccagttgtgaaacatttttaggactagtcaaactcaagtttctcaatcacaatgcgtagtgttgtctatgtaaaagtcccatcaattccttcattcctcgtatgagcaataatatagatcaaatgatccgttataaaattttggtgaataaccccaaaaattaactaagccattgtgcatttgcttcgaaagcatgtgtcgttgtgatctatattattgtttattaagaggaatgaataataatatagaacatatagtagaagtcttttaaaaaatatatatttctcaaaaagagcgtatggtttacacgacttattttaagctatttgttaaatttattattaaaataattagtttactcctataatcaaattaataatatgcaacaacaatccgccatcaccaacagattctttaaacatatccaatcataaaattatgagattttagctgaaaatcgtgccttgtttggtagagctctaactccaaaatttagctataggggttaggtctggagtagaattgtggaggagccaaaacgcaactccacatctctaattcattttgtaagagcactccacccagctccgttcctattttaggtggaactgaaactgtttggctgagctggagctgtgtcaaacagagcccaagtctcaaaaatttggtagtcctatttctgatttttcgctctccacaagttggaagcgcgcaaccactcccaatctccaatcagagcagaggggtggaggggagttgaaggtgggtacatgttctgttttaggaagctaattttaagcaatctattgcaaagattcctaaaacgattttcttttttatttggaatttggggaactgttggtcagctattaataatatatttcaaactaagcctaagaaaacactagaaatgcgggtagttaaaatcctgcctatcattatgtatagtcgagtacactaccaataagggtttagtgattttaataaggacttagcgagattaacagatttaaaattaggtatctatatctggaacgtgtgttctgatgatttatctcttgaaacatgtgttaaatgaggtggggttatgggggcacgagcgtagtgtgtatgtgtgcatcttcactataatcgaaaaaggcttaattgaaagaaatcagatgctagaaaataaaatatgacaaaaaaaactccaaaattatatttaaaatttatcatagctgcttataagttgaaaggtagacgttgtgttttaaaactagataaacatgtctgtccattgcaacacgatctaaaataataaaataatatggaataatagttttataaggtttagtttttttatccactttcattagtcggttaattttggaaagggtggtagggtaggagaggtgggccagttcgttttttatagattttttttgcgcacacaggtgggagaaggacaactaccacttttataaggtagtagatatttccgatggtatttttatgataactggtattttttttctaataagtggtatttataatcttgtctcagtggactcaaatagtagatatagtttgaaccatgaagtttgtttactttgtgccttttttttaacgaaccagtatatgatgtgccaatttcattaaatataaaaaggagtaaaagttacttgtacaagtacgaagaaactgtacaaaagaggtaaggcataaggaactaagagttccaggtgctttgctcctgccaaggtctaagttttagcttcctctttgatttttactcctagctcctagggaagtgacagactaatttagactaagttactttgtgcctaatcaacttatcacactataaactcaaagttttgcttttattggtaggtgtcggtgacatgggaccgggagtatcacgactagaggcttgaggcagacacaatcgcccacgtggcctggcaccctcgggggacgtcgggcccgagggtgatgtgtgcgcccacctcttggtctccccgaagggggggggggtcggaccactcctgcctcgcccccgagggccaaggcgccccgacccctcgcgggttctactccgcgtgtatgggttaggtgagcacagcggggc

SEQ ID NO: 89439 - DNA, 642 bp, Oryza sativa
catcgctcgatcagataatcgatcattcaccgatcgattcatcgaattatcgagatgatcgatcatgtaatgcttaccgctgcacagtaatggacgaccttgacctggtcgaggtcgacgttctccgggtgcctccagagcatggcgagaacggggttgtagacgttggggatgggcttgtactgttcgcggaagaacatgttgaggaagtcctgctcggcgaacggggtgggcggcgtgacgacgagcgcgtcgagcaggtccttggcggtgccgaggccgggctcgtggacgaacatgccggcgttgaagtagagcggcggcggggggcagagctcgcgctccggccacgccacctcgtcggggcgctgctggcagtagccgatgtcgtactgcggcgtgtggctccacgtcttctcgcagaagcagtccttgacggcgtagaaggcgcccttgtcgaggtcgaacaggtggtcgatgttgtcgaacacctgtatgtcggcgtcgaggtagaccatccgctcgtactccacgaactcccagatgcggagcttcgagtagttgatcacgtagtaggccatggcgaactgcgtctggctctccggcgggtacaccggctgaatctcccggaccacgcacccc

SEQ ID NO: 89440 - DNA, 1750 bp, Oryza sativa
gttttccataagccatagttctctcctgatcccatgcatgctacatatcatacacatctcatgtcatgctgacattttctttcagataaatctcgagcacaggatagcatggatggaacctccaggaaacagctagctgacagtcgcctgatgatcatatcaactagcaagatgcaaattcagattgcgttacaagcctcggttgaaatgagcggcaagtgttcactgcgcagcctgggatgcagactcgacaaagacaatacgccccaaaggttttctcccttcgccttttgtgatgcaacagcacatctgccaattatgggtatgaacaatctcaccttcaacgggagatggatagcagcatcatgcttagggactaagcatgtacgtacggactactaaaacagcgtaagtaaaggtgaggatatacatatgtctaatttcagatcgatgattattggcaaaacctgttctgcaattgggcttgttaatttattttaatttaacaaaacgatcgattcttgtgcatgctaaaagtagtagtagtattatttgcacagcttcgtatagtcacttcgtttgtaaagcccaagaaaacaaagctgcccttttcttttccttttcaaaactcttgcccacagttggtcactacttgccaactactttgggggcagaaaaaggaaaacctgaaacaagagaatagtacagcatactagccttgattttttttttcgctattaccttcagctgttcagctggtatctactcctacgtaccgagttagattcatcaatagcctccttctattgggctattggctacagattttgtgaagttattatcggcttgtgccatatacaaattttgaccaaatatttgttgttcctcaaagcacggttaccttgtacacaggaacctacaccgaagttcgtcgttccgattataatttttttctaagaaccaattaaaatttttgaacatagtaacgggatcagggcatggagcagttcatgcttgagatatcctgcttttgataccaatgtgatgataagccagaaatgtttaatttatactgggtaaacaatgagaaatgctagctgatgaaaggtatccactaatccacacctttaattgactgctcttattgaaagtggagcaagctaaccttgcatggctcatatgtggggcagcatatatagtgcaccaaagtaccaaacataatgtcagtgtatatacatacatgattaattccttcgatgtaagccaaatgagaggggtgacttagttatgtgcatataattaatacgatctacataattgtgaaaaaaatataatttattttgacaatacagattattctttaatttatcactgcaaaaatgaatggctaaactcaatcgacacatgcaagggaaagataaatcaaatccagctttttagaattctccaatatacgcaaccaaaaattaacttggttagatgaatttggccttacatgcatgtttgtagagttacaccattacatacttttctgcaggcatgcacctctaacattttctaaccatttggatgtatgcataaaattaaggaggacacatacatgccactaagttgtaaaatgattttcccttcctaaatcgtaatatattttaattaactactttataacaggaaaacaattttctaaaagaggtcttacccgttatacacaattaacagagtgtttttaccgtgataaagaagatatcat

SEQ ID NO: 89441 - DNA, 787 bp, Oryza sativa
gcaagtccgccggcaccgtccgcctcctcaagtacaccgaaggtaatatgcacttaaaaaatctcgtgtttaattctcaacacgttcatattgttttttaaaaaaaatgtttagagtgacgtctctccggccaactctcatttttacgaatgatgcctccgatcgatgtatgaactttattgaaggggtgccgatggtgacgttcgcgaaggagaaggtggaggtggcggacgacgagaagaaggtggtgtcgtacagcgtggtggacggcgagctggtcagcttctacaagaacttcagggtgacgctgcaggtgacccccaagggcggcgccgccgcccccgccgccgacggcgcggtggtgagctggaccatggacttcgacaaggccagcgaggaggtgcccgacccggacgtcatcaaggagaccgccgccaagaccttccacgacctcgacgactacctcctcaagaactagccagacagccagatcgagcgccgccgtgcgggtgcgtggcttatgtgttagagtccactatagcgtcctcgccgtcagtcgtcgtcgcacacggtcgcagtatcggggtgttgcatttgctagctctccggctagccactgtctcccacgaattagtgtacgtatcggtgcatgagtgaataataaagtgttcaggttaaaccgtttatcgtctctccggctctccgtttactgtttccttgtattgattttcggtctatccgactctctcactctcctttggttaggcctaaacatgtttaggttgag

SEQ ID NO: 89442 - DNA, 607 bp, Oryza sativa
gcccaacaatattattatttcattatagcatagactatatgacatcactgtcagtccgcatgttgtgttttgtaacaactagcaattgtatgcttttcttgtcaggaacctttctctaacaagtattaacgaaacaatgaaccaaaataacacttttgacactcctctcatgaagacgttggtaatacttttaacaagtattactgtgtacttgtactgactatgattattctgttcaaatttgaaatgtgcagaagctaaaagtgtctttcaacgagatgaagcttcaagttgaatcaactcgatctcagtgggaggaagacttgaggaggctaggtgagtaatggattcagaaatgttttagaacattttgtcctttgatcgctaaacatttgcttaatattgcagaaagttattttgaggctcataatcacaatgcttaccacaagttactcgaggaaaatcgtaagctgtacaatcaagttcaagatcttaaaggtaatatgcgaataaattaacttcatttcactaacagtgagatatttgtactgataaattgaaacatcttttaggtagcattcgtgtatattgtagagtgaaacctttc

SEQ ID NO: 89443 - DNA, 513 bp, Oryza sativa
atgtccaaaacagaactagttctcagaccagatggagactagcaaaagatctttttgaccttgaaagatgtcaaattttctttaagaaggttattctcttcttactttcttggcaacatagctgtcaaggctccaatcaacatagcaaccatcagtggctcctgcaggcattagcagcacaattcactgaatcttcatacggagcaggtgcaaagaaactagcatgtcttgataatgtacgcttttcacactgttaataacagacacaagcacaaagatttaatttgtgaagaaaaatgtttcatcacacaaacaatctaattgaaataaatagcatgagaaagaactgaataaacatattactcaatataagaacaacatacctccccaggcgttaaattcccaatcaattcctgctatatttttttctgtgattcctaaccctggtgcacctttacgaacaataaactaaaaaacagggatactgttagcaacccaaacactggagagcaa

SEQ ID NO: 89444 - DNA, 678 bp, Oryza sativa
agccattcaataagtcaagcaaagataagcagtcccaacatttgggtataaataatttgcattcccattcatcccccacattgtatcatgtctactgattgttatctatgcacactcatcaaaatcatgagtaaatcagtagccagagaatccagattcacctcgacgagttcctccttggcctcatcgacgccctggacatcgtcgaaccccactcgctgcttcctcggccggcgccgcttctctgcgccgccaccggcggacatctgccgctgtatgaaccacatcatcggcagcagcgacacccacagcgtgagcagcgtgctcagcatgtccaccagcagcctccccgccggccgcggcgccgaccggtagtccaccccgccgtcccgcatcagccccagcaagaacccctcgtcgtgcggcaccctcctcgcgtagcacggccacctcgccgccgccgcggcgcctctgcgggcctcgcccgcgcccgcgccggcgtcgtcgctgccgcccccgtcgtccgcggccctgcggaagtagatgcggcgggagtcctcctcgaacgcgacggcggtgacggcgcccgcgcggaggccagccaggaggtccgagtaggccacctccttggccgcgttcttgggcagcgcgaggcgggcggcgaggaggaggaccgcg

SEQ ID NO: 89445 - DNA, 1672 bp, Oryza sativa
actttgtttctgtaactcatggtgatgtaattgtctatcagatttctaaatatgaaattggcattagacgacaaggaacgtgaagcatcaaagctaagagatatcgcgaaccgtgtggcctctgaaaagagaaatgcaagaacgaggtcacctctaaccaccaccttgtcctcgaaacctgaagctggtcaggattccagtgtagacacttgtacaagcgaggtaccacatactagaagcagtttcttgcaagttacattacagtatacaaaagattactaatttgaacatatgtctaccttgttccatttgcagatcagaagctcatcatctggaaagcagagaaggttccgctctccattgtcagtgagagaactggacgagaagtcacctgtcatcaaccgggagttatacttgagtgccaagttcaagactccatctcctccagtaagaagttcattgtctgccgagagagttggcattgccaaaagcgtggagaggtctgaaaacatcgactgcacaccagtatcaaggattgaagtgcccccaaaagtacagcacagtagctctaggaagaccccttcatccgtcctgacggctcaaagcttacggaaattccgagactccgaagaaaatagaagcgcaaagccatcggtccgagaaagcatgacaaaaaccaggctcgacagtgcaacaaagccgcctcagaaagaagagcaaactgcaaacaagaacacaggtactagagtgaggtcagaagccaagatccccaggaacatatctgacatagaaaacgagtttgcaaacagtgagcccaccttccattccaaccgaaaggcatggaagctcccaccacagtccacaagacagtcgcagagcattgatcttaggtactaagattcttcactggtaacaacatgacatgttttccagttttcctgttgcatacaaatgcatctgtagatgtctctctctttttttttgtgagttcgcttacaaagatgtctctctttttttttttggtttgggttgtcacttttggcagagcctctgtccgggagatggaacctctgactgaagggaagcctcgccggagcaaggcgccccacggtgatagaaccaacgtccccttaccggagacccggcgcagcgtctctctgccccgcgggaagatggctctcgtgtgaaaaatctagttttttcgtcaggcgaatttcattgtaccctgtgatccggctatatctgtaggtcttctacggctgggtagacgaacctgagaggaacacaatcattcattggtttgttcttttttttttcctttcatttttgaagttcgtgtgtctgtttcgtacgaacctcacgcccttttgtacaatgtaaatgtagcaattgccattattatatctcattttcagtggcgattgccttattggaagctgaaagcctgaaaccactagcactttgtatcagtatcaccgttcgtgcagatgttcggagttctaacaaatgatttgctcctggtctttgctactgcagtgcagcagactacaaggcttgaaaagctagtttggttttacaaattttgctatcgattttatattttcagcgaaaagagagagagtttgttttttttttcgaggaaaaaagaactgtttacccccgtatgagcttt

SEQ ID NO: 89446 - DNA, 1734 bp, Oryza sativa
tgaaggttgctctgttgggaggcactagattggaatatctggtctttcaacaggctagttttataggtgtaaactaggaaaatctatcaatgcaatgacttgctgtagttcctatcaatgcaaccttttgttcttggtgatgttactttactctgttttcctctattttgttttgttgatcaatccttgctccttcctcattcttctctgaaccttccccctttctctctgcaccttctgtttgagcagtacaagactagtcataactaatcaccatgtctgtggcataacgacttgactgaactatatgatttaacctcttttgttagttatccctttatgtctattcaaaatttttaactatcattatgttgagttctctctatttttctaactagttactatcattgattaaaaaaaaaacagtcatcgctttaatattttctgctaaaattctggcaccttcacgacaatgcccttttctctttaatgttatataggtataacagagccaataaaagctggtatcagagatgcaaaattgggtgtggggaagcaagagcaagatgacttcttcacatcagaagataatgtgcaaaggaggaaattaaacatagagcttgaggagactgaagaacatataaagaagcgcgaggtgtgcaatcgaacactgattccttaatattctatttcttcagggttgatgcttgcactttgaaatcttatatctagctgttggcattacatattgatatttgtatcttattcatgcaagagttgctagcatcagccctcatgatccttgagcattttgggcattttttatttggtggttctttttcctgcttggtgcaaatcatgacaatccaggtcatagcagaacgcgagcagaaaatacgtagtgaggtcaaggagatacagaaggtgttcttttgcagtctctgtaacaagcagtacaaattggcgcatgaatttgagtctcatttgagctcatacgaccacaatcataggaaggtaatgtgtttacttggtgcagcgaacttctcttctactgccttttcttttgtgaagtatgggtgcacatacatatattcccccttcactcttacatattaattgttcaggactatatttctgataagttcactgtggttacaacagaggttcaaggaaatgaaagaaatgcaaagcagcagcagcagcagccgtgatgacaggcagaaacgtgagcagcaacgagaagagaaggagctggcaaaatttgctcaactgtatccatcccatgttttagtcaataacaatgataactcaatgatgtgctaactatgaacaaatgtgctgaatgtttattgaacttgcaatttccttaatgggacttcagtgctgatgctcatagaaagcagcagcagcagaagcaagaaccatcagagagctcatcagagagaattacaatgaagaacttgcctaacccttcaaatcaggatcagcgtaaaaccttgaagtttggcttctccaaaatggctccttccaaggtaccccacatctgaacaacatattttgttaaactgatatgaccatttatggaagtaaagtagttgtgtgcttgcatggaactctgtgaatttgttttatcttttctatattctccattcttttttcattgctctagtttgccgttaagttgaaactttcttaggcttttttgttaaactgtaatttcctctcagcatatgt

SEQ ID NO: 89447 - DNA, 703 bp, Oryza sativa
acacccttcctccgtactctacagtcgggcctagcaaggcttggttgctccagttcactgtaagtaaataagttgttattatcatacatgcttatttgcgaccggatgagtgttttgtactaacatttcattctcaattgtaggcggaccttctgcaccctgacgctgatgattactcggtccgacgctcccttgaggcgtacctgttgtggttgttcgggtgggtgatgttcactagcacccacgggcacgctgtggacttccggctagtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggttgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttttcttcacataacatgtctaattccgatcatgtttattgcagcgtcgttacgctcacgtccaggtgagacgtggttacccggacttcgtgttcgagtt

SEQ ID NO: 89448 - DNA, 660 bp, Oryza sativa
acacggctggcctattatgccgccgctgttgggcgtctacgacttcaccgccggcctgcttccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgcgctgttgggcgtct

SEQ ID NO: 89449 - DNA, 733 bp, Oryza sativa
agtggtagctgtataaaccagatgtagaggcgagggcactagtcatcagcagacgagacgaccggcgatgaagatggtaaggccaatcaacactggcagaatcatgcagccatggaagtgaagaaaccagtcggcagccatggcaaacgtaggcagcttgtgttgaagatactaatgcctattagtagtgacagcgatgtagccagccgtgaagaagatagcatcagttggcgttataacaagccagccgtgcaggcggtgacaccagtcagcggcggatgcggcggccggtcataataggccagccgtgcaggcggaaacaccagtcggcggcggcgaaggcaagccgatcggtgaagacgtagacgcccaacaacggcagcataataagtcagccgtgcaggcggaagcaccagtcggcggcggacgaggcggccggtcggtgaagacgtagacgcccaacaacggcggcataaaggccagccgtgcaggcggaaacaccagtcggcagcggtcgaggcggccggtcggtgaagacgtagacgcccaacaacggcggcataataagtcagccgtgcaggcggaagcaccagtcggcggcggacgaggcggccggtcggtgaagatgtagacgcccaacaacggcagcataataggccagccgtgcaggcggaaacaccagtcggcggcggtcgaggcggccggtcggtgaagacgtagacgcccaacagcg

SEQ ID NO: 89450 - DNA, 7837 bp, Oryza sativa
aagcactactttcaggcccacaaagtcactgtgccgtcgcagtaccctttgggcgaagtgctacggggcaaggaaattactggctgactcagcaagtgggcggcggagctatctcccttcgacctacattttgtcgcccgcagtgccatcaagtctcaagtcctagttgacttcgtggccgaatggacacctgcattctcccctgaacccgagcccgttgaacagccttgggtaatgtactctgacggctcgtggtcacacaagggggcgggcgccgcggcggtactcactttgccaaggggcgtgccgatttggtatgctgcaaggctgcagttcgacacgaccaacaacacgatcgaatacgaagctgtactgttgggcctaagaaaggcgaaagagttgggggttcggcgcttgcttatccgaacagactccaaactggtggcaagtcatgttgacaaatcctttgagacaaaagaagaaggaatgaaaaggtatctagaggctgttcgatctatggaaaagtgcttcgccggtataacggtcgaacacttacctagaggtcagaatgaggaagcagataccctggcgaaatctgccgcctgtggaggcccgcattcaccaagcatcttttttgaagtcttgtacgcaccaagtgtgcccacagaaagcctggacatcatggcaatcgaccaggcagaactgggcgaagatccagaggattggcgaacaccgtttgtcaagtacctcaagaacggctggctcccggaggatgaagcagaagcgaagcgcttacagctcagagccacaaaatacaagctggtctccagccagctgtatcgctccagggtgctccaacccttacttcactgcatctccttcgccgaagcagaggaaatggcgaaagagatacaccaggggctgtgcggtgcacatcaagccgcaagaacggttgcctccaaagtgttctgccagggagtgtattggcccaccgtgctgaaagtttgtgtcgagcaagccaagaagtgcgaaagttgccagcggcatggctgaagccaaacggcacctcagtatgagctgcaacctatagcaccagtctggcctttcgccagatgggggttagacatcatcggcccatccccagtggcgcgaaatgggtacaagttcgcaattatggccatcgaatacttctcccgttgtatcgaagccgaaccactcagtgcgatcatttcggtagctgtacagaagttcgtgtggaagaacattgtttgccgtttcggagtgccaaaagaattcatcgctgacaacggcaagcaattcgactctgataagttcagagaaatgtgcgaagggctaaatctggaaatcaggttcgcttcggtcgcacacccacagtcaaatggggcgtccaaacgctcagatggcaaaatccttgaggcgctaaagaaaaggcttgagggggcggcgaagggtaaacggccagacgaaatgctatctgttctctgtgcccttcaaacgacccccacaaggccaaccaagttcagcccgttcatgcttctctatggcgatgaagcaatgaccccaactgagctaggggctaactccccaagggtaatattctctggaggtgaagatgggcgcgaggtgtcactcgaactccttgaaagggtgagagtcgaagcactggaacacatgcgcaaatacgccacaagcacttcggcaacttataacaaaaaagttcgaccgacagagctattgcctggtcatctcgtcctaaggaagaaggcgaacccggtggcggtcgggaagcttgaattgaagtgggaagggccatacctcatcaagtacaggtccaggacaggctcctttcacctagcgacgctggaaggcgaagagttcaaccattcctggaacgctgcttcccttaagcgtttctatgtctagaatgggtggcacccaaatcgccaacttgtaaaaatatacatattgttatgtaagcctttcggcactatgtaagcccttaggcacaaaaatgcaaaaaaatagaggaaaatgaaaaaagaaaaaaaactggatgtaaggctattatccaccctggaggcctgaaccagtataaaatctttgtgtctttcgcctttttacttgtgtgaatgataattcgttgaaaaaccccaaggcaaacgcctgatcagcgaaaacgccagggggccgaaacgaatcggccgaagaatttctcgccgaacattgagaccgcgacagcttgttttgggaaataactaaccgaacaccgttatactcgatctatgtgaaaacacaagcgcttctttcggcgcgggacaccaccgatcgaaaacggaagacgaaagctaaaaagtcagcagacctatttcgctaatatacgcaaaggggccgacatgttccaacctaacgaaagcatgaaaggtgacaatgcgaaaaatagcgaaaaggaaataacacacatctttattaaacttcgaaaaaataatcgaagagtacaagccatacaacatggtacaagcaaagaaagcaacagcttcacagcctacctcacaaataaattacatcttcgcccccaaagcaatccccactccctaaggaatgattcggcgaacatggctcgtcatcactactaatgtcatacacaaccctaagggggaagggggcgaaacacaaactagaccataacgacgctgggcgatcatttcctgacgatcggtcctctgatggtttcaccaaaagcgaaccatttcctcccggtgttctacatgggcacaatcgtagtcctctagggttcgcccggggtgcgtccacatccagccggcaactttcagaaccttctagctgttgccgtttattatcatctcgcagtaaacgagccgaaaaggacgcctaatcttcggcaaacttttcgccgcaacaaacttctcgttatcgtttcgccaattaccagtggggggccgaacgcatactttccggccacaagcctactaataaagcacaaaagaacaagtgcaaaaggaaaaagttcggatgaaatcaataccactgtccaacaggataataaggttggcgaaacactaatttttccattaacgaaaagtcataagagctacaaggcgaaaacggctaaaagccgaacatgcaaaaagcctacatacacagcagggctaccaacaaaagaaaaaaaaagaaagtcatacgagggcgaagggcctcacacctcagggtggtctcggccttcatcttcctcgcccccatgctcagtagcgggatccgacggcccggggtcttcgcctacgttggcggtagtggtgtctttggccttcgccatcttctcaagttgctcgcgtaggcgggtcttcgcacagtccttgccgccatcctcccaaaagccctttcagaaggcccttaaagccgctccggagacctgggagttttcgggccagtcccattcacgagctcggagaagttttccacatggccgcaaccatgctcgtgaagcaagctgagcacgaaacccaccaaaacacgcgcgcagcagtccccataggcgctagccacttcgacaactgagccggccccttcttgcgtccactcagaaaagtcgaaagccatcccgtcatctcccggggcacccttcgcgcgcgcgccaagatcgttgagggccagcctaagagtgtagtaggcttgcttggcggactccgctgccggtgccatggtcgaagcaacagcttcggccgggacaagacgagcctcaagagacttgatcttctcctcggccgcagcaagttgacgctcccattcggtatcccgcttgttcgccgtctcaagctccgcgcgaagagacttgacttcgcccgtgagagttttgttctccgcgttcgtcttctttagggcgttcgctacaacacgtcgtttgtcatctttatggcgaaggtcctcctcgtttttccggagacgaagctggtacccatccagcctctccaaggcggacttctccgtgcgtaaggggaaccaaattgtatctacagtcattccgatttgagaaagtggtcaaagtggagagagatttgtaggtgagggagaattggagagatattagcagatttgttacagctgagattccattttggcgccttggcggtaatattttggtgggagaatttttagatccgcgggaattatttggaggcaaattgagactcccctgaaaaaaaaaactgagactgtattcttttaaaaaagaaaaatggttttgactacgaattatcgtatcaaaaaaaaattatattttcttttctacctatttggtgggaaaagtttttagattggtggaaattatttggaggcaaattgtgctgtagaatgagactgtattctttattaaagaaaagatggttttctacaactatgaattatcctattttaaatttgtaccgtcaaaaaatttcagttaacttctgtaccattaaatatttggtatgaaactttttagattggcgggaattatttggaggtaattcgtgctttggaggtattgtaaataagattgattgtagcgagagagattgagcgagagcgagagattaagggaatgaatgagcggatcctttattgataacagtgttacaatatataggagggagagaggcggcaaccgaagacgcgatggtttgggaaccatcgcatctgttgctagaatcgccgtgaggcgagaagaggtgtggggcacaaccaaccgtcatgtccctgaattggttgctgctctatccaaatatatggatgagatcacccaaatatttcataacactcccccttgatcgaatccagctttgatcattgctcatttattgttccagatatctgtaaagataatcttagaaataattatagttagtatattaaatacatcacgtaaaactcctcgaaaacccagtgggaaaaataaggagagaaccgtgatatattattgactattgttagatctcttatgagtaaagctcatagtatgatccaaaatagtatattatctacagttatcatttagtaaaaaccccaatgaggaaaagccaaatgataagacatataacttatgttgatattacctcgttaaaaactttggatgagaaaacctaaagggtaaaactcatacaaaggaaaaagagtataatatgacgaaaataggttattttccagagagaggtactccccctgaatcctgcaaatttttaagtcgtctcataccaattccctcgacacatttaaagaatgtggagtatggtaaagattttgtgaataaatcagcaagattatcacatgacttagtttgcaagatgtttatctctccatgttgctgaagctcatgaggataaaaaaatttaggagcaatatgctttgtgatgttgctcttaatataaccagtttccatctgaacaacacaagcggcattatcttcatagataatggtaggtgattataatgaaccaataccacaagatgttaatatgtggttaaccattctgcgaagccatacacattcacgtgatgcctcgtataatgcaattatttcagaatgatttgtggaagtggctaccagagtctgtttagaagacttccttgaaatagcagttccaccttgtaaaaatacgaatcctgtttgtgatatggcattgtggggatcagatagatagccagcatcagtatacccaattaaagtaggatcctggtcctttttaaagaaaagtcctagatctcttgtgccattaagatattggaagacattcttaactccagtccaatggcgtttggtaggagcagcgctgtatctcgctaatagatttaccgagaaagcaatatctggtctcgtactatttgcaagatacataagtgcgccaatagcactaaggtatgggaaatcaggtccaagtacatcctcaccatcttcctttggtctaaatggatctttcttcacgtctagagatcgaaccaccataggggttttggaaggatacgacttgtccatattgaatttctccaaaattttatgggtatatgcactatggtgcacaaggattccagaaggtaaatgctcaagttgtagacctaagcaaaatttggtttgacccaaatccttcatctcaaattccgtctttaaatgatgacgtgcttcattaatatcttgtgtattgccaatgatgttaagatcatcgacatataccgagataatacaaaatcctgtgggggactttttgataaagacgcacgggcaatcatcatttttagtgtatccctttagggaaaggaattcacttaatcagttgtaccacatcctgcccgattgttttaagccataaagtgacttctgcaacttaacacaatacatgttacgatttaccttctgattcgggatatcgttccatcaggaaccttcatgtaaatatcagaatcaagtgacccataaagatatgctgtcactacgtccatcaactgcataaatagacgattttgtactgccaatgatattaaatatcggaaagttataccactcataactggagagtaagtttcgttgaaatcaacgccaggtttttgcgtaaaaccttgtgctacaagccttgctttatatctcaccacctcattgttttcattctgtttccggacgaaaacccatttgtatcccccaggaaagataccacgaggagtaggcattacagccgagaatacatctcttttgtaaagcgaggccaattctgtgtcaattgcgtccttccatttgttccagtcagagcgcttttggcactcttttatagacctaggttctggatcaacttggaggcaatcagcaatttgttcaaaaaaattagtgtcgacaattgtagctcttctatcaaaagattctccagtttcagagtagttgatggcaatttcatcaacccttacagactcaccatgatctcctgaaacaatatgtctatggtcttccgaattcctagtcttagcattgtgcaccactgagctaggttgcagactatcacgatctgcttgatatatagtatcaattcggtgtgtaccaactaaaggttggtttgcatttaccgtctttctttgcttattagcaattgtttctcgctgagtggcctgtcggctcccaaaactaacgattcggaaaccgacatgtttaactgtatcaagccctggatcagtagattgatacaggttcaacaatctggatcttcatcgcatacatttggtaaagactccaaaggagatatctttatataaaataataggacatttacaagtttgtggctaactattacagcagaggctatacgatgactcaactctgccgttttactatagaattaaaccatctaactacactagacttgaagattaggtttaaagggaactaacttatgtgattgaactcccagcttcggcaaaaactccaattaaactctgaaaaagaggggttgaagcaagggtgagtacaacgtactcagcaagctattatattaaccaataatgaatatatgaaatggtaatatctgtgtagagctaggtttacttgcagaaagctgagaataaagaggtagaaatcctgaaatgcttgatatgcaacagtatttaagaaaatcttgaattatatttctaaccaaagtaccatatgagtcccgatgctcaatccgtgagcacattcatactgcagtagatgtacgctttacccgcagtccacgacttgccaataatcattagcttagtcatggcccatattaggttattaacaattgtggcacctggttcatgaactcta

SEQ ID NO: 89451 - DNA, 2183 bp, Oryza sativa
gttcaaggacaaaaattggaggatttcttggaccataattcataataataaaaatggtttttaaactaaatttgaataaaagagttttagtcgaaagaaggtttaatatttgaaaatagaatttcaacaagaaataccaaatatgtttttaaatgaaaaacacaaaagggattaaataccagagaggttttatgcgagttagttttaggagctccctctaattatattttcctaggtttagaaggttattaagaacataagaatcagcatgatgcaagattagaaaatgacacattttcagaatgttacatggccatacttcttcctctctttttagtgagtggaagttgagtagttttatttggtacctccactctttctggcgcattctgagcgggaatgaaagatttagtcacacctttataattggtaaatgcatctggcaggttatttgcaagtctttgcaaatgtataattttctgaacttgaagttcagtttcagtagtacgtgggtctgaggctggaataccctgggcatcccaatcaatttcctggcattctttctggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggcccatagctgtacgctgtggtggtgagatcgatatgtatacagcacaaccgaacttacgcaaatgggaaatacttggaggatttccacgtactaactgcattggggaagtttcatgatatgcagttggtcgtagttggacaaggtcagcagcgtgcagaactgcatgaccctaacacgacgaaggtaatttgcaattcatcaataatggtcgagcaataagcttaattcttttgatcaatgattcagacaaaccattttgtgtgtggacatatggaacagagtgctgaacctgaattcccaatgccatacaataatcatcgaaagcatgagatgtaaattcggcagcgttgtctatacggattgattgaatcctatgttcagggtaatttgccttcagccttataatttgagacattaatttggcaaaggcatggtttcgtgtcgatagaagacacacatgagaccatctagtagatgcgtcaatcaaaaccataaagtacctgaacggtccatatcttggcacaatagggccacatttatctccttgaatgcgttcaaggaatttaagtggttcggctctgattttgagataagatggtctcaaaatcagtttcccagtagcacatgcagtgcatacaaaatcagaggatttggaaaatttgtcagtgatcaaatgatgaccaatagagttgccaataatttttctcatcatcccgataccggggtgcccaagtcgatcatgccaagtgtggaatgcatcaacattttgaaaaattactttatacgcaacatgtgcaatgggtttaatgtatgtatagtacaatcccgatttgagagatggaattttctcgcaaatgcatttgccatatccgttttgtttggttaagagaagaaattcttctcgattatccatatgggtttcaatgtgaaacccattttgatggatatctctataacttagtagggtacgggttgaatcaggatacaataaagcatcctcgattataatttgtgtacccattgggagtgtaataattgctcgtccggagccaactatcacagtatcgcgcccagcgatagtcaaaactttgccttctctctttttgagagtttgaaaatatttgatctccctaagtatagagtttgtggtaccactgtccacaagacataattcctctccaatcggagcgatatccttagacatctataatgaaagaagaattgcttgattaagaattctttatccaatatatatacatacatacaataattaaaacatcaaatacatagtatgacgtttacatatgttaaaagtacatactctaatgactagcaagccatacaactttacaatataagggagttcgtacttatctacttattacaaccaatactgtttggcaaacttataggatatcaatatactgtttcaagcacactgagataagagcagctgatctcc

SEQ ID NO: 89452 - DNA, 1401 bp, Oryza sativa
ccggtcggtgaagacgtagacgcccaacaacggcggcataaaggccagccgtgcaggcggaaacaccagtcggcggcggtcgaggcggccggtcggtgaagacgtagacgcccaacaacggcggcgtaataggccagccgtgcaggcggaaacaccagtcggcggcggcgaaggcaagccggtcggtgaagacgtagacgcccaacaacggcggcataataggccagccgtgcaggaggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatacgagtgacatgagttcgccattaatggaacaaagtttcacgaatcagaatttactactcgggtacttttgcaattattaagagcagaaaataaatttatcttatctctatgcttttgatttattccgaataatacttagcaccttgcgttactcggtccatccaatcgagcccccgggtgctaggaatcggcccaaaggcaaccatccattggcacaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccgctaatggcggcataataggtcagtcgtgtaagcggaaacaccagtcgacggcagcgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggatgcaggccggcggtgaagtcgtagacgcccaacagcggcg

SEQ ID NO: 89453 - DNA, 1471 bp, Oryza sativa
agcaggtacgacacgtcatgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcattactactagtacaacaatagtcggaggtactcactacaacaacattgaattgaaattacacgatagaagtatttagtccgaacactcattacatcacaacagcattttatttcctaaatcgaaagcattgttacaccatggaatcgcctgatgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaaggacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctctgtgcctttttgattttatcttccatgtactttgtcactacgttgccaaacactatgttgttatcggccatggacggaccaattttcttgtatcgatccctaaagtacgcttgcgtaccgtgaaggatgaattc

SEQ ID NO: 89454 - DNA, 696 bp, Oryza sativa
caccagtcggcggcggcgaaggcaagccggtcggtgaagacgtaaacgcccaacagcggcggcataaaggccagccgtgcaggcggaaacaacagtcggcggcgacgaaggcaagccggtcggtgaagacgtagacgcccaatcaacggcggcataaaggccagccgtgcaggcggaaacaccagtcggcggcggtcgaggcggccggtcggtgaagacgtagacgcccaacaacggcggcgtaataggccagccgtgcaggcggaaacaccagtcggcggcggcgaaggcaagccggtcggtgaagacgtagacgcccaacaacggcggcgtaaaggccagccgtgcaggcggaagcaccagtcggcggcggacgaggcggccggtcggtgaagacgtagacgcccaatcaacggcggcataaaggccagccgtgcaggcggaaacaccagtcggcggcggtcgaggcggccggtcggtgaagacgtagacgcccaacaacggcggcataaaggccagccgtgcaggcggaaacaccagtcggcggcggtcgaggcggccggtcggtgaagacgtagacgcccaacaacggcggcgtaaaggccagccgtgcaggcggaagcaccagtcggcggcggtcgaggcggccggtcggtgaagacgtagacgcccaacaacggcggcataaaggccagc

SEQ ID NO: 89455 - DNA, 1688 bp, Oryza sativa
atagtttttagaagctcttgattattatcatccactcggaagacatccttgaggtcaccacaacacacgatctcaagggtttccaacgcacagtatgcataggaaggactgttgtcatataagggaagcacatatatcaacctggggcagcaatttaggtgtagcactttcaaccagaatgacgaatctgcaggctcaaaatgtatctggcccgttgtgctccagtcccagatgtggcgcgcccttgctagttgggatgcccagaatgtctttaggtaccagaaaatgctgttactaccagtactaggtggagtgaatacaacgccttcaatgttagggcatctctccactctgcaccactctaggttataccatctccgtgcctcatttgaatggcttgtgatacttgcgacagacaagctgtcatgcacgtgcaggcctgaagctctttcacagatggaacctggcaaagatggcgacgacaatggtttcgtctgcatcctcttatcatcttgtaagctaatgtagtgagaggtgctgccctccgatttacatggccacatccagttgccgttcatggttgcttgtagttgcaagtgctggatcgtggagtcgacatccgcatataacttcttgtggtcagcagttggtcgtcggcttttggttgacatcaaccaacgttgttcagccctgctaatggcaatgggccttctcttgcttattgttccgcctaattcagaactatcagtagtagcagtagcaacactagcaggaggggatgagatctcgatgcatggtgcatccaagggatatttcgtatcatttagcgagcgaaggagtcttctgtccctcactgaaatataccatttaaattcaacgggtgagaatgatgatgattcaactacacctgtagcatgaccaagttcagtgctactagtgtcgatgtgcagaacctccaatgatacatcttgttttggccatagtattgcacgaagctccttgcatccaagcagtaggagctccttgagagaccagttgcctcgcattgaacgtaggtcgagggttttaatacaagtgcctgagacgtcgagttgcttgagcctctcaaacactcctctcaaaagcacactcttcaactgggtgcatcctcggaaggagatgctctctatcttggctgtgacatcaacatcattgtcattgctgctgctagagaagctaaatgactcgagtgatggcggtaggtcatgagggtcaattcgcgtcaactcaaaacaaccatccagaatgattgtcttgatgattttgcagctagacaggttcgggaataatgttactgctacttgatcttgctgcaatacttgtgactgatgttgaacttcagttattggttcggtcgcgacttggagcttgacaaggttgagtagcccaaggggcttggtgctgcttccgacaccagtactagaattgttgtcatcacggagtagatggcttatgctccaatgcttgacccccttcacatttagctccctaagctcaaccattagatcttgtgcctctactgatagcagccaataccagtctgtgtaactcaggtcaagcacccatagcttctggaaacatgctccactgctaatactagtctccttttcagtgtctccagcactagtactatttggtgatgagcctga

SEQ ID NO: 89456 - DNA, 2284 bp, Oryza sativa
ctttagcctttagttcctaaatcagttgaatttcatattctagtgatttgttgaattgacattgtctgagacaacacccgcacataaaaaaaacttgcttccttgtgctttcggaattgctgtggtacctaagcattccaacattcatattttataatgtttgaccatccatattccatagtccaacaatatatgtatttataatttaaaggtaccattatattcattgttgaaaatattttgattttcagtttatttatcaatacagaagttaatgagccatgcattgtaaacatcactagtaaatattttgattttcagtttatttatcattctaaggaaaaaagatgtccagaatacagaacattttgaaaatttgggccttttaggaagttttttaaatagttaggtcctattatgattgacagattctctcattaatttcactagaataattaattactgcagaaactgttataaaattatttatacaaaactgttgtacagcatcaatccttgttacaatatttgagaattcagacagccataaagtagtgatcttagaaaatctatagaccaccttaaaattttagtcagccaagagtaccttaaaatatgaaattccttttgtttgtttgctatgtatattcttaatcatttccttttttgtatcttacaggaatacttgcagtttgaaattgataaaaatgaattccacagaacttgtgaactctacgagagattgcttgatagaacaaaggatttgaaggtatggattagctatgctgagttttgaggcctcagttggtttgggtggggaagacagtcaaagtgaggagattaaaaatgaagttagttatcaacaacagcagatagagcaggttcgaaggtgccgaggtaaacagaatttggagaacaaatttactttgtccagttgagtacctctgttccttttgtcattcatagtgcaataaatctaacctcttctttattgcaattttcagctgtatttgaacgggcatttgaatacttcagaactagtgctccagagttaaaggaggaaagagcaatgctccttgaagaatggcttaataaggaggtgagctttggtcatctcggtgatgttaccttagtgcagaaaaaggcaccaaggaaagtgaagagaaagagaccagatccttcagaggatggctccactactgcgtatgtgccttactcaattatttcattcttctatagtttctctaacaagtttcattttactctgtgctatctgcccttaaaaggaggttaagaaatttggtataacaaaaggagacaataaatagttttgactcctaatctgttcgcatagcttgttttccatttaggctgcctgcaatttagggaacaaatgtgctgataaaacattttcctaaaccttagtaggtatgaggagtacatggattatattttccctgatgaggttgcgctggcaccaaacctcaagatcctcgaagcggcctataagtggaagaagcagaagacagatgatactgatgatgactgatataaacagcaaaggctgccttgatgccactgtttctgtggtcagagatgagctgatccttgtcaaaatcagatctgaaggacttccacaatgctgggtaaagttgtgaatgtgccctgccttattgctcaacttgtacaatattatgtggtttgtggccccggcattgatgaattgagtcatctgtcatgctcatactctttcattttagttttgatatgcacgatcatgtcgcttgccttaatatcttttacatctagggaggcaactatgtagcagtcatattttcctaggaatggtgcatgttgtgtatggaatctgtaaggtgctgtacataccagtccgatggattttgtgaaaacttatgtcacactggtgatatccaattttggtgaacaagataagtgaattgagggcaactcgtgcagtcacaggtgtgtcatgtctcttatttttagagttctgaagtggagctcctcgtgactcgtcgacagcaagatgggctcagatctcgttctctgcgggaataagttcacattaggtccctctatatgtcgcccagtccggctttcatcccagcaaaaccgggtatgactccgtgcaaaaaaaaggtcgctcggcagtattgtgcctggttttggatgacgtgacgcctacgtggctccctttgactaggtcctcgtccaacgtggcgcttatgtgacaaatgagtcctggaaaaaaaagggatccact

SEQ ID NO: 89457 - DNA, 2037 bp, Oryza sativa
atttactgaagttgcaaacggaactcaattaaagatgtatgtgtagccaatgagacacagtctccagtcgatgagtttgatgatactttatatgcacaagatatgctaaatttgccacaaaatgttggccatactaggtctacaaaggcaggcgattcatttctaaccaatctcattaaaaggagcttcaaaatgaacaatggaacacgcaatggaagagcaaggatttttgttaatggctttcctatctctgaccgtgcagtcaggaaggctgagaagctagctggagaaatctgtcctggtgattactggtaaaattcctcaggctgcagagtgctaaactatgtttggtttatattttgattcctgcatttcagttatgcttcagtaatcttgaaaagaaacttaaatagtcgcctacattaatataacaaaattctattgtgtactttctttcttgtattgaatatttgagtatacaaaattttgatctgatgttctgttacttaggtatgattatcgtgctgggttctggggtgttatggggcgaccctgccttggcatgatacctgtaagaacacttgtcttggatattgttcatttcttcctgtatgctatcctatcgataaaatctctaagttgttttttttccttgcagccttatattccagagttcaattatcctatgcccaagaactgtggtggtggaaacaccggcatatttattaatgggagagaacttcatcagaaggatttggatctacttgtgtctcgaggactgtctgattcccctggcagatcttatatagttgaaaattctgggaaagtttcagatgaagtttctggtgaagagctttatggccttggcaagcttgcaccgacgtaagtatctctttaaattctaatcattttaaattctgcaaaagcaaattaatctagattatttcggtagtcaaggctagctcctgaactgcagttaatatgacagatgctattgctataatcttgtttgcgatgcctcttaattcctgtggtgatacaacttaatcctggaccattttttttaacaacataggatcatataatctatttccaaggaacttattctacaaatccaatgacatcatggaaaatatgttaatggattgtgctcaccattagctcttttttagagtcatctatttggacacacagtgatgtatatgggttatatagattgttagattataatcataatgccatgttatgctacagctacacccatctgcccagtataatttctaaacctttcacaaaagaatacagcctaacaacagttgagttggtcagaagtaattgtgggcttgtggcactacatttttttaatttgatcaacattccctaaaatatgtccaggaatcagggtggtaaaaatagcaagatttgtaagtgttagaaggattgggaatcttgttgtgaagtaatgccctactacatttcatctttgcttattttttgtggccctattctttttttcatattaatatatactccctccgtttcacaatgtaagtcattctagcatttcccacattcatattgatattaatgaatctaagacatatatatccatctagattcattaacatccatatgaatgtgggaaatactagaatgacttatattgtgaaacggaggaagtacgtcattatggtgaactagtgaatagaaatgatagaaaagcattggcctcagatctataacgtgcctggtgtctagtgccaccaccagtaggcaattccaaaatcatagttatgcatagtttcagaaatccttttgcaaaaatatgtcatcaatatcagagctacattagtcgactatccttgcgactaaacaagtgttgtgaagataattcatttcatctccagttgcctttatgtactgcaaaatcctggtacacaggatactgaatctctgatactcttttcaaggattgaatttctgcattagtcttggaactacattatgttctttatttgttgaattggtgtggttttt

SEQ ID NO: 89458 - DNA, 805 bp, Oryza sativa
ggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccaatgaagttgaactggagattgaggccctccaacgatgccgacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgacc

SEQ ID NO: 89459 - DNA, 1327 bp, Oryza sativa
cagacaaggccggagacaccctggtcaccgacatgcgcgcaattcttgatgttcaccgactgcagcttcgcgcagcaccggccaatcgccttgaggccctcgtcagcaacaccggggcatgcctcgacggtcaccaccttcaagtccgggcaaccctgagcaattgcagcgaggcccttgtcggtgatcagcgggcagccggtgatgtcaagcctcgccagcgaggggcagccggcggcgatctcggcgaggccggcatcggttacctgagggacatgccacagggcgagcgagaggagcgacgggcagccgcgcgcggcggccgagatgccggcgtcggtgacgccgcgcgtcgggtggctcccacggatgacgaggctctcgaggcttccccggagcgcgtcggcgacggccaccgccatgaggccgacgtccgtggcctcgcgcccctcgaggcacctctcggaggagcagccgccgccaagggggacctcgaactcgtcctcctcctcctcgtcctcgtcgacgaacacctggttgaggtccggcaccgccgccgccgccggctctcgcttgatctccgacgagcggatgccgccgaggagagcgagccagcggcgggagacggccgcggaggcgcaccgggcgcgggcgcccttcacgcggcggaggatctcgaagaggcactcgtcggggagagcgtcgagcgacggcgcctcccgctgctgctgctgctgcttctgcctcttggccgccgtcaacccctcctcctccaccacctccaccgcctccgcggcggcggagacgaagccgcagggcggcacggcggtgacccgcgcccgcttccgcgacctgacgccgccgaacagagccgccgacgccgccggctccatcacaagaacaccaccatctgcacaaagcaaacccaaaaacacacatcagcatgaacccaaacccaaatccattaaaattcctcatcttgtttacctacctctgtaatcgtggaacggaggcatgccgacttcttcaagaacaaatcagaccaacaaatttggccccaaaaaacaacgcaagaatcaacaagagatgaggagaacgccgaacccaatcgccaggaggcgagaggggaaaaaagatcgcagatttagtgtgaggagatcaagggaggtggaggaggtgatggaggagagggaaggaagaagagggtgggtggtttttatgtgctttgggtagagaagaaggggggaagccaaagaatggagaggatgatgaggattcctgcccaacttgcacaagttgtgtgtgtgtgtgtggagggggggggttg

SEQ ID NO: 89460 - DNA, 1703 bp, Oryza sativa
agaaaatcaaattaacttcagattataatcgatagatcaaaggcttaaaaagttgtggtaggcaggtttcccttttcttttccatttctgccctggaaatacatataggattatatcacaagattaattgctctcatccttgagaacggctaagtgaagaagatccgacatacacgagagcatttcgacgttcacaagtcattccagtttcatggcagcaaaataaccagcttatttactactactacacaagaaacctatctatatccatgttacatacagactgcacaattggccgctatatggactatctacagttctatattaacaatactaccaaaacatctggtgcatgaaactagaatggtacactgatctactgaagaactgactcagctatgtggtacatgcagcgcctgcaagagcaacttcggtggacgggctaggagttgacaacctgaaaacctgaaaatcccactgatgcaggagttgcagctgcgttagcgccaggctagcatgtggctgtcctcagcagtgcggatttcgctgaaacttcaatcggtctccagattatgctttccatcttgttgcacaagttcttgtagaactgcaatgagtgtaaatctgagttagcaatcgttccggatggacgaaaagttggatgttgcaccttcgaatgagcattttgacacattgtgtgaaagttatcagtgtcagtcaggcagtgtcagtcatttttttagatttatgaactagtctaggcaatcatgctactatattcgattaggatacaagacgatatgtggaaagacagaccctgtggtattccagtgtgtcaccagcaacctttcgaacatcaaccatgaacagagaaggagcaacttcgaaaacctgcgaatgatgcatttcaaagcataagacagcatgaaaaatgtagtttgtgaatgacaaacagcaaaatgttgttccccaacaaagggcaatgtaagactacctgtagaacaacagcaaacgggctcattctgtttgaagatacaccttcaagacgcaactgcagaaaagagttagcaataagtatcattacatcaagagtaagaaatgagttgcttgttgaagaaaatgttttgtaattaccttgtaattctgagagtggaccttaagacccatagtctcagcaacaacttcaattgtagctactatagtctttgctggtttccttgagacaaaacgagtttgacgtttgacaaactcctacaaatataaaacccatcattattgcaacatgagcactccatgtgatgaaagttgcatcagacaacataagttattcatgaggactgcagttaatgcataaagcaaacaccaaagttattcatgacgtgtggcacactatgacgtatggtccacgtaaaataaaaaaatacatactaaacatgtctaggaagatctaatgtaagagcacaaacattgaaaagtgggttcttctttctgctatacgagaacattgcaactagaatgaatatatggttggtgtggtcaaatacttcacaaactaaacaggtgcaatttaaaccatggagattagctaagaagcaagcaatcagatgtttttttctccttttatgcagggtttccatttccattcaaatttggcaaaaaacagaagccgtctgccaccaaccagtacactaagcgataagaaa

SEQ ID NO: 89461 - DNA, 1171 bp, Oryza sativa
tgagtagaacgattatgtaggtgttcacatcaacaatttagggaaagaaagacttatgctgcacacattagtaatgaagccaataccttatcatacagtgttggaagatcatcttcctcaaaaggaaggtatccagccatcaaaacatagagaataacaccacatgaccaaacatctgctgcagatccatcataaccattgttgctaagcacctaaaacattgacacatggtaaagcgcatatcatatatgtactaaaaaaatgcccctaatcttgtctaaggaaatggcttgaaatgcccatatcacaattttatgaactagttcagacaattaaaatcacaatagcttgaacatggtgaaataagacagctagagatatttatttagtgatgatggcagaaatatgcataaaaatgaggtttagaaccctgaagagaactaaccaaccaaataactgcgagacaggtagagaaacaaagaaataggtaatctctttctagtctaacagacatttgtatcatacatacaaatatgatctataaagaaaatctaggaaaattgaattgcatcccgagtaactcgtctaattttgcagacatatttcttgcatgtagtgtagctaatcaattagctccttgccaaaaaaaaaacatttcgtacagttcaatttaccatgcattgagagatagagagagagagagcatcatacctcaggagcaacataatttggtgttccacaagttgtgtgaagaaggcctactccctgaaatccctcaaaaaagaaatcccaatcagaacacttctaggatagaaatacagcatcattaaaagcaattactgagcttactttctgggccaaagtgctaagtccaaaatcagaaactttcaagtttccacgtgagtcaagaagcaggttttcaggctacataacatgcccaaaaaaagggtaagcatgagatattgcacctagtgaataggacaaatgatagccaagtgtctcttatcagtaacggaccttcaaatctctatgatatactcctttgctatggcaataattgatggcatcaataagctgctggaagtacttccttgcttcattttcacgaagcttcccttggcgagcctacagatatttgatcgcataggttcatattttaagaaaatgcaca

SEQ ID NO: 89462 - DNA, 1530 bp, Oryza sativa
atgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaagaagagaattcctgctaaggtgatgtggtatttccctataataccaaggctaaggcgtttgttcaggaacaaggggaatgctagaatgatgcgatggcacgctgaagagcgtcaacaggacgggatgctgagacaccccgccgatggttcgcagtggtgaaacatcgacagaaaatttaaagactttggaaaggacgcacgaaacatacggtttggtttaagtacggatggcatgaatccttttggagagatgagcagcggccatagcacttggcccgttacgatgtgtatctacaacctccccccgtggctatgcatgaagaggaagtacataataatgccgcttataattcaaggcccaaagcaacctggtaacgacatcgatgtgtacctaagaccactggtcgaagatcttaaactgttgtggaagaaggaaggtgtccctgtgtgggatgaggacaaacaggaggagtttaacctacgagcgctgctgttcataaccatcaacgattggcctgcacttagcaacctatccgggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctcactaagaatcttgcgtaaaccttcttagcttcctaggtgtatatggaaagtcgaaagatacactggaagcacgtaatgatctgaagcatatggaacaacgcggtgaccttcacccggaaccaaaggagaaaggaagccattacttgagtccagccag

SEQ ID NO: 89463 - DNA, 2325 bp, Oryza sativa
ttttcaatataagacgcatctgcttgtcaccttgtcaaagagatcggtattctcggtccttgtacctgcacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactggccttcctggcgaggagaccatctggctcgatcgcgacattccagggatatgaaatcaatgggtacacattctacacgagggcccaagacatgaagagcacgaaccagaacagtgctgttcgtatcgatgccatgggacacgatggtacaactggcacgtattacagtgccatcgaggatatatgggaacttgactatggacctctcaaggtccctctgttccggtgccaatgggttaggttggctggtggaggcgtaacgattgatgacggtgggatgacaacagttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctctctctctatctcgatctcgatctctctctctctctcc

SEQ ID NO: 89464 - DNA, 3477 bp, Oryza sativa
atctttggctgctattgtgacttatatgttctaaactcatccaatttgttagtttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctcttctaaaacatcgtctctaaaaaaagaacaacgtgtgtacgtatcgacattgccatgatccaatcagtaaatataccataacataggttgtagttacactatgaagaaactcttctaactctatataataccttcaacaagctaggaagcaaataaacatgcatgccgccccaccattccaaggcggttcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcagcgaaataacgaccgctcttggaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccggagctaccaatgtcccaagcaattagagcattcacttcccttcaagttgtaccaattgccacatgacgacaatagtctttgattaatcaaaaccaatgaatcgaatatacaatttcagcatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctatgcaagtcattcacttggaaaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccatgattggaaaggaagaactcagagagaaagcattcgattgaatcacttgattgcattgaacacgaggaaaacaagcatcaaaagatccttgggaatttgcaagttccccttgtccatgtcctccatgaaccaatgcatccagcagaccattgttgtttggagagagatattctgatctcagggagccaaagtcaacctggtcaataggatgtcctaaggggtcgtgatatgaccatgcattattattgttaaagtcatagttgggatattggagtgaagggagctctacattcatgggcctctgtatggtcccagaagtagagaagttgccatcaagaattggatgtccactgacaatggcactaccaaaaggtactgactgatcttgtgtggcaatggcactaccaaatggacttgtggcatcaactggaagagaatttggagtcacacaatttggccgaatataattttctggtctactatagtctaaattatcgaaaaaaacctctttgtaactttgaccatttccctgtaaaacctcatttgttcgtttcttggcacgtgattcatcagggctttcacagttcatcacttccagatctgtcaacttaaaatgattaaactccttcggatatagaggttcaccagttctctgaattctcttacatctagtgttccagaagttcttgatttcattatctgtgcggcctggcaactgcaataacaacaacagaagttcagatatgcaagttaacatatgatctaataggatttttctaggcaattagactaaagaaccttaaggcattagcctaataagcatttgcattgtacctcagatgttagaatggcaaatatagcaagatgtatcatggtgttgcaatagttggagaggatttaaacatacctaacgaaacagtgaatgatattgtctttacataaatgaaaatatgatgaagtcctattcgatgaacaaaactcataggatttcagtaggaggcaggaaaggaac

SEQ ID NO: 89465 - DNA, 627 bp, Oryza sativa
ccaattaaatgaataaaataaagtctttcgccaatacagaagaaaatactggttgatgtactctgaatacatctatctacgagcaagtggtatatttgcggcccctatatttggagtggacagcatgcattctccccactaggcaaactgttggtaggctttaatttaggtggttaaatatttttgctctaatccaactaatacaccaatgcacctaaatattaagcatgctactaatctaaactaacaatgaacggagtatcaatgcacaagctagcaaaaccaaggaaccatgaaagagtaggaggaggagcacacttacagagtttgccatcttagcccacttgttccccagccataaatggagcttgatgatcatctcctcctcttccttgctgaagggccccttcttgaggtcgggcttgaggtggttcgcccagcggaggcggcagctcttgccgcagcggttcagccccgcgttcctctgcacccggttccagttcccctcgccgtgcgcctccacgtactcccgcagccgcttgtcctcgtcgggcgtccacggccccttcttcagcggaatcctgccacgcacgcgcacacggccgccgccgccgcggcgacgaaccc

SEQ ID NO: 89466 - DNA, 500 bp, Oryza sativa
ccttctctctctcaacaacaatgatagtgctaacggaatatggcgtggcggcaatatagagaaataattcttcattaggttgaggggcaacaagtacatgtggatttgataggtagcgcttgaatgcaatgaatgcctcttcggcctcctgtgtccatacaaatttgtcttgttttttcagcagagcgaagaaaggttgtcctcgctctcccatcctagcgacgaacctgcttagtgctgccatgcatccggttagcttctgtacttccttgagtcttgtaggcgacctcatgttctcgattaccatgatcttctcgggatttgcttctattcctctgccggagacgaggaagccgagtagcttgctgtcacgcccggaatttctatccaaaattccaaacgcttacatgtgtgtgaaccctcgtccaggaatcagccgaggcacacaataacaaattgataatagagtacaattaatactctaatttaaacgaataaaa

SEQ ID NO: 89467 - DNA, 3454 bp, Oryza sativa
gcggtctccgacggcggcgaagcaacggacgaggacggcggcgacttggcgatcccgacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagataaggtcgaggagatcccggagatcatttcccctctattgattcggccggaaacggaaagggacggccggatttggaaaggaacggcggcggcggcggctaggggtttcgggcggaggccgacgcgaggaagacgacgacctgacaggtgggacccacctgtcagcgaccgaacgcgcgcgcgcggctgcggactgggtcggctgggccgaggagagagaaaagagaggtttttgagccgactttcggcccaaagccaaaagaagatttttaaaacctttttcaatttaaattattttttaaatgcaattccatttattaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctgggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgcccgttgttgtctcggcgccgatctccatcatcg

SEQ ID NO: 89468 - DNA, 2709 bp, Oryza sativa
agtgattgggatagatcggtcaccatgccgagacagtataaatcacttagatcgaaatatataataacaatgagattatagatgttcatagcatagccgattagatagatctagcatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccgccataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcggggtctatttatacccgagattacaaaatatgtccatgtcggacacgactctcatctctaacaaactctaagataccataagtctttgcggcagacttttgcccaaacttatctctaaggaaattacatgaaataccctaattaatagatacaattaccttttcaggactcaatccatgcatggcaatcctcatgaagcacattaactcaacccgacaacgtgtaccgaatcacattgtcggaatcggcttaatcggcaaccttgtccgactcgaactctaccgatcctgatcgtagccgattcggacttcagccgattcttgctccgcttctggaacgatctccatcttggattccgcttcgattttatcttcatctccgatacctaaataaccaaatttggtcgttaacaatatgcaacaattttccctccaacatcaacttagacttgccaatcttcttcccaagttcagtgattaccttgtcattcgtggtacaattatcaagagtcaaggttgagatcttctcatcaagattccattccaccaatgcttcataaagttgttcacatataacttcagttgtgtgtggagcaggcacatatatgaacctatacaatcaaagttaaacctagattaaattcagattgatgcaaaaatgaaatctaatgtcatgctgaattaaatatgtagcagtaggaaatgaaattaattgttcatcaagtacctcatgataatgcttctaagtgtccaagaatcatcaatgaaatgggctgtgacagccatgtaccctcttttttggttatcagatgtccacaagtctgtagtaatagccactcttgacttagttccagccatgtaggctagggctttcttattttcttccatgtaatagtccataatgtccttcctaaaaatgcataaatgttaattttttcttcttaattgcagatatttttaatagacaactgaaactaatagatatcattattacctaatagtgtttcgagtcaccatcttaaataatggctgaagtgcagtcacaaacctttgaaatccaatatgatcaacaatagataaaggatactcatgtagtacaatcatggcagcaagctctctcctagctatttgtggatcaaatgtgtacttctccacagatatttttcctccctcctgggaattgaaccttaaagaagactgtgcaagtgtcttgttttgtcccgccatcttgatctttttcaatgtgcaaattttcaaatggtcatggagatgtcttgttccattactgcttttccctccaagccgcttgtggcaatgaaggcattgagccttgactttaccacagatttttactttcttgaaatccttccaaacgatagaagtaagcttcctcttggtgccaaagtccacatcctcctcctcagcctcatcttcatcatcatcaccttgtattggctgagaatcattaacactctcatcgtgaggtggaagtgattgcgagtcttgctggcttctattcgcactacccgcagttgacttcgatgtgaatctgagaagagagaaataaattcagttcaaaatttattcaatggcctagtaacatactgaaatccctttacaaagctgtgaaagcaaatttaaagttcagaccatgttgacgcatacctgcatagcactataaatcaccaaacaataatgcatgtacataagtataaatatagaaaatatataacagtaacgtgcaaagaaatatcccttcaatttgcaaagaaaatatatgacagtaacatcaacaaatccatcatttagtacctaagagctgaaacattcagtacctaagtgcaatgcaatctcataagtcataaactccaacttacatattccaaattgttaaataaaagagctgaaacatataagaggggtagcgtgcttgaaatcgaaccccatggattttaatagacgaaggccgccggcaaaagatgacgtgtttagagtagtcggtgca

SEQ ID NO: 89469 - DNA, 964 bp, Oryza sativa
aagtcgacaatgcattcttaccttgtcctgataacctgtaaagggtaaacacatgttgcccccaaggctcctgatacagtcccacagcccagttgtactagaggaccaggatctacacaaccatgataaaattcaagaatcaagaaacggagttgaaaagcaaaagggtaggaaacagaaacagtttctgaatggaggctcaccactatccttcaggatatatgtcttggatacgtctttcaatgtctcatatacagcaagatcaattccggcataagggacaataccaagcaaagatggaaccagacctctatagaatgctcgaggaccctcgtgcatcaatatatcccttgacaatgcaccaagactaggtactttaccatccacacatgaataagtctgcagtcgtgttttcactaaatctacgggataaattgctgtttgtgctactgcaccagccaaaccaccagctacaagacgttcagaaggaccaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgca

SEQ ID NO: 89470 - DNA, 630 bp, Oryza sativa
gtccttaattaattccaaccatctcctttgtctcatgttcagatccggctgggtaaagatatactttaaactcttgtgatcggtatatacctccgttcgagtaccgaaaaggtaatgatgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcacaatacacttggaaacccttctttggatcaggcaaaatcaagataggagccgatactaaacgattcttcaactcttgaaaactctgctcacattcttccgaccacttgtacttcacatctttctgaagcagtcgtgtcataggcttagcaatcttggaaaaattctctataaaccttcgataatatcctgcgaggcctaggaaactgcgaatctctgaaactgtctttggttgcttccaattggttacggattccacattactaggatcgacggcaactcctcctgctgagatgacgtgaccaaggaacttcacttcagacaaccaaaattcacacttgctaaacttagcatacaaccgatg

SEQ ID NO: 89471 - DNA, 562 bp, Oryza sativa
tgttggtcgaattttcagggtgttacagaatgtacggctggggatcctaggaccgatgtgcggccatacgttcatccaccttccttgccacctcctcttgcatgctgagctcgtagctcgataccctgtactcaagatctgcaatcttcgcctcggtatctctcttgctcctcatccgactcctgtatgtgtggatgtcctccttaaatccaatcttccagggaatcacgcctttccctcgtgttcgtcttggatgctcgggagtctatagggcgagtgacagctcatccttctctctgtcgggtcggaatctctctctgtcgggtcggaatgttccctgagaagaggctaccactgcgtccgttagtcgactggcagcctcgcgtatctgatcgctgaagacaagggagccatcaactgggttaagcgttccaccgtgagcatagtaccagaacttcgatcgttccagccaattagcggtggccggttcgatacccctctcaagcaagctagcctccatctcctcccacttcggcatcgcgacgctatatccgcctgaccc

SEQ ID NO: 89472 - DNA, 533 bp, Oryza sativa
ctggccttctgcggtggtgcttctcccttcaatgcggctagttccttctccaaacgatccaccttgtcttctagcttgcaaatcttaccacgattccgatcttcacgatcttgagccgctaacacagtctccgcacgactttcatccatagcccacagcatctcaaccaaatgccttgtggtagcatcattctcaattccttcagtctcaaggtagctgccacggtcacttccctggggttgacgaggatgatagcgatactcagtatcggccaactgatcactgtaacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaggggcagtcccaaatccaatgacataggacattgtacgcactcctggacagaccctcaacaccaacaagtactca

SEQ ID NO: 89473 - DNA, 735 bp, Oryza sativa
ggtcacatgccgccggtcggacattagtcggaaaagctttccaacaagggtttttctggccaaacgccctcaaagacgcctgcgacatggttcaacagtgtgaagcctgtcaattccacagtaaacacacaaagctgccagcgcaagcactccagactatccctttcacttggccgttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagcacacgagtacagaagtattccgatgaggatcaggaagagcagcgatacgacga

SEQ ID NO: 89474 - DNA, 1623 bp, Oryza sativa
ccctggcgagatgcatcacaataaacctggaagtctttagtctgatctggcaaaatcaaaacaggtgcagataccaaccgcgtcgtttgagttcttcaaaactcttgtagcattcagcagtccagataaacttttcttccttcttcaatagctgggtcattggcttggcaatttagaagttctcaatgaaccggcggtaatagcccacaagttctaagaaactccgaacctgagtaactgtccctggtggggtccacttggtaactgactccacatttgctggatccagagccactccttgggcattcacaacatgaccgagaaactgaacttccttcagccagaagtcacacttactgaacttggcatacagttggtgctcctataacttttcaagtaccagccgaagatgctgctcatgttgttccttggacttggaatagataagtatgtacatacgatgaaaaccacgacgaacttgtccagacattccataaacaccttgttcatcaaattcatgaagaaggcaggtgcgttggtgggtccgaaagacataattgtgcactcgaacaacccgtaacgagtgatgaatgctgtctttggaatatcctcctcgcggatcctcaactggtgatagcctgatcgcaggtctatcttagagaacatagtagctcctttcaactgatcaaacagatcatcaatccttggcaaagggtacttgttcttaatagtgacctcattgagcgtgcggtagtcaacacacatcctcttggttttgtctttcttttccacaaagattaccggaacaccccaaggcgacgtgctcgggcggatgtatcccttctatagctgttcatcaacttgcttcttgacttccaactcgttggctcccattctaaacggcctcttgtggatcggtgcagttccaggtgccaagtcaatccggaactcgatatccctttttggtggcattgttgtcatatcctccggaaaaacctctcgatactctctgactatgggaatatcctccaatttcttagtggttttctccattgctacctcttcttcttcaccggtggcctggttcagactgatccctggcttctgcggtactggagaatggaaggttaccacttctcctttcgccattggtcaacttgatggtgcggctagtgcaatcaatcactcctctgtgccttgtcaaccaatccattccaagtatgatatctaggtccttggattcgagaagaatgaggttggctggaaaaatcaacccttggatttcaactgtcactgatgggcagtagtgagttgtggtcatgccacctccaggagtatgaactcgcataggtatcttaagcttcactaaatataacctatgtgcaccagcaaaacgcttggaaatgaaggaatgagttgcaccagaatcaaacaatattgttgccggtatcgagttgacaggatatgcgcccaatatgacctctggtgctgaccgtgcctcctctgtagacgcatgattgagacgggcctgaacaagcttgggtccagcacgtcttggcttcgggcacttaccaaccatgtgtccaggtttgttacaattgaagtagagttcgggcttttctc

SEQ ID NO: 89475 - DNA, 2149 bp, Oryza sativa
gaccggaatgatcccacgaaaccacgggcattgtctgggctttcaccataccttcattttgggcacatttcggcacagcggtgtgcgctcgaggcaaagaaatgccgacatcttagtcccaaggtgctgttctttaactgatttgttatgattaaaagagttatgatcctcttgcaatgtaataaattgttagatggcattgtttttctttaccgtgaactggctagaattcttagtgatgttgtttacctaatagatgtttgaagtaacatgtgttctgaaacagtccgtcgatgctttcttggaggaattggttgtaaggagggaattagctgacaacttctgctattaccaacctcaatatgattcgctgtctggtgcatgggaatgggcaaggaagacactgatggatcatgctgctgataaaagagagcatatctatacgtgagtaagttgccctttataatttattgtcacaattttaaccaaattatcttcctgacgatgttaaggtaaaagatcttcgctctaattggttatttgttaattgtcattttgttttggctaggagggaacagcttgagaatgccaaaacacatgatcctgtaagtgctattggacgtggtgtactctgttgctgatattgaagttactctaacacactgagttattttttttctaaatgattatcagttgtggaatgcatcgcagttggagatggttcaccatggaaaaatgcatggattcatgaggtaatatatcatgaccagactcttacaaaatcacgcaagtataaaatgtttattgaacagttttttttttatgaaactgcttgttatatttcttctgtacccatggcacattctagttagttgcccataacctattggcccacttgttgacaacatatggttattttacccatcatactgatggtgtggtgctaacctaaaggcattggattgcccccaccccatctttgctgacataactgattagtttgctttgttggatagatgggaattttctgacgttgtggtttactttatcctatgtcagaaaatatgaagttatttgaaaaaaagcattccttaaaaaattagttttctgtagagtttgtgtagttccaataaatttatgatgatctatgtgatatgtctggtagcaagcctttggtgcacataattctctttgattctgggcaaaccttttacactatttttgttcaacttttgttttggatctggaaagaaagaaaagtaagttgttttggcgaacatcaaagaatgatgttatatctaattgattcttagttctgaaggtaacagtgcctgtaaggactttttcctttcctaatgtagtagttgtctgtagaatgtactgggccaaaaagattctagaatggactagtggaccagaagaagcactttcaactgcaatttatttaaatgacaaggtaagacctatacacatgtttgggaaatacagttgtgttattttgaatttgtcctttttatagttttgctagttgtagttaaaatagctatatttcaacacatggaacatgataaagaaacatggaacatgataaagaaactgctcacatgaaaaattgtaattgaatagcaacttggaagagtctgcccatgcttaaattagttcctgcgccgataaccgaaaagttggagtcacatttatcaaattaagaaatatataatttgacattcttttcatgtaaggcagaaaattgtatggttggtgctcttttcattatcttatcttcccttaagttaaaaacatcatccttctagggacaaccagacaataaatcagcttcacggtcgcctcggataagctggactatcctttttcttggttacctgtcagaagaaagatacaaaacagtaactggggaaataaattttcaggaatgtgaaattgctcgaagatattttcatagttgaacctacaattctttccccagctggattgttctcgttctttaataggagtagttgtttgcattgaagtacttctacggattttatttatgcttttcaacaaagtcttacaaatcaatcttgtggcagtatgagatagatggcagggaccccagtggttacgtcggatgtatgtggtccatatgtgg

SEQ ID NO: 89476 - DNA, 588 bp, Oryza sativa
caaggacggggtgatcaatcagccctgccacttaccgccttcgacaatcacactctcaggcttggtgtcatcgctcagttcttttcgcacatattggtcataaagcttgagcagaaacttctcctcccccaacttcgccagctcggcattcacccagtcgcgcaactcgatattgcccttcttcaccgccggggcaatcggcgcttcatcacccagcttctcttccagcacgcggtaacccgggttctgcttggcccagctgaacagcaccaggttgtcctgggcataggcatcaccacgcccggccgacagagcttgcagcgactcggagttcttctcgaacttgagcagcttccagtccggatggttcttggtcagccagatatccgccgtggtgccggtggtgacgatggtcgtgcgggttgccaggtcagccaggcttttgacggcgctgtcattcggcaccagagcctgcaccgcgactttcaggttggggttggtgaagtccaccgcgtccttgcgttcaggcgtcacggtcatgttggcgagaatcaggtcgaccttgtcgctttgcaggaagggggatcc

SEQ ID NO: 89477 - DNA, 642 bp, Oryza sativa
gataggaggatgctagggtcaatcgtcaccgtgaaagggggttgcccatcaaactgatcgtaatcctcgtcagtcttgtactctactccgatgatttttctttttcctgggagaaccacgtggcgcttcggctcgtcaggccctttgccctttcttcctttgctagacatgtccttgacgtaaaaaacttgcgttacatcattggcaaggacaaaaggttcgtccgagtatccaaccttgttaaggtcaaccgttgtcatcccactgtcatcaatcgttacgcctccaccagtcaacctaacccattggcaccggaacagagggaccttgagaggtccatagtcaagttcccatatgtcctcgatggcaccgtaatacgtgccagttgtaccatcgtgtcccatggcatcgatacgaacagcactgttctggctcgtgctcttcatgtcttgggctctcgtgtagaatgtgtacccattgatttcatatccctggaatgtcgcgatcgagctagatggtcccctcgccaggaaggccggttgttggttaatcgtctcgttacccatgagatgttgtcgcagccacgcggagaaagtatcaatgtgatactgtgtaatccatgcgtcggactggccgatgttt

SEQ ID NO: 89478 - DNA, 1596 bp, Oryza sativa
ccaagaagctgccagctgactgcgccccttcaacccgacctttattcactatgcgtccaagctcttggaaccaaaggtatgtatgagcattctgggaaggtcgcaagaagccggttttagaaggtttggagcaatcgcaatttatcatcatattattacccgtttcaattgatgactggctaatatataagtgttccatcacaaattatttttggttcctcaattacagcttattctttttttcgaggagaagggaatatattactcaactaaagagtcctcacaaacaaaatgtgagatgaaattacatttatcatccggtcaaaactcagtaagagattcacaccgggctctgttagctagagtatggctaacattattctgattttgctgaatcttcgcgatgatcacttccatgtttcctgataacagttcttctatgtccctgacaatgaatgcaagttcagagcgccctttcatcgcagattagatgaggttcttctccaccaaacaatcagtctccactataattggaaggagtgtccactgaagaaccaagttaataccttccctataggcaaggagttctgcctccaacggactgctgcaccggtcaagaaaaccacaagcaaaaaaaaaaaaattaccatccccatactgttctttgactactgaatcgagatccatatattatttgtttcatgctggacatgtggactcgagaatattatctccgggatcagatcagataataattttgtgcattttgccttatcgtgacttatatcttggacgtgcgtgctgtaaattgttaaactactacgagtcatggtgtttttttaagggtttgctgccagcttccacagatgatacggatcggatgctattaatatgttggaaactactaccgccgggcgcccgattgggggtgggaaaaaaactattttttctcttaaattatttatccaaatcatgatccgattgcaccattaaatttgttgcaattaaatatttaaaacaagactacacatggatatattccgatgaaaaaattagcttattattgaaatatttttaaatattgcacgttgttccaccaagtagatcagaattgtttcactgagtagatcgaaaatgtttcaatcgtttaaatcgagcgttgtttcaccttatataaaaataatatttcagcaaatagcgaaagaatgttttaagtccctgcaatatttgatccatacatagtgaaacattataagtacactaggtgaaacattttttgtggaacaaaaaataaaacgaattcccttaatagagggtttccataatatgtgggtgatttgttgcaaaagaatgttttaattcactgcagtattagatctatatatatatagtgaaaaattatgattacactaggtgaaactttttggtggaaaaaaaatgaaacgaattcccttaatagagggtttttaaaatatgtgggtgatttattaccctcctcccatccattccaaccgagcgaccgattgctgatggtccttatcgatcagtctcgaccgtcaatattactaaaattggagagaactggtgatgcctgca

SEQ ID NO: 89479 - DNA, 1977 bp, Oryza sativa
ttaattgtcataaacaactcagaatcatgtagatttcggacttggacatgaatgtctccgtctattttgtctttagaatgaaaaacattacttcctccatttcaaattacttgttttaactctatcctaagccaattttcttttattttgcttatctttcttatctgtggtatttatttgctaggcttttgtaatgctatcctggactcttagatttgaaggtacctcctcaggctgaactgtggagatcatgggtaccacatatccactcagcctacgtatccaattggaaataggaggtgggttggacccatagcattatgtaatggtcttgggcttgagaataatgttggcttgtatcatgcggcatagcccataggttttgttaggttatcatataatagattagaaaactgatgccgtgttcaaataggtttcttctctgtaaatctaccccgaacctatacaagtgagcaaggagctctccgaggacataaccataactcgatcgccaaatcaatacaacatccggcggatacaatcctcaaataggagtagggtattacctcattgagagtgcctgaacatgtctaaatccttatcttctttattcatccacttttagatctcgtgcgctgctcccttttgttattgccgatctctatttccaatttttcttttcttaaaatcatgtggataaggtttaaatgggcctttaagaacatatgctctccgaactgcatcttgatcattgacaagataacttacaatgggtagtctttcctcttgatcatgtggaaggctgtcaatgtcataaaccggcggcggtggtggtgagacatcttctcaacgtcttgttcctgagtgtgctcctataccacaactggggaagaaggcaatttagaactatttttctttgctgcatgtttcaacaattagcgatctacaatatagcggagagtggactcgtagtctcgtcacgctagccactcggcttcgcgagcggtggccggtgataggcgggtggcggcggcagccggcgctcgtggagtcgcagtcctccgtcctctgctcctctccacatggacttgctgttgcaaatgcgggtggcaggaggcagcgcgaaaaacgagtagtcaagtgaggagaggacgcgtagcaatcgtgtgatgctgcgcgcgacgtttcggtttccaattccaggttcatgcgctttttttctattattttttctatatatagttgggtcggttgccttattttttgtgtggtcccaccgggaccaccccacagattggtaaacctaggccgtctgttacaccactgcccagaggtggattaggccgaacgcacggcgttcccaagggctatgagcggatggcagcctagaaatccctaggggggggggacatagtggatcctgcccgctgacaggattagctagcatctgatctactcaacaatgtggtagtagcacagcaactagggcttagaccatcatgggtgtttgcacggttctcttggttttgtccctctatcatactatataaagggccgagggttccccatgaaggggttgaaaacatttgaagacagactctcgagttatgtaggaaaaatgatttgggtttgtatatccctagtttattcaatccaaaaaaaggaaatgtaggagtaggattgttatcctcagggaggcccgaaactgggtagaaacttgtgagttttgcatgatctagaggagagcaagcaaatcaaagcctcaaacccactccaccaaacactggtttcactagattttgtactgtcaggcacagttcgtcgacactgttgctgcactaattgtatcaagttgggaagaagttgtactcgtaatatgatttctgttggatgcaggtcagtgaacctttcgacctgcctgccgaagcaccaaggaaccagagaaccagcatggagcagagcaaagagaggataagc

SEQ ID NO: 89480 - DNA, 535 bp, Oryza sativa
tagaatggagattcaaagggcccgacggcggggggtttacgatactgggttcatcgaccctcggaaaatcaacaccgaaatgatcgacaagtacgagaaagacacggaggacaatctcgtccatctcctaacgcagcaacatttcaagacgttcatactactgccgtacaacacagagtgagtttttattgtcattcgaacaaatttcgttcccatacatatagcatgtacattttcatatatatctcatctcacgcatattccagattccactgggtcctgttattcttcgacttggacgcatgcagagtcactgtgtacgactcaatgaataaagaggagaagatttttgacaaggtcttccaactgatagacaggtaatataattccatctattccaaagtcgcggggattctattgctattatgttgatctcgggtaataattaattaatcgtagcttgcaactgcacatgtagggcttgggatcggttccgtcaattggtccgcatgacttggaaagaaaaacttggacg

SEQ ID NO: 89481 - DNA, 2103 bp, Oryza sativa
gctccgatccccatatcgcgagtcgcaagcagagcatgggagcggaggggaggggcgccgtcgtcccgctgcacaccggcccattcctcgcgctgtcctctcttggcccctccgtccgcgacgccgccccctccgcggccgggaagacgtcgccaccaccacctccatccgcgacgacgccacaacctccgtccgcaccgaccccacgctgcgcacgccgccgatccttcgtccacgcgctgccgccgccgctgtcgctgcctccaccgccgtccgcgtcgaccccacgctacccatgctggcggcctgctgccccacatcgtgttaacaccgggatcaggtttctggccatcgtctccacgcagatatgggagttgtgaatttccctcttttatctttcttggtttttctgctctcagttctaataggcctacagattgtctgaatccatttgaacaaggttctgcacaaatcttctgatagaattctgattttcacaaaattaatcgtggtggtattttacgcatgtggcaatttaattaccaaaataataactatttctatcagtctttatgtttaggtaacctgcccaagtaaattgtattaactgattgatgtttgttgttcctggtgatgattctcttctgtttcatgtggtctgcagtgcatggacagtgtttacaaggtagccctatactcctatattcatcacaacatagtagatagtacaaacgaggtgcgtatccatttgctttaattcacatagaaaactccctacaattgaaattcactaataaggtgcatattttgttctcagccacatcaccgtctgtttccgccatggcagcgtgactccgcccgacggctggaggaggcgaggtcaggcctgccctcaatcgacgctccacgccaccgcagcccgcagccccatcggcgccatcgctgcgtcgctccatcgccatcccgacctcgaagttgaaccggcttcgagtccctcgtgctgccactgatcccagggctcctcaaccctgcaagccatcgatcctgcctgcgaacaagataagagtgcttctcgatcccgttcctgtacgaggaggcatacggggcatggtatgtttcatccatagagatgcataatgcctttatctcctttgttgactaaatccccattgttcattattaaacattgttcattgtgcatggatatttgtgatgcaaaactctactccaaaatctgaagtccttagtggtttactgtacctgacaagcaaacatctcaaacatgtttgtaaaatcctctcgaaagtagagtaccacgttcctcaaccctgttcaccgagataagtattgtttaatgatgctaatgtatggtatgttaagctgatatttgatgctactgaaatatgtaacatatggacatgaatgttcacttcttttttatgtaaaatgtatattacctcattaatatgagtgctttcaaacctgacaccatcttaattggaatatttgattatgagaaaacccttataatttatctccactgttcttgagagttagaaaaatctttcaatacattttagtagttttagatgctaaaaattccagaagttgaaggcttatccatgcagttttagatttggttggatggaatttggattcattgaacattcttaaactatggctcttttaccatcaaaactttacattttccatatcgtcttcgactgcttgtagacaaacaactacagaagaatatctcatgctttttatgaaaccagctaatgcgacagtgtcgaggggggtcttggccggatccgttgctcatggccggtaggagtgaggagtacacaggcttccacactacgaggtaatctgcgtgcatgattcatgtgtctgttggtttctctatctaaatgatagttcattttggtatacctccatcattccaggaaacttcaatgctcgagttgtcgagctaggttggggatatttgattctttaatctgtatagggtttggtagcgtgcactcagcccttaggacttaacatgacagtaagtgagaaaaagggaaaacagtgagtttttgcatcaggctggctcaa

SEQ ID NO: 89482 - DNA, 1415 bp, Oryza sativa
ggtcggtcggatttagacgaaggtaatgggaggaggaagcctagcgatagctggcagcaataacagggcgatacgacattgatagttctacctcgaccacgtgtggttgagtaggtggatagtgtactggaattagaagaggggatacttgtcggagtgtaggagggggtgacgatgattgatccaatgaaaacccttcaaacaaaggttaggagatatgggtcggaaagtgggtagttgagaagtaggagtatgaagatggctagccagtgggagagcacactagtggggcccaatgagtagatgggtggcggtactcagggtcaggtcgggaagggtgacggtggtgcacatatgtgtgtgtggctgcacatcgtttggatctgtttggagacaggggaggagggtgtatatacgaagttcgaagtgatcgtaatttacaaataaataaggtgcgattgacaaataaccaacccttatttatctttttcaattcctaaaacatcttaaatgttgtgatgtagaagcaggattagttttcattatctgaaggattatgttttgttattaactgtcaccaccgtttcatagtatatctattatgtaggacttgtttgctgctgggagtgacacaagctctagcacaatagaatgggcaatggtggaattgcttaaaaacacattatcaatgggtaaagcctgtgatgagcttgcccaggttgttggatcaagaagaagaattgaagagtctgaaattggtcaattgccatatttgcaagctgtcataaaagagacattgagattacatccaccggttccactgttaccacatcgagctaagatggcgatgcaaataatgggttatacaatacctaatggtacaaaaatattgataaatgtgtgggccataggtagagataaaaacatttggacagaacctgagaagttcatgccagagagattccttgatagaacaattgacttcagaggtggagatttagagctcatcccatttggtgcaggccgtcgaatctgccctggaatgccattagctatttggatggtgcatgtggttcttgcatcactattaattcatttcaaatggagactaccggttgaggtggaaagaaatggaattgatatgacagagaagtttggattgactctagtaaaagctattccgctatgtgctttggccacaccaacttaagtcaacgagccactgtttgagttagaataatggactgctctttgtcaactcaagcattgtatcatgcacggtattattgatgtgaaaataaaaatacatcatcaatgaaatttgtgggtatttactacttcccaatgtttatcaatagtcctgagaaaattacacagcatatatttgtattagaataaaccctcgtggggaaaaa

SEQ ID NO: 89483 - DNA, 4051 bp, Oryza sativa
gggggctgtaagagtagataaggaagaagatttatagaacgatttttctaggcggaccacgtattttttcgcctgtaaaaatataatttttgtaggcggaccacttgtaaaaattgtttttcgagcgccgacgaatgacgacttaagtggtccacctgcaaaaattgattttcgtaggtggatgatgaaaacccaccctggtttatatttttataggcagatatttggcttcgagagtcatacccgcctggaaaaataaaaggctaacatcgctaaaaatcatttttctagtagagcgggaaatgcagcaatcaagaacacaccacacccaaatcaagaactaatgagatggtttaggacgtgtgacggcagcggcgaatcaataactcatccccacccaaccaagaaaaaaagctcattccccatctgatcaagaactcactaatcctcacccaaatcaagcactcaccagatcgagcaggatatgaggaggacgatgacgaattgcggcgacgaagggaaagggagaaaagaagaaaaccctaaccctagctttggaagaggaggagagaagggaaaaggctgcgtgctcactagagagaagatggtggccggaggagagcgccgtgccgtcaccgtcgcctcgcgtcgcgccgctcccgccgttgtgccacctcgaattgcctccgcgtcgtgctgccactgcgcgtgttgcacgtcgcctcccggctcccgtcgtgaggaatttttccacgccacacgagaagctgattttttcccgggcctaggtgagggggaaaggccgggataggccagggtaaaacccatactgggcttaaccgaacacacaatttcggatgggccgagattgtttcctcgccagggtgatccacggggattgggccccgatcccggccgggaatggcccaaccaaacaaggcctaagggaaacctcaaacatgtatatgaggggattgttaagttataattaattgaattagttgtattagctgtgtttccttatcaactttaagcttttgcttgaagcagcccacctataaatctattagaatttataacaaattaaataaaatggttcaattaactatataagctgattacatctaacagacccaaatttgtaaacttagaataaatttaatggacagtgctccggtactcatctgcaatggaatttatttggcttgtttggattttccatgtattcataagtacattagcatgcatataactatgtttgaaaaaatgacaatgcgcatatctctgctatcgtaaacatgacaatgacaatgaacatttgtgacgagttttatagtgatctctatcggacctaaaactgagcctgtcaccaatgacacacattggtgacggggctaaacaaccatcttcatcgggcctaagttagggcccatcacagatgagacctatcagtgacggacctattccatgagccgaaacataagcccgtcatcaataggtctcatcggtgacgggctcgcaatagatgctcatggaatatgtctgtacgggtatatctgtgtcggtatttatttcagcctattaaagatgacgacgttgtgacagtgcgaaagaccaaacacgggataggctgtcacagatatgtagttttgtactagtgaacactctgacatcttcgtatcatctcacatatagcactgtacattgaggtcttgagaatcagttatatgacactataagtaaaaaaatgtatttgatgtatgtgttccaatgcttgtcagattgatcctctcatctttaatttacacctaccaatcttattatgcaactccgaagacaataaattacgttgtgatatggcaataaacttgaacatcgacagcaacattttgtcagggcggctggtgatcaaggagtgccaaagaactactgaagaagaagggctggagactgaagagcataacctgccggatgatgtacaggaagactcagagatggcactggcgctaccgcgacgaacatcaagtattgtgggccgaaatgggccttgtaatagatccaatacagtcttgcattagcttgaacttgcgtgagagagaaggagagttggtgagatttgtaatacaagaacagagtactctgctcgaagaacttgggcttggcaactcggtggcgatggcggcggcagctcaaacctaatggattggagcaatatatgtactaaatagttgcctaaatcatgtgtgtgtgtgtgtttgtgtgtgtgtaattgtcctgttcttcctcttttctccaatttgactagcgagtagctgacaatctggtataagagccttccgccccaaaaattctcctggcttggttgtaaaattccagagaaggattggaaattgttctttggatcaatattccacgaaaaggcaacttgtcttcttctggttaagtgagtttggagagggagtggtcgattctgtctcctacgtcacaacttaaaacacccataaaaaccatggcgcatgaatggaagcaagatcttctgttgagaactatggaggagaacgagaggaaaagggaggaggaggaggagagggcgagaagtgattttgcaaatctaaagtgatgcctccttgcctttggcaactctggaagcatctaacaaactctttagaggcctcatacattggtggcaaaaagaatccgctctgccaaatcttggcttgtgtgtggaatgcaccgtagtgcccactataaggtgctgatcgtcatctctctacgatattaagtccttcctcggttggcacatacctccttagtagtccatctaagcagactctatataaatatggctcgtcccatatgtggtgacgactttcatactttaatttccttctgttctctctcagtggtacatatcttgataccatgtagttcacaatattcgcgtaacacgggttggagttgttcacaatcatcagcttgtcatctagtacgaaatcatttattagtggttcctgcacattagtgatttgcaacctcgacaaatgatctgctacggaattttctactccctttttgtcgttatttctaagtcaaattcctggagcagaaggatccatcttaaaagacggggtttagcatctgtcttggtgagcaaatattttaaggtagcatgatcagtatagagaattaccttaacacctagcaagacctaaacatatctatagcaaaaataacagccataagctcctgtcaagattttgttagcataacagattgcattatgtttcttctctttggtttggcctaaaaccgcaccaacaggaaaatcacgggcatcacacataatctcgaatgggagtgtcccatcaggaggttggatgattggggcagaaacgggtgcctttttgaggatttcaaaggaattaaggcactcgtcgttaaactcaaagggcacatccttaactaacaggttggtcagaggtctgccaattgtagaaaagtccttaatgaaccttctatagaaaccagcatgaccgaggaagctacggattcccttgatactcaccggaggtggaagttgatctatcacctctatcttagcttgatccacctctatacctctctcaggcacacgatgtctaaggacaatctcttcatggaccatgaaatggcaattttcccggttaagcactaggtctttctattcgcatcgttgcaagactttgtctaaattttggagacaatgaccgaaagtttttccatagacagagaagtcatccatgaaaacctccataatgtattcgatcatgtccgaaaagatagacaccatacaactctggaaagaggcaggagcgttacacagcccaaatgacattctacgataaacataggttccatacgggcatgtagctcaaaagtttcaccggaatcttcttcttcctcaatgaaatctgagacattattttcaagaagtgattcgggagactcaaaaggaataatagttgttacttcctttgcatattcgtcttcaggcagggaatcagtcaaggca

SEQ ID NO: 89484 - DNA, 719 bp, Oryza sativa
gaaagataagagaagaagaatttatttttgaaaaatccaaagggatctgtatttcaagcttacgtcaatttataattcttcgcttatgtgcacccagtcttctactaacatcagtagcatacaatgcgacaatggtcgagaggttgacaacatcactgcacagactttcttcctcactaatggcgtcgctatgcagatctcatgcccccacacgtctccaaggaacggtaaagccaagcatatacttcgttccattaacaatattgtgcactcccttctgtgtcaggccagccttccaggctccttgtgggccgaggccctccacacagctaccaacctcatcaaccggcatcctacaaaaatcctacaccaccacaccccctactatgccctcatcaacggatttaagattactcaaaactttattaatagagtaaaatgcactatcggtccttaaacttgtcatgaggtttcactttggtccacgaacttgcaaatcatacatcgaggtccctaaacttgatttgttgtatcatctcggtccaaagcgtcgtttgaccatggtcttgcctatgtggtacgccacgtgaacaatgacatggcattttttctttttcccccttttctttttctcctcctcttcttttatcttcttcctctactggagccacctcaagctccctcgtgccgaccaccactgtcatcaccagcgtcgctgc

SEQ ID NO: 89485 - DNA, 709 bp, Oryza sativa
gaagttgacgggcagctaacgaagaagagaattcctgctaaggtgatgtggtatttccctataataccacggctaaggcgtttgttcaagaacaaggggaatgttagaatgatgcgttggcacgctgaagagcgtcaacaagacgggatgttgagacaccctgccgatggttcgcagtggcgaaacatcgatagaaaatttaaatactttggaaaggacgcacgaaacgtacggtttcgtttaagtatggatggtatgaatccttttggagagatgagcagcggctatagcacttggcccgttacgatgtgtatctacaacctcccccctggctatacatgaagaggaagtacataatgatgccaattattattcaaggccccaagcaacctggtaatgacatcgatgtgtacctaagaccactggtcgaagatcttaaactgttgtagaagaaggaaggtgtccccgtgtgtaacgaggacaaacaggaggagtttaacgtacgagtgctactgttcgtaaccatgaacgattggcctgcacttagcaacctatccgggtagtccaacaaggggtacaaggcttgcactcactgtatggatgaaacagaaagtacgtatcttaagcactgtcggaaggttgtgtacatgggtcatcgtcgattccttgcagcaaaccacccagtacggaagaaaggcaagcacattga

SEQ ID NO: 89486 - DNA, 3428 bp, Oryza sativa
ctgagatggaggactggacatttccagattagaaacccaggacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctcccggagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgatggggagccaaacccacgccgtcgagctcgtactccaccgccccctccacgccaaagtcctaggcgggagaaggcgctcgagagggccgaaggatccgcgacttcgacatccacaggaggtggagaagggcggcgagatggggagcatcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctgatgggcggtcctccgccaccaaggcctctggtgctgctaccaccggctccgcgtcgtcaagacggagggcgcggcgagcggcagccgctgttcgccattcggccgccactccttcgtcaacgcctccgacccaggaagatctgtgtggggaaccggatgctcgcatcagtatcgagcgccggcgtaatggccgacgtgctccccacgcaacggagggcgcctcctcgtccggagtgtcacctcaccacggacgcggggatcagccctccgtacccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgactgggtcatggcgaatttctttcccatggccctgaaaggacaagcgcagggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacatttagcggttctgtcaagtccacaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatctcctcgccgtcgagggcgcttcgcgggccacccgaaaggggaggcctgcgagcgacaaaaagaaggaagccgacgctccctgacctcggctacttggaagagcgaaggtggcgcgcggcccttcgagccgcgcgcaaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggcgatggcacagagctgcctaacccatggaacatcgaacaccttcgtcgcttctacccctagtgggggtcgggtgtcaggtcttgggcttgggccaaccccgcacccccccgggcgtgcagggttggccgggggcttatcttttttctcttccgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgctcccggcctggccagtctcgacatgtggatctccctaggcactagccttgacccgcgccgtttgaggctgggacctgggcacgagcccttgttcaagccaagacacagaaggaccgtggcacagaccatcctcgtctcatacacagaacaaatgaaattgacacaaaaatttcctctttatttgattgcagattaaatcagcctataacaagaaggaggcccgaaggcctcggaagaagaaggaaaagaagaaactatttaaagattggcgggtgcctgggggctcactccgatgcacccgggtcgccagcctcgtcgccactgtcggttttcccttgctgatgcgcgcgatttgcgaccgccgggattctgcccgaagagagagagagcagggaggagaggcccccgagccgaacggcggcccaaggcccccgacggccggagctggctctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgccaagacccgataccctcatgcccagaagatgctttatgctatcctgatggcttcgaggaagttgcgccattatttccaggcgcatcgggtcacggtggttacgtcttatcccctcggccgaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgtccccgaggccagctcgagcccatcgctgctgcctcacaccgccctctgggtgatgtagttcgacggcacctgt

SEQ ID NO: 89487 - DNA, 1179 bp, Oryza sativa
aacaaggagttaaaaaacctgatactgacataagctcatcaaactcagtattcaattcatcacggaaataccaagatgtaccaagaccttaaaggaaaattctggtgggtcaacatgagaagggaaatagctgaatttgtcgcactccgtgatgtttgccaatgagtaaaggcagaacatcaaaggccagcagatttgcttcagccccttcggattacagaatggaagtgggaagaaattagaatggactttatcaccggtttgcctaggacatcatcggggcacgattctatttgggtagtcgttgatcggctcaccaaagtggctcagttcattccggtgcatactacctactcagggaagaagttagcagaactttacttggcaagaatcatgtgtctacatggggtacctaagaagatcgtgtctgatcgaggaagccaattcacttcaaagttctggtagaaattgcaagaggaattaggaacccgattgaatttcagcacagcctaccatccacagactgatggtcagaccgagcgagtcaaccaactattggaggatatgttgagagcctgtgcgcttgactttggtggagcatgggacaaaagcttgccgtatgccgagttctcctacaacaacagttaccaggctagtctgctaatggcaccatttgaagcactgcatggacggaggtgtcgcactctgctcttctgggatcagacagggcaacgccagttgtttggtacagaagttttaaatgaggcagaagagaaagtcagagctgccagggaaagattaagaatagcgcaatctcgacagaaaagctgtgcagacaaccgccgaagggagctcgctttcgaagcaggggattatgtgtatctctgtgtcactccgctcaggggagtacactgcttccaaaccaaagaaaagttggcaccacgctttgtgggatcataccagattttggaacatagaggtgaagtcgcttaccaactagagcttccctccagcatgcttggcatccataatgtgttccacgtctctcagttgaagaaatgttcgagagttcctgaggaacaggcaaagtccggatcacatcaaaattcaggaagatctgacgtatgtggagaagccgactcgtatcctagaaaccagcgagagaaggaccagaaacaa

SEQ ID NO: 89488 - DNA, 2581 bp, Oryza sativa
aaggtttctccgaggagtaggcttcgtctgtaccgtcgaggatgcctgtggagtggtgttcccgctgcagttctagtcaaggcttagctcctgttgtctttcgttctttccgctgcatttatgtaagacttttatgatgtttgtaagacgtggatctgaatgtcaacattgtcgtttgtgtaccccggccggtcctggacggtgattttaatgcacattctgcttggaattctattcgggaatttctgggcgtgacactggcggagctcgggtgcaaggggaggccggattcgccgccgccaggccgcggggaggccggatccaccgtcgtcagaccacggggagggtggcatcgtcgtcgacgccgtcgaccgtgctgcctggatccctcctctccgacctcgacgtcgtcgaccgtgctcccacggctccctcctctccgaatgtgctgttagatttgaatttttctttttttttggcatgttgttccagatgatgcacatgttttgatctgtgtaaatgatgtttgatctgtgctaatgatgattttgcattggcaaaatttgctacaggacatccaaaaaacatgtaattagctggaggaccccgccaaaacgtgtatttggtgtagtgcatcgtaaaaaactgataattggctgctggacacacgtagcattattttattatttttagaggaaaaggagagagaaacaatgattaaagacaagtttgcccttggctcaaatgactccaacgtgggccccacatggaagtcccctctccctctccctctccttcttcccagacagtccgggtggcggagcggcgatccgcggctgcggtgctgaccacgttctccatcaggagggggggtttacgtgcagccacaccgccgcgcgctgccggccgtcggcgctcatctgcgtgctcagctcggcgatgagctgcgcgctcaagtgcggcggcggtggcccggcgctcgtctccctctcggcgtcatcgtatttacggtgtcctacaacaaatacacgtttttacggtgtcctccagctaattacacgtattttggatgtcttgtagcaaattttgtctcgtgtatttcgtgtttaaatttggaaatgagcagcgaatctagatgcggatttgaattttgaaattaatgaatcaatcggcagttgtatgggtatttttcgctggcggttgtgcagctgcatgggtgtttctttttggctcaaaatagattttcactggcggccgatttaacacagccgctagcacgctggcggctggcttaagacgaccgccagcgaaattgaattatcagtagcggtcaataaccgtagcgaagattttgatcttcactggcctttgcttcgtgggggctctaaatttcgccagcaaaaatctaaaatagccaccacgaaagataatttttgtaatagtgatattgaataggacccacctatggatattgcctctattgaagaaataagcttccttgtatagacttgacccacctagtaaacgagttacaatctacgttggtcatagccttatattttggaacggagataagagtttataactgtaaaaatattttaccggtccggtgtgtagaaacccctgttggcgttactaggtacgcctctcactgttaaaaaaaaatatcctgagaggctgagtgtctgagacacagctagagtgatccatggattatctgcaaagtaagtatatacaacgcgtaaatacgaggaaagccaagacggacgacgcgtagtgaacgagtcaaagcctgagatggctcaagaaagtagctgccccgcgcgcgcgacggcgatggcgacaacgcgcgcgctaccgtatccttctttcttccgccgccgtgacttgatccctacttccaatcagctactagacttccgctccatgtaaacgcctgagcacgcgcgactcacgtgcgtgctcacgtcacctcaccgcccggcgcccgccatggccatcatgcacgcgcgcttcgaggtctccgacgtcgtcggcggcgacggttccagcagcggcgggagcagcccggcgtcggtctccggcccgtccgacagcgacggatccagctgcagcagcagcagcgccgccgacgagctattcccggacgcgcgcgagcttccctccacctccgcctctgtgccggtgctcgccggcgtcggcttccacccgatctctccgacgtcgctgtccgtgctctccgacatcgacgtgcacatgcagcgcatggcgcgtctcctcccggccttcgcgtcccccgccgccgcgccgcgcgcccaggcgctgggtcggtggctcgccgggttcgacgtcggctgggtgctggagatggacgccggcggcggccggctcccgcggcgggaggtcgggaggagggtgagggtgtgggcgcaggcgctgagcaccatggaccgcgtgttccgcctccggcaccgggaggcgcgcaacccggccaacgaggccgcggcggcgcagctcgccgcgctcggcgagctggcgtccgcgagcgccggcgcgatgctgaggctggccacagacgtcg

SEQ ID NO: 89489 - DNA, 2714 bp, Oryza sativa
gaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacactcatatagtttattcgcatgagggataacctgaccacacacaaggaatttatcgcggcggttcaagaacaactcatgggattcatcaacgaagaaatccttgatcccaagggtgaattctactacgacgaaaacacaattcaccggtccttagcttctgagctagcagcgagtactactacgtcgaaatcgtagctagctaggacatataatggattataattaatacatgactacatatgtttctatatgcatgtgtacacattttctataatgtaaatatattttgttcatatatatatctatatacatatgcatttgcataacatatatatatatgtataaatacatatatattatgaatgtatatacatataatataatataatatatatatatacatatatatatgtatgcatatatatgtattgaaacatatatatgcatggtttatatatatatatatatatatatatatatatatatatatatatatatatatatatatatataagccatgcagcaacaggggcatgcaaaaaaaaaaggtcagctggatctttagtcccgcctggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgctagtaagctagtaacacttgcatctatcgacggttgagaaatgtacgtgcgtacgtatggctttatgatcggagctacatatgcctaacgataaaccgtacaaaactttaaaaataaaaaagaaatgctttataaataaaacctctctactacaaaagaaagccaccttaaatcaattaaaaagttccaaaacttaaagtttggcaatgatcgatcatccctgggattacaatcgagctgcggatcatgcaaccacaagaaaatttacagcggatcagtgcaaccacaagcgaaactactatattcattctaaaatgttgctacttagaatgagatgtgtcaatattttacgacggagaaagtacggatcagtgcaaccacataggaaactaccatattcattctaaaatgttactacttaggatgaggatgtgtcaatattttaagacggagaaaataatagtactccctctgtcccactgtcccagaatataatgcctcctccaacaaggatgagtcagctagctcataaatctccacatcagcttttgtatgatgtggaagagagagaaaataaggagagagaatgcactatctcttcttcaagagctaagctcctaaagaaaatgtaagagaaattatggaacccaaagcattttaaacaatgtgctatgagacaatctattggagaggtagactttttgctatctcttgtatgaggtggacaagcatgagctagtgcactagctcaatcatgaaggaggcctaaggagttttagagttggacacggttattaagaaagtaggtagaagtgaatgatggagagttgtggttg

SEQ ID NO: 89490 - DNA, 1478 bp, Oryza sativa
aatgttcctgatttgcagaagagcctggacccagcttcggaagctcagcactagcagcggtttcactaataacatttctcttatccatgttaagttcaccactaccagtatcggctccaataacgtcttgcttgttttgcttctggttattatttttaggactgtcactatcataggcacgtttccgccctctgggagtacattgcacagtttcagacgacgttgttgttgatgttgatgcctgctgctcgcttgtgttgttacctgaacaagtggcattggccatgtcctcacaaactacagaccgtcttctagttctattgcatttctttttcttttgtacctttagtgaacctagcataacttgtctgggcccaagccacatgttcatgactggatatctcacaagtttctttgacttcaaatccacccttttaggtgtgttgctattgcacgaatcagctgcagctaccttcatggaaacttcagagctagtctgttttctggcgttgactcgttcaagtcctgatactatattgttctgcacaaaagccagaaacaaaatatacaaatcagcctatatgaaccttatggggtcaatcaaaagtctacaggatcatatgggatagtgacacataataagggtaatggtaccatacctcacttataggaagttctttcaccgttttgtcatcttgcttgatggatttttgcaagccacacaccttctcactggaaattggatccctgctactaggtacaacaccatttgaaacaatagcatcctgcagagttgaatgaacaaaacaagtcacatagcaaaaatattaccaaaaaatcagcagtgatcaccataagagtaaacataccttagttgggaaagtttgtgcagcaagccctgcccctgtgtcctttccatgggaagctggcatagaaaatggattttgatgctgggatgtttgtttatttcgctcagacaatatcgcattgccattgcccagggaagaggtatcggttaagccatcaacctttggttgcaattcctgcgacggaaccatggccactgcttggttcacaatcacatgtgtaagagatgcagatcgatctgatgaagatacctctctgtgaccagttgaagtaatttgcttagattgagcagataaggtagcaccatcaatttgaggtgcagaagctttctgtgtggaagccaggccattgttttcagaggctttaggagcttcagttttgccatctttcttcaaataatgctctcttgaagtcttgattgagttcccattgcttatgccgtgcaacctcttatcgccataaggagacgaggaaccgttcaattttgcttcaattacgccgctctggatcatatcactcagacctgagatcttttcaggtattgttctcctggctggcatattagcagtgatattatccttgcgtggagtcggattcccaactctgtcacg

SEQ ID NO: 89491 - DNA, 6560 bp, Oryza sativa
  unsure (1)..(6560): unsure at all n locations
cgaggcttcgataagcaaatctcgaaggagcaccgattgaacccctcgcaatcggcctattggcccaagcccggagaattacatgaccttcttgtgtgaatttcatggcattgccaagaaggttgtcaaggatctgcttgaatctcttactatcaccgatgatgttgtcgcatttcatgacagagaaatcgcagggatcccagatcacttcgatccctttggtgatgccgacaacattcgccatgtccacggattcttccaaaacgtctgccatgttgaactccacttcctccagctgcaccttccctgattccaccttagttgtgtctagtattgagttcagtatatctgcaaaagttatagcaggtcagtcatgaggacatatattgataggtccaacaaaattactcctaacaaagacttagggtgtgtttgaggagaaggagattgggggagattgggaagatacgtaaaacgaggtgagccattagcgcatgattaattgagtattaactattttaaatttcaaaatggattaatatgactttttaaagcaactttcttatagaaaatttttacaaaaaactcaccgtttagtagtttgggaagcgtgcgcgcggaaaacgaggtgctttctcaccctatatcacacaaacgaacgcagccttagaacatactcctaacaaagataatatatttatatgtgtatatacattcactggtgcaaaagaacaaaacattgcatttacagttattttacatgcatgaaaattacatattacacgcaagttttaaaacataaatatgttgtaaaataagttgtaataggatatgataaattcccaaaacatgtgacctaagcaacaaaaatgattttaggatacaactttaaaggcctctaaagcagctctaaaaataagttctaaaattcaaatttgcctatggcttataactcatcgagtagccaagcaagcacactttgacagtgtaaaaatcttaaaaatgagttagcgaagctaacctaactggagtgctaggcatgtatggtccgtttggatgtaaactagtaaaaactataaactaataaataatttccaggatattactccctccatctctaaatatttgacaccgttaacttttttaaatatgtttgaccgttcttcttattaaaaaaaattaagtatttattaattcttttcctatcatttgattcattgttaaatatacttttatgtatacatatagttttatatatttcacaaaagtttttgaataagacgaacggtcaaacatatttaaaaaagtcaatggcgtcaaatatttagggacggagggagtactagaatttatctactcccaaatgcttacagctgcagatcaaggacatcagttaactgcttgaccataatctatactatgatcaagatatgcaaatggcataaataaataaagacaaaattaatagaccaggcccagcaaaaagaataaaaataaaataagagaaaaataaatcacatgaaaaaaaagtacgtagcaaagtccaatttaacaaaatatattgatgtttaaaatctttaagtttgacttaaaaacatgtccaaatcaattgacatgttctcatgattccagcattctggagactgatagcaaattataccccctccgtcctaaaatataaaagattttggtggatgtgatataacctagaactacgaatctgaatagacttcttgtccagatttatagtactagaatacgtatcatccatctaaaattccttatattttggaatggagggagtacactttagcacttctcttcaaaaattgaactaaaaccttgacgaaccatagagctaaagtacccaattgataatggagcaacaaacaaacaaaatcttgtcggcaacacaagaaagcataaaacagtaacaacaaaagaaaaacaatacgatcagtggcggatgcagcgcccggccaccacgggcaattgccctggctccatgcgtacaacaacactgctccaatgcatatgcagcatattactcattaataatatacttaatcactttgtctcttaggttataatggagattaattagatgaaaaaacagaaacgaggaaacaaggaccaaaccatcaagctgtagctacagagaccaaacaatacaacttactcgagtagcacctatgttcaagatatatactagctttataatctaaattatcggcgataatatattcttgcctaggctccaaaaaatttctagatccgccactgaatacgatcaggggcggatctacagtattagaaccggtgtcaggcgacaccgacgactttcggtagaatctatagcaaaactgcttaattatccatatgttataacaccatgatctaagtataattagcatactatgacaccgatagacacgttatgacaccaacgaatcgattttctagatccgtcactgaatacaatcattattattatttttgttgttgtgcttaccaagcagcttgttggtgcagagctccatctggttgaggttgtcgacgatgttggggttggcctcggggcgcgacacctcgacgagcccggcgacggcggcgagcgcggagcggatgtcgtggctggcgctggcgaaggcgttgctcttgttcatgctcttgcgctccgcctgccggagcgcgtccctgtgcctcgcgaggtcggcgcccagcgccgtctccctcgccaccgcccgccgcagcgcccgcgccatcagcacgcacgccaccgtcgccgccgccgacgccgcgcacgccaccgccaccatcgtcacgccgccccgccggaacacgcccaccatcgcgctcttccggagcaccaccctgaaaccctgcaacggcaacgcacgagccaatccagagcagcatgggttaattagctagactagctcgatcgagaaatcatcgaagcatgcatgtgtgcatggacgtacgtacgcagctagctaggacacgcacgtatgaaattttatgaaatttgaatttgttgttatggaaatatggagatgatatctgcattaaggaaaggaaatcaatcaaattaagtatatgatatctcgtcttccagatctctttaccgtatattactatgtatacatccttattggtatatatgccaacgctggtttggcaccagtttagtttgcttgcagtattatgctgaagtgaatttctaacatttgaaagttcgaaaatataacaggtttgaaacattagggaatgttcaatggtagggtacaatataagattatttagtagagaccatgttcgtattaaagctaagataacaaaaactctaaccattagttctcaatacatattttttttcaccaaatgcaaccatgttttcattttatagaggctaatagtctatgtaaaatgctctgtctcccatctttctcttttccatattaacaaaaatttctaattaataaggctaagaacgccctccattaaggattatcgtatatgccctttagggcatgttcaatggtagagacgagtatggtctcttaaacaatacaatattatttagagaccctgtctttacaatagttgagacgacaaatgctctaatcattaattcaaaaaatattcctttggttaatattctttccattttcttaccctcatgcaaccatattttcatattatagtgattaagagtcgttattaagctgttgtcatgcataacaacgatgttttgtctctcctctttctctttcctccatgtcaacaaatattcctaattagcaacgctaagagaccactattgacaaccattgtacatgcccttagccagtttatttgaaaaagtaaattaagcagcgactatgcacttaattaatgaggcagatcaatgtactccggatagatagaaatcagattaaatcaaattaaattaaattaaattaaattgcctcacgcaccatttgtactccggatatgtcaaagttggtgcacgcgaatctgtacttgtcagacttgacaccgtgcacgtcgagcttgggcggcgcgtcaatggcggacgcggtgcacttcacgctcgagaacaacgccatctcctccgccgcggcgccgtcgccgagcaaagatctatatgccgccggctccggtgctggtggtgcggcggtggcgccgccgttgccggcgaccgcgtagtacatgcccaggtcacggagctgcctaaggccggcggcgccacggaggacgacgtcgtcgacggccacggcggcggagaccgcgccgccgccgccgccaaccggggccgagaggaacagcatccgcacgccggggcgcgcccacccgtcggcgagagacgcgccgccgccgccgccgtcgagcaggagccgcgtcacgttgggcggcagctgctggtgcggcgccgccgccgtggcgttcccgacgggccggccggtcgccggatcaaccgcctgggtgaaccacgtgccgttcggcctcgcgaacatcgctctcgcctcgccgtcgccgccgccggcgcggtagtaggcgaaggcggcgccatcgacggcggcgtaggagatttgagcttgcagcggtgcatggagaaggccaagaacagcttgggtcccacctgcaagtcagacacggacaaccatgcagtacacgattacaaaacgacatttgagtgtaatttttacagtaataatgttgttgcttacataatattattgttatttcttagtgcaaaataaaaaaaataaagatataatgatattggaaacatgaagagtttaagcagcattaatatactgaatcagtacagatatcacttgctgatattntgctatatanttcatatatacnagagacaagaaaaaatcanctgagattcttattttaaagaggagatatccccgttaaatgaaatcgacaagaataccatttatatcaaggttagtcaccgcaagaaaattaataaaacacggttttaatttcttgtgtgtttcttaaaaaaaactaaaaataaggataaaaaaaatgacaggtacatacatgagaaaaggaagccatgttgccctgaacatgcaaggtgttggcaatggtgaaaactgagcgatttgcttcaagaagaggtcgcatgttgccggcgatgtgcatcaaagccgaatccatggcgcccttggtggcctcacccatcacctctgtcatgtacatcgtagaggagcagaaggtgactactgtgattgtcatgcatgttgcaatcacagcctgcacacatatgagaatgtatgagaaagataaaattggggataaaacgcataatttcagtattcttcggattttccctgtgttagctatacttattaacaatctagatttatagtcccctaagtgacaccgaagaaagcacacgggtaccaacagatatcgattgagaattggtaacgctcctgccctctttaaagggaagtccaaaacaaatcgttaaaatacatatttttatatttaatatgtcgggatcctatctcttaacatgaagaattttaaaatagcgttactgcgcgcctttggggatatggtgtgtgggtggatgggcggagagtgatgaggatgctacacacgcggataacaaatgtttcccgcgtatctctgcagatacttcatcataaacaatatatatattcatgtgaatattccagcctccacatatatatgaaatcaaaagggagataacctataagacccagaaaaaagggagttgttccttaccaacgggaataggatccagaagtagcagcaacggcgtctccatttgctaacttcttctacctccctcatggtcaaaagagagcacaatctgtgtacttgggagagcagtaggaaagatgagctttttatgacacaacaccttgatgcattgtactaccattttatacatgccaaataggaaaatatatattaggaaattttttttaaaaaaatgtttttctcaataccgccaacggtttggagaatacgtttggtggtattcatgtatagtggttttcatgatatttaatccgccagtagcccaacaacgctagaaatgtcaaggtgtaaaagaaaccataaacactaagatctccaattaattgaggcaaattttaacacttattagaacaagtttaatagtatagccaactactagctttaattcatctatagccaatctaatagctcatccatacaatagttacatactatactattaatatatggtcacatctgtcatacacactgcgtctaatatatggtcacatctgtcatacacactgcgtcttggagtctgtgctacagcaggttacaaatatgtagcccgctgctattctcgctccttatttatcttcttaaaatatatttgcagctggcttatagcctgctattgtacctgctcttagttgtagtacatacgtgtgggacccaccacaggtggcattagttgtgataaactccaatgctcgtggacgtagtagaaaataaagtgggtcccaatagcatctctctct

SEQ ID NO: 89492 - DNA, 2099 bp, Oryza sativa
aatgtggactggaaaacagttggtggtggttcagtgactactgacccaagccaaccagttgttaaaaagcgtctcccaaagaaaattagacaagttcctgaatgctattttctgcctcggcgatatttgccttctgcattggcaatctatggcgctgtgtgtgctgctggagttggcgcagggatgctgcttgaggtttggataaacaaaaagatcaaaggtgcattcttgttttatctggtggcaggaggggccattcaactcacgttcttggaacactgctattttcttgaaagcttatgatgttggattatacaattgaaaacattactcttcttttgtcttagataatgttggattgaacaattgtttgttgcctgtatattttgtacatatacttgctcttcttacttgctgatgcagaggacagtgccattgtctgggaaatgggcaaatgatttgattgctacctctgaagagttctccttgctcttgtgttcagctgctaaagctgcatctcagaaataatcctagctatattgattcagattatcttttgattcccagacaaagtaaaactatcctttctaatgtacggcactgccttatatctacattcctgatttcattttgaatgctagcattacagtatggtgtaacaggcagtatcagaaataacggtgttccagaacgagccatttctgtttgacattatcagtagtccgtcatacgaattaattgattgtgtggacagtagtgattacatgctgtgatggaaatataaaaaaaatcattagagctgatcggagtatctctgattccttttcatgtgtggtgataattcgatagaattcaatacatgatatgccatattacaaagttatgaagtgcgtcctctgctcaaacaaaagatttgatatcttgatatttgtatggggaagcctccagcgtatctacgctagtaaacatattttgggggttctcaaatcctccccgtattctgaatatgaatgtaaacttgcctgcaaatgaataaaatatccgtgttttatctcaagaaaataatagaaaagcatttttgttttccaacaaaaatggatcctgtagatcgaaacaaagggcagctatagatgcatgcctcgggaaaacagaactgcgattataaaacagaactgtagattctaaacattatgaagctgtatgcattacagcagatcaatgaagcttttctagcgccaagtccagattagcttcattgattaacgcttcacagatccgcttcacagatcgggacacacaaataggcaataagggtgtgtttagttatttgggtgtaaagtttttgaagtatacggacacacatttgaagtattaaatgtagactaataacataacaaattatagattccgtctgtaaactgcgagataaatttattaagcctaattaatttgtcattagcaaatgtttattgtagcatcacattattaaatcatgacataattaggttcaaaagattcgtctcgcaatttacatgcaaactgtgcaattggttgtatttttacccctctcctgcatgcacgaatcttgatgtgtgattcaatgtttagaaatttacaagttgagtaaatttcataaaactatagatattttgacaaaaatcacaaaagcacagatttaatatgatgtattacaaaactacagatttaacgataaatttatctcaaaactacaaattaaagctgaaatatcgtaaaagtacatattaataacaaaattatcacaaaactataggttaatattaatttaatcacaaaacttgaatatttatatctcaaacatatattagtgctaatgctttaaacttaaaatatgtagttttgtgataattttattgttaaatcagtagttttgtgataattttattgttaaatctgtagttttttttgatacatcaccttaaattttgtgataatttgactaaactacctgcaattttgtgaaattaaggggaaaaaactgtcgcaactaatgtttcaatttctaaggaaaaatctgttatattttcgtttagaaagcattgataccgggctgcaggaat

SEQ ID NO: 89493 - DNA, 1182 bp, Oryza sativa
aaagttgagaagaaaaatggaaatgttgctcaagttccatttattttttggttgaaacttgaaagaggcagtaataattgtaagatgatttcgtgaacagtgacaggtttgacgtagctgatttgatctgtcagatttaagcacgagccagatcaagcattttctgctgtcgtgagtaaacatgtctagaattctactagtactaattttaaatttttaattaagttcatagaaatatagaatgccagagaggagattgagttggtagtgggaagagagtggcaggcaagcatgcatacacgttcggcgatgctgtgtgggtcggtggcttgccctctcctcgcgcgcacccgctgctgccgcggcggcgccgtgccaccgccaccggaggaggtgaccggcgccgtgcctccgctcgccgccggccctccgaagctctgccccgacattgatcctcccttgaaacgacgaagaggacaatcttgatgtttgagtcgtagagattaattacagtggcaagttcttgagcgatcggcttgcttacctggccgaacggcggctgcccggcgccgccgctgccgccgtgcacgccgaacccgttgaacagcgcgtgctcgcctccctgcaaatgaaagagaaatctcgtcggagaaggaggagaagatggtggtaaggaaggagacgagagtttccaagaacgtgggagcacgcacggcggcggcattgggcgacttgaagccgccctccatctcctcccgcggcggcacgttcgtccggtccgtgaacagcggcagcggcgagaacgcgccgctcccgtcctcctcgccgccgccggcctgccggtgcagctcgctcagctgcagcatcaccggcttctctcccccgccgccgccagccccaccgatctggtgatgccggaggcgggacgcgagcagcgccgactcgtcgaacacctgcgacgccgccgccgccgctgccggatcgacctcccacggcgacttccccgccgcgccgccgccgccgccccccaggtcggcccacgccgacggcagcgtggagagcatctggtcgaagaagtcatcctgcgtcccctcgccgccgccgccggcgaccgtgtcgcggctgctcggctgcatggaggcaaagcttagcttagcttagctgaagctcaagctgacaagc

SEQ ID NO: 89494 - DNA, 967 bp, Oryza sativa
attttgatcagttcatcaaaaaatggcttgtgctcttatcagccaagggaatcaagatatgtattgctggacgatggtcgcaaactctgcctggagtgccttgattctgcagttatggatacgagcgagtgccaacctctttatcttgaaatacaggaattttatgaaggcctaaatatgaaagtggaacaacaagttcccttgcttcttgtagaaagacaggctttaaatgaagccatggaaggagagaagactgtatgttgaccaaagctggacaatccatgattctcctgtttttcactatactaatgttagtaaatattttgtttcctgtggaaaccagggtcaccaccatcttccagaaacaagaggtttatgcttatcagaagagcaaactgtcagcacggtgagaactattctgagcatgagatgaatggatcttttcataatttaaattctatttcaattgtattggtctgctgtgttctgacttctgactgagttccagcatttatttttaatattttagatattgaggagaccaagaatggctggaaataaagttatggaaatgataacggagccatataggttgactcgtcgatgtgaagtgactgcaattctcattctttatggtctcccaaggtgaaccacttactatctgtttcataatgccattgttaccttgttgctactcttttaatatcaacaaaaactaggaggaatattcgaatttataactgatttgaaataatatttctttctgtgttggagaatacattcttctaaaaaatgttatggattcactgaagatattctggactgcatgctgactctacagagttaatgggaaaagatattactcttgtgccttgtcactgtagcttttgcagtacaatatgcaaattatttgttgtgttatcatttggttcttctgtattgggacctcatgaagtacattgtcggt

SEQ ID NO: 89495 - DNA, 1951 bp, Oryza sativa
attcctgcagccctaaaggttcaaagcagtattgaaacctcaaaagaactaactataagtagctttcaacatttaattttccattaagctaagaaaaccaacaatgaaggtttttagtcaatgaatataaagcagtaacctgaactggggttcccgttaagagaacacgatgcttagtatgatactctttaagttgaccgaacaacttggaatctttgttcttcaaacgatgcccctcatccacaatctgcaataaagcattaccaattggagaaaagtcaatcagaacttaagagcaatttaaacattctccagagaattgaagcgtatagaaagggagatggcaaaagaagtaccatgcattcccattctatggtttttagaacagtagaatccatattgatcatctcataagatgtcaaaaggacatcaaattttattcttgattgtttcttgtcttcattagatggagatgatttctttttcttaagcttcttaggtttctctttggggtagtaaaattcatacttcctaataatttcacgagaagctgcagatccaaaatacattacctggcaaacatgaagaaaaaaaataagtcgaaagaattatgagttagtataatccacgtacaacattataaattagtataatccacgtacaacattcatttgaggtgcccaagttgcaaattcacgctcccaatttcgcaaggttgaaaggggtgcaacgaccagatgaggaccaagcttgtccactgatagagagcccaaaaaggcaatactctgtatcgttttacctgcattatttttgtagtgataagtgtactcacttggtcaagaccccaatacagcataccataaaacactttcattcttaacagtaaaaatcacttaccaagacccatctcgtccccaagtattacacgtttattatggtaccaagaatagcgtaagaagtttaacccttcaagctggtagggatgtagtgtcccttcatgtaaaaaatgcaaaataaaaaacaaggaaatatgtagtcaattagaaataaaaatttaattcccaggaattattcgtgttttaaatgcagcataccaccagagagaaacttcgggctctccttatattgacgtatctcacgagtgacactcttgcacttgtcagtagacttcttcctcctggactgaatctcattgaagcgttcaatctgaggctgaaagactgcaatgtcggagtcattttcccaagtacattcgtcgtatgttagttccttccatttcacatagtactccctttcaccagtagagctttttcttttttttcacaaaatatttaaaaaaaagacaatcatacagtcagcctttgctaaaaattgatgggtgtaaagaagataataagtgaacactaagattggtgaaactaacctgacagcactatgaaagtaaagtggaatgatgttattatttctcgttaccacatttaattgaggaataacatgacagcaatagggttttcacacggtatcaaattaccttcaattggaaagtttgtcgttgagtaataggctaactatcatggtaaacattataaatggagtacatattaccactaacagcatcaatatatgcatccacagtaacagtaataactattaacctaacacaaagctacatgcatgtgtcagttaccaaagaaaggctggtctagctggtcatattatcataatattaatagcaacaaaagcaactaattatcagccagtaaatcacatcccttctattgtcacaactatacaaggtaaaaagatcaagcctcgcatagctttgttcgttgtatccatacctggtagcaaggatcctgtcaacagtagtccactcaggtctaattgcagaatagtcatcatcagacttatccgttgaatccatttgcttatggaagttattgagtctagt

SEQ ID NO: 89496 - DNA, 1440 bp, Oryza sativa
gcaaatcatgcattacaattgatcatattgtacccaatttacaaatatcctgcattctattaaatgttgcattcttttacaatgtcatgtgggatggttcctattactcatccattattgtttaccctatgccattgataacttgggtatcaaaatgactagatgttggtttaggaaatgcttagctatgcttagctcaactagtacacaaatggggatcatattactatatagactttgactattagcatagctttggattagtgccaccacaatggtgttagttaattaaaatacactgaatggtgggttgtgggtgcatggttttgctggtcgcacccatggcaattaaggaccggttcacgggaaaccctgggagacttaccgtgcttaccacaagcgggagtgggtaaatgcttgatttgaagtacagctcgaccctttcctaggcaccggtggcgagggtgggcatgatggagttgggtcggcgggggtgtccggttgtccagctgccggattcaccgcggcgcaagacgggaccgcccactgccttttgaggggtgggggtgaaaccttagcgtggtgtggatggttaggggagggttatgcagagggtcttgtcacgattaccccctttgcagtatcatggtgatacttcgggcatggcgacatgtgtggaatcgtgtcttgtgggtacagttgtacacgtctggccagagtaaaactattcgaatagccgtgcccgcggttatgggcgaccaaccagattcaccgtgattagtctcacccctagtttagcttaatgaactggtgtagtttaagtggttggttgggcctgttgcagcgtggtgtagcgttggacaatgattggttaatattaattaattactacaattgttttactgctttcaactactgcttttaaatgcctgctttatgcaaatgaacccttagcctcctttggatatatcctgcatcatacctcctcttctggtatgacttgctgagtacagtggatagtactcagccttgctctcttttcccccacaccagagctgaagatcttcctagttggagctgtcttattgaggttggtttcgtcgctgccgtcaaggattgcctgtggagtggagtcgccccgctgctgaagtcaagcttccaagtctagctcgttttaccttttccgctgcatttgtaatcttttatatttttgtaagatgtggatctgtgtgtcaacaattatcgtttgtgtaccctggctagtcctagacaggggtttaatgcacattcagcttagaaatcctggttcgtgaatttctgggcgtgacaactataattataggaatatgatctttctatattctttccacttagcttagataatcatgaattagagtataaatgcttctgcttagtgtcctctacccttggaattatgtt

SEQ ID NO: 89497 - DNA, 593 bp, Oryza sativa
gggttttcagatggtgatgaccaggagaaatgctgctaccggtgatggcaaccaacccgaaggcagtaaccacaaccaccagggcaacccacctccacctcctcctccgcctccaccaccaccaccagacaccaacgccattctcacccaaatcctcgcccagcaagccaacatgatgactgctttcctccaccacctccaaaatccgccacaacttaatgctccaccaccacccccacaacactctaaactcgccgagttcctccgcatccgtccacccaccttctttagctccaacaaccccgtggatgcgttggattggttgcatgccgtggggaaaaagttagacactgtgcagtgcagcgatgaggagaaagtcatcttcgccgcccaccagctgcagggacccgcatctctatggtgggaccatttccaggctacgcagccagaggggcaacctatcacttgggctcgcttcaccgccgcttttcggagaacccatgtgcccgccggagtcgtggcccttaagaaaagggaattccgagagttgaagcaaggcaaccgctccgtgatggagtatttgcatgagttca

SEQ ID NO: 89498 - DNA, 1296 bp, Oryza sativa
agctcgcacctcggtatgtgggtcctttccgtatcattgctcggcgcggagaagtcgcttatcagttggagctgcccgcctccttgggcaacgtgcatgatgtgttccatgtgtcgcaactcaagaaatgtctccgagtgccatccgagcaggccgactcagggcaaattgaagttcgcgaagatttgacctacgtggagaggccagtgaaaatcctggacaccatggagcgcaggaccaggaaccgagtaatccgtttttgcaaggtccaatggagcaaccatgccgaagaagaagctacctgggagcgtgaagacgagctgaaggcagcccatcccgatctcttcgccagttcttccgaatctcggggtcgagattccgtttaaggggggtaggtttgtcacgtcccaaatcgactctaaaatacatcctcgaaattgtgccgagaataattaaaattcatgtgaaagcctccaacaagtaaaatgtgcaaatttaaaagtcaaataaggcttggaggatttttgtatatttcctaaaagcctaaaatgcgtaaataaattttagtggaattttcagagcacaaataataattgagaagaaataaacaaagttgaaaaggtttataaaaagaaaaaccctaaaagtcttctttccccccctttccctcgtgggccggctcggcccaactctccctccctctctctctcctctcctccgcggcacatcggcctcctccccgcgcgcgcgccgctgacaggcgggcccgcccaccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtgggggggattattccccgcgattccctctcccgtttcccccactttcccctctctctctccctcggattcgctcggattcattcccgaaatcctcgccggcgtcatcaatggagccgagatctccgcgcccgtttcctccctctccggccgctctctctcactcccgacgctatataattgttccccgtgcctctctcctccgtttccgccgctcgccgctcgctctccccgtcggattcgtgctcgcgccgattgtacctctctctccgccgtcgccgccgagctccggttcgccgccgtcgtcgctccggacttcctcccgtctcggcgtcacctccatcggcttcgccgcgtcgtcgtcgacctcgtccgccccttcatttcgcccgccg

SEQ ID NO: 89499 - DNA, 2876 bp, Oryza sativa
catttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacagggaaataatcagaagccgcgtcttactttaggaccccagcccatgccacagggaggttcttcgtctgttgttcgtccgcaacgtcagttcttcaacaacaatgctggcaacaacatccgtaatctagctccacgtcctgttgcagttccagcacagcaacaacctgccaagagggagcaaggcaacaagcccgtggtgtgtttcaactgtggagatccaggacattatgctgacaaatgtccgaagccccgacgcgtgaaggttgtccctgcccagaataactctgctgtaccaacatccaaggctcgtgtaaatcatgtcgctgctgcagaagctcaagatgctccagatgtgattttgggtatgttccttgttaactcagttcctgcaacagtgcttttcgattctggtgctacacattcattcttatctatgagttttgcgggaaatcatgggatggaagtagaagaccttagatgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttatagatgatattcttatctactctcgaaccaaagaagagcatgaagaacatcttcgccttgcattggagaagctacgagaacatcaactgtatgctaagtttagcaagtgtgaattttggttgtccgaagtgaaattccttggtcacatcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagtcggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatttaaaggatgcaattctgaaagaagctcatgatactttatactccattcaccctggtagtactaagatg

SEQ ID NO: 89500 - DNA, 911 bp, Oryza sativa
ttagagacaaagcatagtggaaacaatgttgaaatacctttgtcacaaaacaatttgcttgatgtttcttgtgataaagaagagttgtgcgatgcttcacttatatccatgccacaactagtgaatgaacatgttagttctatagtacagccactgtgtgttgagtttaaacatattattcacattgctagtgagaacgaagagattaaattgctatcttctttaaatacttggggttaaattcaatttgatgatctttgtccactcaactgctaagagaagaaattatttgctagatttgaattgccatgcccatctgatgtgatttttcatattattggcaattacgataataaagaagaatataatgtgcatcgagtatatatatgttcgaatttgactatacctccttttcataatgaaatgcattgtctagaggacctcatgcgtataagtaattctctatctatttcctctagttgttcaaatgagttacaggttggtttgcaagaaggggagtgttgtggtgtttcgactacaaagattttaggatccaaccatatgtccatcaagaaatggtcctcaccagatgttgtgatagataaatataagtacaatacgctccatgataaggtgaaaccgaggacggtttccaatcaagaaggggaggatggtaaggacataactagcttggatatgaccatgactactttatatattcatcaaccaaaggttcatatgttctatgttagatttacttattatatatttgaacaaacgttgctacacaatgagtttcgtgtgttttcgtttgcagaggtccttgcttgggtgaaggaaaagaaatcgagcgtaaggaatacttggacgatcaaagaagttgattggggaccaaaccaagaccttttcca

SEQ ID NO: 89501 - DNA, 711 bp, Oryza sativa
gaccatctcgtacaactctggatacttatgcttgtttggaagttcagcggaaatgatacaatcatattgctcgggagaagtgagcttgtattttccgtccatgatcaaaaggaaatgtgcatgtggaagacccctcttttggaactcaaccacatacgcataagcaatcactttgccaaggatatgcttctcaagtaattgtttcttgaggtcctctagtttcgctcgaaacacgcgcactatgagatcaggcctatcttggggtgtctgcccaggctcaaggttacctattatctcttcccagttagggttgcatgtcattgtcaaaaaaatgtccggcttcccatatttttgcactaatgccatagcgtccatataccgacgcttcatgtcccgattgcccccaatgaatgatgctgggagcacagtacgtttgcctacctggcttgcacggctctctccagcatgaatgctatcaaccacacctttgtataggtcagcccttatctctacctggtgacgccttatgaagtctagtcgagtgctttctactttgatgtacatatcaactgcaaattgttggaacaagcgcttcccatacaatagtggattgaatataccacgacgcatttggaatttgtagcaatagtagtctctaacggagacacatagtctgctattttgaatctgcacaaagaatgagagcaaaaa

SEQ ID NO: 89502 - DNA, 528 bp, Oryza sativa
taattaagcaactaataagttatgttttgcaatcctagggtgctatggactcaaatatgtctctatgaaagtaaattgcaactaagtgatgttttgcaatcctaaggtgatatgggctcaaatatgtctatatgaaagtaaattgcacaaatgaaaatgcaataagtaaatgagacaagacaaggaatttttcacccgaggttcggaaactcgccggtttcctaatccccgttaaggcaagccctagttcaactctcaaaaccacgaagccaccgcaagcccccttcatcaaggggtgggaaaggtgggagccggccacgaagtggactacccaagccttgatcactaggggtagttcttccttcactccaaaggtggtgaactctaaaccactcacaaccggcgccgggccttctccataatctccttggagaggtcaccggcaacacctccacaaattgtctaggagacagcaacctccaagagtaacaagtgatgacctggctcggagatgatcaagtgccacac

SEQ ID NO: 89503 - DNA, 1161 bp, Oryza sativa
tggggcttcactatactgggtatcatgcggtactggagggttatagtgattctaactggatctctgatgtggatgagatcaaagccactagtggatatgtcttcacactaggtggtggtgctgtttcgtggaggtcttccaaacagaccattttgacgaggtcaaccatggaagcagagctgacggcattggatactgctactgttgaggcagaatggatgcgtgatctattaatggatctgcctattgttgaaaaaccagtgccggctatccttatgaactgtgataatcaaacggtaattgtcaaagtgaatagttataaggataatatgaaatcgtctagacatgtgaaaagacgattgaagtctgtcaggaaattgagaaacttcggagttataacgttggattacatccaaacagctaaaaacctggcagatcccttcacgaagggactatcacgaaatgtgatagacaatgcatcgaaggagatgggtttgagacccatgtgaattatactatggttgtaacccaatctatgtgatcgaagatctcgtgaattagaatatgggaagaacaaaccattagtaaactagaggagagtactaatctatactctctctaagtgaagatgcatgtactctcatgagctgcaaggcagcttggctatgacttaatgagttctattggctttaattagcgaagatgatgtcttgcagagcattcttgaaagaactcacctttgtgagcttgactgttggtcgcagtctatggagattttgggtgaatcttctaggaagcttactaaagacctaggagtatgacttatacgctacacccgaggggtagtttatagacggtctagtaccagataagactctgagtgaaacttgcttgcacaagacttgcaattcaaggtgtagtccattgttcaagtgttgagtaagtgtagcttggagttctagatggatgttcaaccttaatcggtctccatcgaaccgctggtatataaacagtacattggaaaaggcaaatctcagtgggattttgagatttggtgggggattgttggaattaatggatgggctaaaccccactcaaagattaattcttttaaaaatcacaaaagcccacctcatgggatggcatgcatgtggagtttag

SEQ ID NO: 89504 - DNA, 830 bp, Oryza sativa
accctatgagtgtaaacctatggggtgcaagtgggtgttcaagaagaagcttaggcctgacggtactatagaaaagtacaaggctcggcttgttgctaagggctacactcataaagaaggcgaagatttctttgacacttactcatttgttgctagattgaccacaattcgtgtgctactttccctgcagcctcacatggtcttctcgttcatcaaatggacgttaagacaacttttcttaatggagagctggatgaggagacctatatggatcaacctaatgggtttgtagttgaaggtcaagaaggcaaggtgtgcaaattgttgaagtctttgtatggtctgaaacaagctcctaagcaatggcatgagaaatttgacaaaacattgacatctgcaggcttcgcagtcaatgaggcagataaatgtgtgtactattgtcatggtgggggtaaggaagttattctgtgtttgtatgttgatgacatactgatatttgggacaaaccttgaggtgataaatgaggttaaatcattcttgtctcaaaattttgatacgaaggatttgggagtagctgatgttatcttaaacattgagctaattagaggtgagaatgggattacactcttgcagtcccattatgtggagaagatcttgaatcactttggttacattgatagtaagccttctccaacaccttatgatcctagcttgttgcttcgcaagaacaagagaattgctaggaatcaactggaatactcccaaatcattggctcgctgatgtacctggctagtgcaactaggcctgatatctcctttgctgtgagcaa

SEQ ID NO: 89505 - DNA, 1002 bp, Oryza sativa
ggatcccgctttttactgtgctgccacagatgaaatgggtgtttaaaagaatgatcgttacaggagagcttttctttggaaaggtgacgacccggagaaggttagtgcaggcagcagccttgtcaactagcaacaagtttgcaaacctaaagacttgggcggtcttggcattctaaatttggaaaagtttgctagggccctgaggttacgttggctctagttcaattggaaggaggaccaaaagccatgggcaaatatggatcttccatgcgatgagatggataggtgccttttcaaagctggaacgaagataactgttggaaatggaatcaaaacatctttctggaatgataactggatggatggacaatcgccaaaggatatagcaccagcaatctatcgattagcaaaaagaaagtcaaacagtttaaagaaggaattagaggataatcactggcttgaaatgctccacccgatcacttctttagtggaaattgaagaattaatccaactaggaggtttgttacaacacattaatctagttgctggacaaactgatgacatttcctggagatggacagcgaatggacaatattcagcaaaaagtgcataccttgcacagttccaaggatccaatgctttaactgaatttacacctttgtggagcgcgtttgcggaaccaaaacatcgtttctttggatggcttatccttcatcaacgaactcttactgctgaaaatttgcttcgacgtcactggccatgtgattggatacgtagtttgtgcaatagtgcctttgaagatgcagcccaccttgcaaaagaatgccctttcacagtgaccgtgtggacgcagatttgtatttggatgaattttcagctgcctcaacatcatttgcaaggaaatctatcggactggtggagcagtttctgcactatttcgccaagacaaaacaggaacaaggttctgagagctctcatcacaacatggtggaacgtttggct

SEQ ID NO: 89506 - DNA, 701 bp, Oryza sativa
gcttcccatatccatcaaagggttagttaacagactgaaggggcctggcaatttggttgctgtatctgagaagcgtattccaacttataccttttttttaaaaaaaatacaggtgctactacatttttcgacaaaattcgctctgtggagaaagacgcagtttgtgttgctcgtttgcggaaatgtggagtgttattcattgggaaagctaatatgcatgagctaggccttggagtaactggaaacaatccaaactatgggtatgcattatcatcatgtgactgcttattttgttcagatcccttagctagtatctagggagcacctgacggtttgtgtggtcacaaatgagaaatatcaacaacattttcaaggccaaacagactgtattattttattagctgtttcctagaatcaaattaaattgagcattagtaaatctagttgactaaccaaagtactgggatgaaaataaatattttgagctatatcagtcacatccaaatctaacacatttttttaaaagattaggaattcaaaattttgatccaatcttaagtgatagtccaatttactgttttctgatgcctagtgtagtgcttaaccatcttgtttcttaacctttccatttgcagaacagcaagaaatccacattcaattgatagatatactggtggttcttcatcaggtccagctgcact

SEQ ID NO: 89507 - DNA, 1952 bp, Oryza sativa
cctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttccacattcctcttgctagacattaatggccagatcaaattcaatgtttggtctcaagacaagcactcatggcaaagcctatatacccaacccgttgatccgtgcaggtcatatgatacttgtggaccattcaccatctgcaacggcaattcacaaccattttgtgactgtatggagaatttcactcgaaagtcacctcgggattgggaccttggtgatcgaacaggagggtgttctaggaatagtccattagattgcaccagaaacacaagttcaacagacatcttccacccattaattcatgttacattgccccgtaacccccaaaccatacaagaagctaccactcagagcgaatgtgcacaagcttgcctcagctcctgctcctgcactgcttattcctaccaaaatactagcacttgctctatctggcatgacgaattgtttagtgtaaaccaagatgatggcattgaaattcattctcaagatgttctttacctccgccttgccgccaaagatttgcagagtttgagaaaaaacaaaaggaaaccaattgttgcagttgttacaaccataagcattattattcttgtgttaataataatgctcatggtgttggtaatggtttggaggaatagattcaagtggtgtggtgtgccattacacagaagccaaggtggtagtggaattatagccttcagatatagtgatttagaccatgctactaaaaatttctcagagaagttgggagaaggaggtttcggctccgtgtttaagggagtgttgagggacttgactgttgtagcagtgaaaaggcttgatggtgcccgtcaaggcgagaagcagttcagggctgaggtgagctcaatcggattgatccaacatatcaacctagtcaagttgattggtttctgctgccaaggtgacaagaggctacttgtttatgaacacatgttaaacggttctcttgatacccatctgtttcagagcaatgctactatactgacgtggagcacgaggtatcaaatagccataggagttgctagaggactttcctacttgcatcagagttgccacgaatgcatcatacactgtgatattaagccacaaaacatacttctcgacgaatcatttactcctaaaattgcagattttgggatggcagtatttgtaggaagggattttagcagagttctgactacatttagaggaacagttggatatcttgccccggagtggattagtggtgtcgcaattacaccaaaagttgatgtttacagctatggtatggtgttgctagagatcatatcaggaatgagaagtttacctaatgtacacagtagcaacagtcatcatgctgcttacttccctgtgcaagccatcagcaagcttcatgagggagatgtgcagagtttggtggatccacgtttgagtggcgacttcaatttagaagaggctgaaagggtttgcaaagttgcttgttggtgcattcaagataatgagttcgatcggccgacaatgggtgaagtggtcctggttcttgaaggtctacaggagtttgatatgccccctatgccaagactacttgcagctataacgagatcttctaatgtagctgagatgtaaaaacaattcaa

SEQ ID NO: 89508 - DNA, 575 bp, Oryza sativa
taaacatgagtgccaaacattagcctcatcatccacactgccacaaatatggttcacagacttattttagaaatcagaaagggaaaagcggaataggcctccgcactcataacctttaccaataaaatatccatgtttagacacgactactttattagactcaaaaaccaacttaaatccgtctctagtcagacgggagccactaacaagattcttgttgatagaagggacatgctgcacgatctttcccgaagtaaacttcagatctactgtgccaacaccatgaacagaagcatgtgacccattccccattaggatggtggaaccccgtgcgacctgataagaagaaaacaatgagatgtcagcacaaacatgtacattagccccagtatcaacccaccaattagtagactgattaactgaaaaaacagtaggtaaattaccatacccgctttcatctccagtgttgccaatggttacattagtagacttagaagtctgccctgcaggtgccttcatccccttgcgttgtggacacgtcctagccagatgactaggttggccacacagaaagc

SEQ ID NO: 89509 - DNA, 1056 bp, Oryza sativa
ttattggcattagatcggcaatgaagaataaagcaagataaagctaaatctactcaatcggctgtagatatcaatgatatataatctacctctagaaacatatttaaaccaagtgattgggatagattgatagtgagtcgagacagtataaatcacttatgcataaaagtactttaagacaaagattatatatattcatatcatagccgatgaagtagatctaacatatatcggcttgtactccgataccactctatgttaagatattaaaacaagaaaaatataccaaacagtaagcctaatatatcttagtgcaataagatcttagtataaaggtcagatttagtacgtcaagtaaacgtgtacagaacaagacaactgaatcaggtaagatcggctgaaaccccgatactatctctattgatgatcataagacaagctagatattataattctagatattgcttaatagatcgaactcgaccgatgcagcattaagcataaagaaaaacacaagatctaaacaagttgatgaaaacctctatgagatggtggatatactatataatctagatcaatatcgatatctaactctattgtctgccttccaatgatagatgttggctgatttagggttagatggtaatactgatagagattatacagcacatatgataactcgacgatttacataatcaagattagagtgtcataaagatgtatgcactaatcccgagaatacaagccgccatgacaagttttacctcttgttgaagatcgaaaccgatgtagctcaacccaaaagcaagaactcgtcgaaataatgaaaataaaaaatgtggcgatacgccgaaagtgttattgaattgtcgttatcaatatacatggtcttgggccatatttatacccaaaatacataatgtgtccttcccgggcacgactctaaatctgctacaaccgttaagatacgaacaagtctttcaggcaaactcttgccgataaatatctctaaggaaactattcaaaatatcataattaatagatacaattgcctat

SEQ ID NO: 89510 - DNA, 4589 bp, Oryza sativa
ggggccgtgagacagtaatttctctctaggcatagtataaacagatttttaccattttatgtatcttaacgctattatgttcatttaattataaatttgcatacataaatatcacttatatctgttaattatatgcatatacatcagataagttgactgtccctagtaagtataagcaaataaatcagataagctgactctccctagtaaggcacagaccttgacatagcaacaaggaaggggtggaccaacacggcccacacttgtgtcatcccattcagaaaaggctgctccagcacaagtctctgtcaatccatagccttgacctactggtacactgcagcacaggtaattcaaaactgcataagaaccaaaaacaaatgcagcgacatacaataaaaggaagctcatcacattatagcatagtgcatgtactctagaaaggtcctctgtttaatatttcaactttcagcatttgattcactaaacgtgcaaatacaaatttcactataaagtgatttttgacaaactgtttgaattaaaaaaacatataagtagcacgcccaaattttatgagcttatccaacaaatgttttgttttctgtaaataaataaatccaaaggtttgatgagcgcactacctgcaaacgtacactctaacaatgtctaggacttgagtatggcattgaacttgaattttccatgaggtaagttcattaaaatcagtattttttttagtaacgtcttaaacaaacttaagatgtacaataagacaaaaaaaaaagttgactccttgtatgtttttggaattcatgtaattctagcctcatttttcgaagaaaaaaaagataattcaagtatccgagaaatgacactatgctctacgactggcacacaatcttcaacaaataaactcagtggaaatttttggaagaatacttcttcagttgacatctcactgattgcaaatggttaaatttaagataatccaaataggacaaaagaaattacccaagacatatattcataaatctttgtgtgtcactcgatagaggtgcaccaccacaaagaacaaatctaatgcgcccaccaagcatgaacgtattggtttaaaaatgaggttatcccatatcatcctctctggtgcccaggatccaaaccaacttccttcaatagctccaagatttcgtttataggcaatgtcaaacagctttttggtcagaccacccttctcaccaacctggaaacataatttaaatattaagttttgagatgagaagtatgtttaaaccatattttggtgcatgatcataaaatttgaccgttcaattctgcctgcatgatacatgccatttgatgcaatgcatttaaaatattaagtctacagaaactcattgtttcaaacatgtttccagccttcggtttcatcatctgcttgttggcttatcagccacaaccaatttgaatttgaaacttaattttagagttgaatttggggttttctcatcatagtctattctccagccttgtacctcccatttttaatatatgatgccgttaactttttgataaacgtttgatcattcgtcctattcaaaattttagagcgaatataaaaaaatttaagccatgcttaaagaacatttgacaataaatcaaatcataataaaataaatgataattacatattttttaataagaagaatggtcaaatgtatctcaaaatgtcaacagcgccatatgttaaaaaacggagggagtataacagtttaacccaaaaattattttcggttgcttcattttctatggcttatcagcctcagccgaagctcagacttgtatgctagacaagacatgaagcgtgctacggtatggtaggcattataatggctagggttgggaaataagagatgcagaccagagcagtgcaccaaaactgaaggttgtagtgttgtatgataccaaaaacatgcatgttatactatgctagaaatggctggggcctgcacttgactttgcccattgagctagccagaacatcaatttttttttttaagatatgcctggtgtaaggtacagaaaaatctacaagttgctaggctgctagatgtgcaaacgacaaccaaacagtgcatctatatcctaatcttaattccttaaaaatactgaattgggggtgatagtgtgctcttctataccccaccaagttgtgtggtcaggtataagtggtgacatataaactgtttgcagtatttaggttttagctgatcccatatggcatgtacatccattgaaatacgtgggcacattgctagcagtagcactcctttaaaaataaggttgtggtggttgtgaatccaccactcaccaactctgcactgcaatttttatgaattgctgccttcatttccttacattacaatacctcaatatcccatatgttgtttgttcttatttggccttctaaaaattagaagttgacatgaaaatgtccaagatggaccaatgtatatgtggcatgtgcgaatacagtcaaacattactaaaacgaaaaggaaattaagtacatggccatacagataacgcttaacataaaacaatattaggacctgtatggttcaaaacttttttctttagtttattcacaggcagatatttaaacatataaatgattaatgcatcaaaggcactctaaagacatgttgcagctgaatgcaaatggcatataaaagattgcagaactagtcaaagatggaaagataatggtgtaaactactgagatagatggtatgagaggagaatcttgaacctttttaacacggcatctctgatgcggtctaaaattgcagggactgaaatcataagagtaggcttcagtgcagaaacatctccttttgtccccttctttattttatttgatgtatctgtcatagtcagagctgagccatatccaatggcagcaccagaagctaacatgacagtctggccaaacaaaacaacaatatgtcatagaaatattcacagttcttaataatggcatctctctcaattgcaaaagatgtcacctctgctgctagttcaaagacatgagccagcggaaggtatgccagataaacatcccctgtgccaagttttggtatgattgtcatgacagctgcagttgtggccaccatatttccatgtgtaatcattacaccctatgtcaaaggaaaccataaaactggattaaaagaggacacaagaactgcaaactcaaaagtggttgacattgtgataaatgaaagtacatagctgtggatcccaatggattgtaattcaagtttgcacaaaaaaatatgcattatgctgatcattttgtcaaaaagacgaacgttgtcacactcatgaacagttaattcatatattttatctatacctgtttttcctaatccgaggaattttgagttgtttgccaaaatgatgttctcgttatgaatttcaaatttgagcctttttcgcgtatcaaaatgcatatggtttctgaatttatttttttttttctctgaatactagagtcaacctagagatccagtggttatagagggtcttaattgtacattggaacagtccatggatctctacatgatggtgaggagtggatgaagcagtgatggatcagtttggttcatcctgttcccatccctgctatccttccacaataagcaaagtgggtaattgcacttgcaaaaataccaaggaaaaaccaactttcctttggggaagagaggaaaagagagtatatatcaggaaagtgaatttaatttgtagaaaggatttaatgtcctgctttatttctcatttgtaaattaaatgggcataactgcatattatcataactctcaatgttgcccttaattatggagagcatcagttcaaaaggaagttatgtgagtacgttgagaataggcccaagagattatcataatatctgtcaagctaatgggctaataggatcgtaattctctatatcatacatcacttaagctcttgttcagtgaaagtaacaggatggtaggctcatcatgtgtgtacaccttcagatgaagcaaaaagaaaaggaggaacaagaaagaatgacccctgcttttgtccttatttattttcatgaataaaaatagataacagcatatgacagaaaaaatcagaatatctttgagcacaagtgtaccttgggaagacccgtacttccacttgtatacataataactgcagtatcagtgcttgaaggtaatcttgcatctgtatgtgatgttttacccaattcttcaacttcaccaaaagaaaatgttgtccagtgcttcatttgattgagtacctcagcctcaacaggttcatcctcaatatagataacatgcttaacactctgcaacttggaactgattgcaggtagcttcttaagttgctttgaatcacatatcagagttgaaacctgtgtctgaaatttataacacacaaaaaaaatgagtttcccatctactaatggttgctgtcatttaactcttctaaagtgtaaccatctactaacggcaattcagcatggacatgtgtca

SEQ ID NO: 89511 - DNA, 3730 bp, Oryza sativa
attcctgcagccccaagagagagtgcacctcgtctcactgttaaggggactcccaccatcgccatcagcgactgcaaagctcgccgactgcgccggagtggggataggagaggtgggggcgtcaccatccaccagatgcgcggcgaacacctgggatcccatcacggtgaccaaggagggaaccttaatccgcgccaataacagtgaccgaaggagaggcggcagggagggagctcgatcgtcgtggcggcggagagggagctcgatcgtcacggaggcggggagggagcttgttgtcctcaacaagcagaggccggatccgacgaccttgcgtctagatccagtggtgaaggggagcttgccatcgtgctcccaccatgtcccttctcccccagtggcagacgatgctgcggttgatgggaaaggtagagatgcggagatggatgacgaaggcgtgggcatcggcggaggcagcaaacatcatcaaaggtgagggcaagaaaaggggataggtgtaggaaggagataagagagagattgtggggagggataaaaaatatatgatgggagaagatgacagtgggaccgtgtaaaggctaagggtacctacgtactctttttgttattagaagatccaaaatacaaatgttgataataaaatatattagaagtactgacacgtaaataagtagggactgaaacacaaatatactttacagtgctttccatagtgagtgttgtgatatttgtgtagttctatcctatatgacttgttgagactgctgataacagtggtcttcgttgtatgaatacataggagtacattacttttaatcttttttagttatacatatgtttttttgaaagatacgaaaatatacgtgtaccgtgatgtggaggcgcgcaaccggttcactggtgctgcgtggacgtgcgggaccgatggtcctgcggcttggccgcatggcaccgcgcggtggcgcggtccggtcgcgcgccaccgggtacacgaaggcagcgcacgcaggcatgcatacatgcatgcacgttagtcacatactcacattagtcggctgcactcggtggggcacggccaggccgcggtgttttcctagccgttggtcccacgcgtccacgctgcgccacataatttcgtaaatcttttaaaaagacatgtataaatgcaaaaaattaaaaatagtgtatatttttttcctttgtcgtacatacccatggggtgggggttatttagttggtgaagatgtagtcgcccgcggccggtgccagggatcaccccgccgcagggcagcactatcatgttttagtggggaaagcgacggtgtcgattgtaatttttgtacccgcatatatatatagaacaactcggcaagattagttcttttagaaataatatttttttaataaataaattgtaaaaatagatgttgattggctaaaatcgtaaatttaataccctgtcgagcaaccgcagtttgacatctatattaaaatctccacgtaaatcatttttttacctcctattagctctcacttagattcaagtatccaaataatagtatggcataactgtgtaaggacaaattaatgacttataactgatgatatgcaaatatgctatattatatattcaaattagttcatttaagattccaaaatatataaaatcaccatttaaaacaatattaaggataatatggatagtattgtaaagtttagggactggatgtccggtttgaaagtcttggatgctagacggatttccattcaaagtttagggagggggtacttggacttttttataaggccccatttagttcccaaaaagtttttcccaaaaacatcacatcgaagttttagatatatacatggaacattaaatatagatgaaaaaaactaattacacagttatgatggaaatcgcgagacgaatcttttgagcataattagtctatgattagtcataagtgctacagtaacacacatgtgctaataacggattaattaggctccaaagattcatcttgcggtttccaggcgagctatgaaattaattttttcattcgtgtccaaaaaccccttctgacttccgatcaaacgtccgctgtgacatcaagaaattttcatttcgcgaactaaacagggcctaaattgtaatcgttaaaatgatcaaaagaaaatttattttcctccaacttagtactcctttcgtcctaaaatataacaacttatagcatttaaaatttaacccaaaatataataacttcttcatccacgttgtatttttaaccaatcacaatcattgaacattcattttttttccacatacctccacttttcaaccaatcacacacctcctatcttattctactcaccttttaataatcgtgtttaatcctaaaacttttatattttaagacagagttagtaacattttgttaaaattatgggacatgcttatattttaaaatggatatttccttgataagaaaaacacttctagagttaaatgtgaatacgacgatttttttttttacggagtaccgacttgtaaaagaatcttggagaagacaaaactttttatctatcataaaaccattgtacccgaagaatcctgtccagtggagcccacccgacgaaatcagatctcctaaaccaacaaaaagaaaagaaaaaggaaaaacaaaattccttgtctctatcaggcttgaccgcgactcccccacgaaccggtggcgcctcctttcctcgccgcctcgtgggccagctcccaggggggcattcccgtcatttcacctcggccggcgtggcgggaattggcgcgaaagctggcctcacccccggagacgacgagacacgtcgggcgtttcccgcccaatccacacaccgcgccggaggtgggccccactacccgacgcccaggatcgcgccacgtggcgcgccgacgcgaccgaggcgcggggcccataaacccggggaaggcgcgagagtgggggagcgggtgcggtgcggaaacgtggcgaggttgccgctttgtcagctgtcgtctcctcgcttcgcttctcctgtttgcgttgtttttcttctcgtcgcagccgatgcgatgcgatgcgagctgtgacactgacacatgcacacaccgctgcctgtggccatgttcacttgatctggctctggctgctgcaagtactcggcttgtggaataataacctcttctgttcttcacgttctgacttttcttcgcacgttcttaaaacacaataattcgagacgtaatactgctagtgattagtaaagaaaacaaaatccacttgttcgaaagaaagctacggaagcgtggaagactgttgctcctcataggagattcatccaggagacgggacaaaagtagtagtaaatccggacatccattttccctcatcagattaaaaatcaccaaccacattaacaaacccccgttgctgtcaccggtcgtgactcgtgagacgaccagggtgtgtaattaacagctaatcacccgcatcagcagccactagtcacacccgattctttcactccaactgcggctgtgagcgctgacatggtctgaccactgcgcaccacgtgagacgagagacaacgccacaccaccatttaattactcctcccccactccactcccaacaaaagcaaaaaaaaaaaagaaagaaaaaataaatatctgccacgcaat

SEQ ID NO: 89512 - DNA, 1259 bp, Oryza sativa
gcagaggttgtgcaggatgaagagattggtgaaggtgtggagggtgtgcgggatgaggagattggagatatcaattcgaagcccgacaaaccatatgttggcatggagtttcgtgacaaggacgaggcaaagaactattatgatgactacgcgaggaaatggggtttcataacaaagatttcaagctgtagaagaagccagatcacaaagcaatacaatcggtatgagttcgcttgccactccgagcggagctcgagggaatctggtgctagtgctggcagcaggtcaaggaggtccagtagagttctgaagacaggttgtaaggcaagaatggtggttgtgaagagggatgagaagtgggtggtcaccatagtagatctggatcacaaccatccacctttgaacccttctgcacttatgtccttaaagcctcatcgcctcataaaagatgaagatcatgatctcttagagtttctgcgcacaaacaagatacccacgcagaggatcatgtctgttctctgtgatttgtatggaagcatgcaaaacatccctcttgcaaggaaagatgtgagcaacctgagggcgaccatgaggccagaggctgagggcacctgcactgatatcgcagctacaatcaaatacttccaagaatcgcaagcagatgacccatcattcttttacagtatggaattggacagcgaaagcaaaattaccagcgtcttttgggtggatggagtatcaagggaagcatatagagaatttggtgattgcgtgttttttaacacaaaatacatcacaacaaagtactgtcttccatttgcgcccattattggtatgaacaatcatgggcagactgtgcttttcgggtgtgtgttgctgaaggctgaaattgaggagacatttgaatgggtgtttcagacttttcttaaggccatggatgggaaagtgccaaagagtatcatgaccgatcaagatgaagcaatggagaacgcaatcgcaaatgttttgccaaacacatctcataggcgttgctcatggtacatatggagaaatgctaagttcaagcttggtgtgctgccgtctcggttggaagggtttgaagatgacctaagacattgcattgacgagtcatttaatgttgaagagtttgaaagaagatgggctgctgtgcttgaccgatacaatttggcaagcaacaagtatatgcaggacctctacgaaatcagagaaaaatgggttccatgctatttcatggactg

SEQ ID NO: 89513 - DNA, 6393 bp, Oryza sativa
agtatttgtctgctaatcctgtttttcatgccagaaccaaacatattgaaattgattttcactttgttcgagaacaggtatctcgaaaattgctggacatttggtttattaatacaaacaatcagttggctgatgggtttaccgaagccttaccagtgcgtaaactcaatgagtttcggcgcaatctcaacctggttcccgtgttgggattgccggggggtgttaaacagatagatagttcggataggaacatatctgttgacaagataagatagagtttagtttgtttcttatttttctgtttcctttcttctcgatgaagatgtaatctataaactcctatgtacacgccacgccaggggctgtttctggctatataacacgggccgtggaaccgagagaggcaatccacgttaaacccatctttacagacatgatcctgtaggatcaagatgtcgactagagggggggtgaatagacgatttaaaaactaaatgacacataaccaaaactaacctaagttgctaggctcggtgagggtcaagtctaacaaagcaactaagttaagttttgtaaacctagggtgatagtggctcaattatatctctaggaaagtaaatcacactctaagtcaatgtttagcaatcctagggtgatatgatcttaagtatgtctctatgaatgtaaattgaacaaatgtaaatgcgacaaataaatgagacaaggaaacaagagatttttcaccgaggtttagaaactccccggtttcctactccccattgggacgagcccaactccaccgctcaaccacgaagccaccgcacgcccccttcgtcaaggggtgggcaaggcgggagccggcccacggagaggactacccaagcctcgatcactcgaagtagtctccaatctttagcacctgaaggctaattaagtactccctccgtactcgtaaagaaagtcgttttggacagcgacactgtctccaaaatacaactttgacttcttgtttctatataaatatttattgaaaagtgatatatgtatacttttatgaaagtatttttcaagaaaaatttatccatataatttttatattttcaaactcaataacttgagagttattcatgatttatattcccaatgtttaacttaagcattgtcctgaacgactttttttacgagtacggagggactgcaccatattttgttatcatttgttctcgtggaaggtgaagaccaatcctgaacctcattcttgttcaagagtacaagacgtgaaaagatcagagctgcaagtatgtacatggtcattgcatgattaggctctagttagcaaattacggctgtgttcttttggaggaacctctccccttcgcaccgaaaacagagtggtaacacgtgattaattaagtattagctataaaaaaacttgaaaaaattcattaatatgtttttttaagcaacttcctatataaactttttacaaaacgcgtactgtttagcagtttgaaaagcgtgcacgtggaaaacaagggtgataaattgggaacttattggaaagaacacggccgcacatttatctgtttgatgaaaacacgtatgtgatggtagtggatagattagtactaaaatgctatatatagctggttggtacccgttgtttggttgtctagtaactaagaaggctaaatgtgtcattttactctagagtaaacggtcaatgcacggtcaacacacggtagtggtatgaaagggtgtgcaaatttgatccaggggcatataaggaaagagccagtttcaaatggcatataaggaatacaacaagttttcaatggcgtataaggaattctctcgagaagaccaaaattctgaaataatagatatgtgtcatttagactcttaattcacttcctcgcaaaaaaaaatgactcttaattcactagtatattaataacaatcttttcgaagcccacactatatttaatttataattagccagtttgtatactcttattttttcataatctaacagaatacgttcaccttaggaccatcaatttgttattgagtccgaaattcgtccctcaaccgaaataccagatataacgggtccctcaaaatataataccggatcacttgaggttctatatagtgttatgcccgatttcggctaatgtggcaagctgagtcaacgtggaaccgggccccacataatcagtgggtagcactttctcataggttgattcatcttcccatctcgcaaatgatcatattggagagctgaggcaggggccagcagcagcaccaccagtagtagcaacccggtgggtacggatgtggcggcaacggtggctggtatcacaaacggggccgggacaggctgtactcaggagaggatggtcgtggacacagccaggatgggtcgtactcgggtggacatggtgggagttatggttgaggaggaggcacaggtggtggggtgccgtactatggcggaggcggaggcggtggaggaggaggccaagggcatggatgcattgctggctgcattgagagggagtgattgatggcgaggcggaccgatgcggcaccgaagctcagaagaagcgaggtggcggaggtatgctgccttatgctctgcagccatgccccgtgccctcctccacccttttctctctctctctctctctcatcttctctccctcggtgggtgcatcgagagcgagcagttgagggtgagaaggactggtggcgccggagctcgtggaggagaagcgaggcagtggcggaggcctgctaccctatgcgccacagctgcgccccacaccctcctccacctctctctctctccaccttcttctctcttctagcggtggatgcatcgagagggagtagttgagggcgaggagaaccggtgcagtgccggagctcgtggaggagaagcaatatatgcggcggcggaagcctactgccctacgcgccgcagatgccgccctatgcccacgggatccctatcttggacaagaacggcactgatccctttctcaaggcacccattctccattgccgctgggagactggcaacaaggagacggtgtggtacttctgtgggccattacgatgccagcaccaccatctccaatgctatagaaggaggagctctgtggcagcataggaggcaggtgagcttccaagggcaactgaggaggtggaggacggcaaggactatcctcgaagaccgcattctggaacagggaagcccatgtggatggtgaggttggcggcgctgaggaggataacatgggtgagcagacaccgttctctccagcggcggtgaggccatgtggctctccgttgactaggagagggagagaggaggaagggagagacaagtggaaagagaggggctgatgatgtaggtcctactataattttgcttatttttaagtgaacgctaactgacatgtgggtctcatgtaggcactatatcaattgaaaccgacatctaaactgtcttgagatcatatttacactagctttgggacttgaggacacatcatatatattgtggttcggggacgaatttcggattaagcgacaaattgagagactcagtaaacttattcctaataatctaaccgattttgcggttcagagacaccgataaaactcgatcatggacttttccttagcagcccacagctcccacacggccacaccagctgggtccgaaacataggcccaacaaggagcaacaaccctgttctagcccaccactcgacgccgacggccgacaccgctgacacgctgtccgcggtccgcggtccgccgacgcttgcctcccgcagccgccgcccgtcggccctcccccctcccctcgctggcacggcggctcggcggtcgccgagcactgacccgatgctgcgacctagccatcggaggaagagatccttagccgatgccgtgaagaagctggtgaagcaagaggaggagtggagctggggagaaaaggtcaacttcgtgggggtaaggatcagaatatcatatccaccactttctttttacaggcgtatttaactgtacatgatctttggttaggtaagacaaacaacacaattagtcaaagtttttagtatgaagcattgaagttccctaattcttccaataaaatgcaatcggacttgcaatattaacttgaactgcacagtttacctgttttggagaagtatacaatttcttggccctgcccttttcagatgttttccagaaaaaaaaaacaatgccttggccctggatgaccgtccaaaagaatactcaatactgtattcaacaaaatacaaaacacaaaaaataaaaattggaccgatttggaacccgagaaaagttttctgatgttgatctgtggggactcaggtacaatttcttatgtcctggaaaattactatagaactccgaacttccgaataggagatattttctaatgttcatgataacaacatttgtcaatactctatatttccaggagtacaaaatggtgggctcgatgtctttctctattaatgtgtttcagtgtacagacgggtccactagaagtctcagtctccttagcaccacagggaaatgattattaaagatcatatactttgtttaaatttattttgacctgatgagacgactttgactactggctgaagccagctacctgttggaaaattgattggctggtggccatagaaggagaacgaaaatatgggttggtggagttctcatatggctcagacatggtctcatggtgtggagagaagcatgagaaaggagagagtagatcagcaatacgttgtttctattcattgatatcttgacatcttgtttctattcagtgatcataaccagtccaatccagtttatgcagttttctccccttcgcgatggagttttcatgcatctggagtgatcttatcaggtaagttctttccacgttgtctcatcattttgttctccaggtttcctgtaatcatatttgatataaggtagtgctaaccttctctccagatcatggcttcatttttagaaataagctctgccctttatttgatatcttcttttcctgcttcgtagagttgtttgtgatcttacagttttacaggcttcaaaacccagctattttggcttcaattttttcccattacagttatttaattaatttatgatctaccttatgttgcttttgtatgttttcctcttgaagttaaattaggggatgttcggcacctagatttgctttaaaccaattcgactttaattcagaattccaattagagtaaatttaataaaaccccatgttttattaccaaagttaaaaaaatgcgttattgtagcatgtactttgatgctaaagtttcacaaaatctcaaccctatttaaattccagacaatgtagcatgtatttacttaatttttgccattataaaatgtctatagaatttgaattacgaatttcttggttaaaatgtttcattatattgaacccttcattactctgaacaatattgttttaaatatttaaaatttgctaagagttgaataagggcgggactttatgaaaattttaacctatatgctaccagctataactcccagagtttatagcaagtttgacaatgaataacctatagtttactgtgaaatttgttcttgtatttactttgatatttttgaaatttgaatggaaaaccatacaattattttttagatttaatatgaattccttttttcttggttgcttgacatggactctttacttttaaatttgtaatcccaatttgaacacagagtcttattaatgaaactgtttcgaggactggattggaacacagaggagatctgcctaaacaggattggactggttatgatcactgaatagaaaccagagtcttattaatgaaaccatacaatttgaacgcagatctcctgcgtgcaaaaaaagttattgaacataggctttttggggtcgcgggagggggttgctacacataggccattgagctcaattgaggcctgcacacaaacatttgttttagtgcttgagctgaaagaatgtgatggaactgtttcgagaaaatcactaagtggggatgaactgtaaatgttatatagaatttgtagccttttaaacatctaggactatattcttgaaggactctaattaatattctttgacaggagtgcaaaaattgtcttttgatgacctagacatatcgttaatctgcggcaaccacatagacaatgttgcattttctttctttaatcatgtgcctgtagatgctactgtcctgataccatccaatggcttgttctggagtctttgttctgttcttgggctgcaggaat

SEQ ID NO: 89514 - DNA, 1708 bp, Oryza sativa
cacagtattatgatgcaatactaaatggccttgaggtcttcaagctatgggacattgggaaaaaaaaccttgctgggcttaaccctccacttccaccacaaccaaagactgatgtgaaccctaaaggggtgtctggtggagggaaattaaaggtgctgtcccagcagccatatgtgccgtggttgtgctgattacagcttgtttttgtgtgtgcatcatctgtagacgaaagaaagtggcaaagcattctggcaagactgacaaaaagtgcttgacttatcaaactgaattatacaaatcaccatcaaatctttgtcggaacttcaccttccatgaaatgcaaatagcaactagtagctttgatgaaacccttctgcttggtagaggtggatttggtgatgtgtaccgtggagagatagataatggtacaacggtggcgatcaaacggagcaacccattgtccctgcagggtgttcatgagttccagaccgagattgagacgctgtccaaggtcagacatggccatcttgtgtctctaatcggatactgccaggaaaaaaatgagatgattttggtgtatgaatacatggcccgtggaacacttcgggagcacctgtacagcaccaagaggccaccattaccatggaaggagcgcctcaagatctgcattggtgcagcccgagggctgtattacctgcacacgggcccgaaagaaacaatcatccatcgtgacgtgaagactgccaacattctactagatgacaagtgggtggcaaaggtttcagactttgggttgtccaaggttaatccggacattgacgccacccatgttagcactgttgtgaagggtacattcggatatttcgaccctgagtattttcggttgaagcaacttacccaaaggtcagatgtgttctcttttggggttgtgttgtttgagatcctgtgcgctcgccctccagtaaacactgagcttccagaagagcaagtgagcttgcgtgaatgggcattgtcttgcaagaagataggcactcttggtgaaattatagatccctatcttcagggagaaatcgctcctgattgcctcaagaagtttgctgattgtgcagaacaatgtgttgctgatcgaagcatcgacaggccagagatgggtgatgttcttcggaacctagaggttgctctgaagatgcaggagtgtgcagagaacaatagcaaattcagtgaagaaacaacatcgtcgaagacaacaccagacatgatgaccatcatggatactgacaaacaatccacctactcgacaatgagcatcactggacaaaggaccatattctctgatatgatggatccgcaggcccgatgaaacacaacagttaatgtttcaactaatttcagatccatagttcatgtcctggtgatcttttgatcgcaatcactctagtatgttgaataattagttgtttcagatttttcatactagttccaaatctaagcatagttagacttatcaagtaaataattctgcataccatttttaagaagtaatgctactgtttgagtggttattttgttgcttttggatagtatagtttacccaatctatctacatacgaaggtgctgttaatgcagtgtcgatcttaaaaaaaagataattaagaagcaaagtttattatcatgttaatcagttgttaatgctatagttcagctgtc

SEQ ID NO: 89515 - DNA, 1837 bp, Oryza sativa
cagttgtcttttgagctgatagaatttttgctggtgggtctcacgaatctgtcttccatagttattaggatcaaaccggatcggcggtccgaccggggaaaaccaggtcagaccgggctggcttttggtgatgggctgaggcgaggcccgctgagcaaagtccaccaaaaatcgctggaaaaggatggggattcgaccttgggcagtgacctatgcctcccctatcacaaaaacgacacccgtggcggtcagttgtcttttgagctgatagattttttgctggtgggtctcacgaaatcgctggaaaaggatggggattcgaccttgggtcgcacggttgagagctgcacgcgctacccaccacaccatcgcttcgcttctgttggtctaagacattaatcctataatactttaaatcgcggttggaccggccgaaccaccaaaccagtgaaccgagacctcgaccggctcattctccggtccggtatagaaatcttcaagtaaactatgctgtcttcaagtgtatagaaatcttgtgaccgccacagttcatagaatatactttactcccttcgtttcatattatttttttcactcaaccagttttagctattaaatatttttgtttcactgattcaccagttgcacatataatagttcattttcttaaaaaatagctaccatatgtacccacgtgtgaaaaccctgttttcgtgtgcgatttgtgctgcccatatggaaagatactaaaaattattttttatagtgataagcgcccttatagcaaaaaaaatatttagacctagtagcctgcaagaacaggttttagccaaatgcgaaaatcattttttatagtgataagtgcccttgcaacaaaaaataaaatctttataccacaccaataagtaattatatcactacgtgaaacccacatctctatcatatgttccatccacaacgtgcatgagacccacccaggttcatgaaaaaaggcccccaaatatccatcatctaactctccgccaccgtacaccaaaaaaataacatatgtaatttggatttcctatcacaacgcacgagcatgtttgctattcttaaaagaaagaaatgagagagatgaaaggaaatggttcacttgaggtgccttatcttgaagtcgagtttcgaaattgaccctgaattgaaataccagatataacagatccctaatcttgcaaaaccgggtcacattaggtcccaaggcagtattgctccccggttttggtgacgtggtggctgagtcagcgtggggcccatgtgggtcccacatgtcagtccataatcttctcccacctatctcacctttcttcccttctcaacccaaacctccagggcagccgacaacaggtagggagaagagtggcgactgacggctgcgtcatggacctgcacggcgaagagcgcgaaaaagcgaagtaggaagggctcccgacacatcgtccccttgggttacaccacaacattgttgcgtggcagctcgccgcgcatctgcgccgtgtccgcattgtggtcgcatgtcagccacaccgtcgggattggtgagagaatctccaagagttgggagatggagtacgttgcgacgcctgagtatactcgcgagcaccactgactccatgagtgcccgtgcatgcacgcgaagaggacgctagacgctgaattgcgggagaggtgtgtggtggccggtgaccagtagggagaagggaggcggtcattgggcggcggcggtaggtagaagcccgacgacggcgcctggcgattggtgggaataaggttggcagccaacaagaagcttggcggt

SEQ ID NO: 89516 - DNA, 2154 bp, Oryza sativa
tcaagtcggtcgccggcgtcgacctgccagtgcagccgctgcacacgctcatctgctactggaaggcccgccccggccgcgagcatgagctcacgccggagtccggcttcccgacgttcgccagctacggtgacacctgcatctactccacgccgtccatggagttcccaggcctgatcaaggtgtgcgcgcacggcggtgcgccgtgcgacccggataggcgggactggtgcgctggcggcgacgccctggcggacccggtggcgcggtggatcgacgagctcatgcccggccacgtcgacaccgccggtgggccggtcatccggcagtcgtgcatgtactccatgacccctgatgaggatttcatcatcgacttcgttggtggggagtttggaaaggatgtggttgtcggcgccgggttctccggccatggcttcaagatgggacctgcagtcgggaggatcctcgccgagatggccatggacggcgaggccaagacggcggcggaggccggagtggagcttgggtatttcaggattggacgtttcgagggtaacccggagggaaatcgtgctgaaaataaggtgaaaatttgagtcctcgcgtaggcatggccacctgtaagagctagatctgtaaggtgatgtcggtgtgcgattgtgagatgtttgctagtactgtaatatgtcaaacattgcatttctgaacttatactccctccgtttcgaaatgtttgacaccattgactttttagcacatgttttaccgttcgttttattcaaaaacttttgtaaaatatataaaattatatacctacataaaaatatatttaacaatgaatcaaatgataggaaaagaattaataattacttaaattttttgaataagacgaacgatcaaacatatttaaaaaagtcaacggcgtcaaacatttcgaaacggagggagtatatgtgtgcgcttcagaattatatgtttgcttcggaatcttggacttcggtagattggaatgattctcattacgatttttgctgcgctattcctattccagagtcatcatcttcatgttagatgtgcatgttaattgaaagaaactagtgtgttggtcattgtcaggaatatcactggttatccagttatgtcaggaatatacagtaccacaaaactccacatccgtacaaccttataagtaccggttcacttagacatgcttattacgctaatccagaccgcaccattcacaaaactcaaaagtgtgggacctcgctagcattgttggtcagatctccaaatagagatatgaaagaaccatctaaagaacatgatatcttacacgtcatcaattatgttatagaagtaccctatatgatcttagggtctgcgggtagaactccaactcctaaatttagctttagaagttttgtctggagtggagttgtagataattaaacataaacccagctctgcctctgtgatttattttgtaagaacactccacccagtttcactcctgttttaggtggagctgaaactgtttggctggagctgtgtcaaacaagcacttaaagtctataacttcgcttctattttaagtgtagctgaaactgtttggctagagctataactgtattaaacagacacttaaagtttataacgattttatgaccttcatgaacaaaagatagtagaatcagaattacatggaaacattatagttacctaaatagttggcggagacagaaactaccacagaagcatggggtcggctagtcaatcagggaataaacacctaaggatccaacaggactaaatggcatgtttggcctattgaggtatcatattataagctattgtgttaatgtgttattgaaattatgccaacaagttggatatgagctagcttataggaaatggatacttaagcttctaggccccataaatcaatacctgctttgttgcttcagtttttctttggaggtagagataaatttgaagagcaagaataatctgaagatgagaagtgttagcttttttggccttatgtaccctatgaatgctctttacaagttcaagaacaggagtatacagctaatcaagtattatagtttaggtttaggtttattggtttagacttttaagtcagcttattgactt

SEQ ID NO: 89517 - DNA, 2186 bp, Oryza sativa
cagatgtagcattgcctaactaggagttctcccaacaacgtgtttatatttcactctaatatcgtagtgagatggataaaacacattgagaaacaagtacaattttaataggcattcaagaactacctcccaccgaagatcatgagcaaggtgtggctgtgatgatgaatcatcttgacatggtgatcctatgttgttatcagcctcctggtgctggttccatgatatataatccatgtaaaaccatatataaattgcattgcaccatatgaatgaaaacaacaaatcctaacctttttgccacaaagatccagaatattgtcatggtgcatattttgctgttcctcacatcttcttttgttctatagtggaatggacaataaaaatttactatagatgccagtatgtgtattgagtgttcaaataaaatttatcaattagaaacgacaaaataccattgatatatttctttgattactcattgagtcgtcttgatcaggtctactgcatcgaaccctctgtatgtgcacatatttaaatattgttgcacaaaatatggtgagaaacatagaatgcattactttgacattacctttctattagtccgtactactccctcttcaataccatcatcaaaagttctctgagatgttgcctacaacaatgaaatcaggaaggggtaagattttagtgtgaatcacataaattttttattttacaagcatctacaaaaatgaaatcagaagtagctaaaaattcaatgttaaggacaaaggtatttataacgtttaccatagttggttcactattcccattgcttgttcctttgttttccaactcctcaatacgctgacccagtgttttgactaatttttttaattcccccacttcccctctaacatgtgtctcttcattcgatgatgagtcattcactgtagtgatgtttatgttcttgagatgatgtgatgtacgaccataaacctgcttaggaacaggaagtaatcccattccgtgcacttggccaggtttttctttgcccaatactttatttagcgcatcaccttcccatgcaactcttccttggtcattttgtgccaactctggttgttcatcgatgaggttctccaatgtgacctgcaagtgaaaaaatatatgcccactgtacaaggtagataacatacatattagatatttatggaaggattatgtgtatatggcataccacgtgttgatttttatctttatccttttttttgtgagttgctaagtaaaccattgctctatgtggctgcttcttatttggatcatcttgtctctgaaaatgaaaggtaatgtaagaaagtaaagtgaacatgtatagatgaattttgaacaaaacaaattggctcaccaagtcctcagaccaacgagcataactctttgtccctgctgagtgagggttctgtaacattgaacgacttcttttgttctttgcactgagggcctattacagaagcaatgtagtctcattgagttcacacttccaatgttgtttacggtaggaacaacagtacaatatatgtcaatgagacaatagtacagattgtggagcagattttttacctttcctttttttgacttccaatatttgataagtggaatccattggtctttttctacatcgtctggacaaagcttatacagagcagaacgcttcttctttgggttaaaatatttatcttttagtgcagccttgtatcgcctccaatctcttccaattgatttcagtatccattgaacgcatgatggagggtacaggaaatttgtctgaaatacataggaataatgagagtagaagtatttgaatttgcatgattacgtcaatggttaggcaagggataacagcaagtaagaaaactcagcattgaatatctgtaaaatacatataaacattgaatcgaaaacattcagttgccatggatatgaacagatgcatcaatctgagagtaggaaaaaagtaatgactagtaatacaaacagagcattatacttatgctattttagcgtttgaggtacctggacaaattgtagtattgttaaatctccttcatctgctttgatctttctccaggtcatcttatctaatggacagtaagctccatttcttgctaatgtgcccaaaaactgtcctagcaatccaccttcat

SEQ ID NO: 89518 - DNA, 3755 bp, Oryza sativa
tctggattcctgcaagcagacgcttcagccaaacgacgacgaaaaggaaaaaaataaaataaaaatttgaaaatccctaaaccctaaccctagaatccataagccgtcgccgctgtccttgtcattgctgtcgtcgtcgttgtcgcttgaatctaccgctggcatcctggtcatcgtcatcgctcgaagccgccgacggatccacacgtgtggggacggaggggcggcaggatccgcgttggaggggaaggaggcgtcgggcatccacccctccaattgatgccggcagcggacatccttctcaccacggcccccgctcgccgtcgcttcgtcaggggaggaggttggccgtggctgatctgcaccccatgccagagccctcacccgctgtcgagccctcctcccccgccactggatccgccaccgccttgctcaacactgccgtatccgccacaaccgctctcacccgagcccggcaccttcgctcgccatcgcttcttcgagagtgggagagttggaggagtttgagagaactgttagacttactgggagtgtcgagttggacttagtgggaaaagcgagaggaggggaggaaaaaacatgtggacagagggaggggtattttcggatgcaagccacttaagaggcccgcctacgaaaattgattttcgcatgtagttgttgaaccgtgattgggggagtgattttgcaggcgagagcagttatagcccgtctgcaacttaaagagcatatcgtcctgaaaaatcatttcatatcgtagtgcataaactctaacatgtgcctttgtttaacaatcatatttagttcgatggtcaccgaccaattcagtattgctgcatctatgctgcttaagtacaacgatatgccgatatccgagctgcaagcctgcaacatgtcttacacggatatcgcgccaacatgtcttcatcaatttgtcatttttattttcaccttctaatgttgccctgtttgccgttcttgttttggttgtctcccttacttagcagttccatcaatttgagctttccttcacgcttttttcactgcagaatatacaactacgtgaatatactcttacaccatgtgcaatgttcatttatatccggagaagggcagtatatatatttgttttgcagaaaacaatcaatgctttgttgataaattggaaaagaaaggtgagcgtatgtgaagagatgcattccctgaggatgaggatggtgttgtaatgttattgcaagcaaaaacatatcaccggtgaataagatttgtgttttctgtagacagacaatatagagtagtagaagtgggaggtattgggaaaactaatagtactcctactaactaatatgtggcagagatggttcaaggtgatcacaagcattttggcagagtccgtgaagatcttgatcaagaccaggtagttcccagtatgagaacatcaactacatgtacagtgcacagtctaaacatagccaagctattgtggaggcaaacagtctgtatgagattatggttcaaaaccgaagttcatgtgatttctttttctagactacagatatattttgaggtacataaacacgaagaaaaaaaaagggcaaaacattatgccatacagaaattacagacaaacaatttattccatttcatattacacaggcattcggttttaatttgacagggggcattattacccagtaattgaagcaatcttaataagaaaataattaatgtgtgcaaatatgcctatctgcagcgatagtatcccaattgcaaagcattatcgtcaactcgtcttaccaggtgtgtgttgggctgactgaaggagtgagagcacgaacaaaaacggagctagctgaccagacgaaaaacatacctctggtccaactaatatgggcttataagtacccttctcaaggcctcatgggcataagcatgtgtgaggcaatgtatatatatgcccatggaagatgttgtaacattggttaagatgtagtgccttttgtaagcattcatggtttagaaaatagaagtggaagacatcaggaaagtgcataaaaccgctgctctttgatttattggagtccagaaatgttcagctcctcctcccaacccggaagcacggtcttgcttggttattgagttcactacatcgtaccctagatgaactcatcgtgatgggccctctaaacgatatataaaattttatgatatatagacgctaattttatttacaaaatgaaaacaaatacatgtctggtaattattgagaaataaagtcgaccaaaatatcaatatatttgtaccttggaactaatatcactaccttaatgaagatacttctttggatatttcttgatgcaaaatcatcaagagcgttattaagatcaatagtgtctaagatatccttctcgatagagcatgtagccaaatcatttaacatttcttgcaacatagttgatctcaaatagttattcaacaacttcaattttgagaaacttctttcagttgaagctaccatcacaggtatagttaagagaattctttcagctggatgcctggacggctagtcttgcactcttgccgagttgctgtcttgcgtgattgcgtccagggctccaggcgggaggctgctgccgattggcagccggcgggctgacgccatgcaggcaggcggctaagtgttgacttgtgctgtgcgatgcgatgccgagttgctgtgttgcagacgagtcgacgatgttgtgcgcctgtgcggctataccctgtgtgatgcgatgccgtctgccgagttgccgacgacgttgcaactcctctcgtctttcgcgcgtttcttcttctaggtaggccataggcagttactagactactagtattaggtgttggacccactcaccatcatggccccctggtgattgcctcgtctgcataggcctagggccggccctgcatacaacaacacgtagaacacgacgtatatatcatagtaggtgacacgactataggccttcctatatagatgccggttttctaaccggtacaaatttgaggccacctttgcctagttgcccacccacaccagaaccggcactacaatctttgaaataagaaaaatctaggcagaagaagttttgaatctgtgatacccgtggagctcggggaggagccgccaccatctagtagcaagaacacaccatcccccgaggccactgtcgagccaatgcctccttgaacgagcagcgagattgcccaatctgaagcgatgaggcaacagcagccactggcttccttacctcgccatagggctccaccaccaaggcccctccaccgagctcatttgcccccgccgcccgatccatgccgtcgcacgcttcactacgctgtcatcgaatgcagcttcaccacggtgccaccggatctgaagcgccgacctcctcgcttccaccatggccttggcctcctcgctctccgccggagagtgaaacaaggtttggggagataggagaggtgccgtgggctctccccctcccgtgcggatcctgtcgcctaccctcctcgtgcatgcatccggctggccgggatcctgccgccttttttacaagctcccttgtgcaccgatcagccggcggcggcgatgggaggggccgatccgccagcggcaacgatgggaggccggggatgacatcgatgatgacgatggcagcggttgctagatagggagcatgatgatgacgaac

SEQ ID NO: 89519 - DNA, 842 bp, Oryza sativa
gccatccgggcctatctgatcccatcagccgcagattttccaaacatcgatcccattccacaacagcaattatacaaagtagtagtcaaacaaaactacgctagggatcacctcacatccgcccatgaccgtgggcacggctgttctaacagtttaataacctctgcagagggggtacactttacccacacgacattactaacccggatcacccagctcatgcagaacagccacgtctggagaccttgaggcattcatgacaaggcatttcgaaagccgacacaggttcaccatatgccaacgagaggggtcccagactgacatcaggttaggtcccagaccatactatgccaggaagcccgggggttctcctcggcaccaccccgttgaatccacatgtctcttggcatcatggctccctcggtctgtggttttggaaattcatttagttcgcaagcaccgacccaggtgtcgggtattccaagtcttttgtaaaaccccaagttttacccatcgttggatattttaaattagaggggaggtgttccgatgcccgtgcccgaaggccagtgcatcgaagcacaacagttgacaaaggaggtttaagtgttcaataattcacagagggtaattgcagcaattaggattcgggccggcaggctatctaacaagccgcggccgaattactgtgtttaacctattcatgcaacatttgtggaaaagaaatacttagatttaaattataggtgcaagatgatcaaaggtgacttgccttgctcgagatcttgagctcgatcctcgaaatcctcgcactgcgggtctgcgggctctgaaactacacg

SEQ ID NO: 89520 - DNA, 1735 bp, Oryza sativa
ctccatccatccgggaagtatgaagatgtaccaggatatcaaggcatacttttggtgggctggaatgaagcgagatgtcgcagaaaacgtggccctttgtgacatttgccaaagagtcaaagaagagcatcaaaggccagctggtctactgcaacccctaccgattcccgagtggaaatgggaagagatcgggatggatttcatcaccggtttgccaagaacccctagcggatacgactccatctgggtaatcgtggatcgactcacgaatcggctcatttcgtgccagtgaaaactacctttgatggaaagaaactggcagaactctacatgacccatgtcgtatgtcgatttggttgttccaagaagattgtgtcagatcgaggcactcagttcacctcaaggttctggaagcaattgcatgaagctctcggaaccgatctaaatttcagtacagcttaccatccgcagaccgatggtcagacataaagagtaaataagatcctagaagacatgcttcgtgcgtgtgccctggatttcgaaggcacttgggaccgttgcctgccatatgctgcattctcctacaacaacagttatcaggccagcattcagatgtcgccgaatgaggcaatgttcagaagaaagtgccgcacccccttgtgctggaatgaggtcgacgaagcactagtgtttggccccgacatactcaaggcagtagaagagcaagttaagctgatccgagaacgtttgaagacagctcagaaccgtcagaaaagttatgccgacaatcggagacgtgatctcgagtttgaaaaaggagttcatgtgtacctgcgggtatcacccctccgtggtatgaggaggtttgggatgtccgacaagttagcaccccgctacatcggcccctacatcataaccgccagacgtggcgaagtggcttatcagcttgagttacctgaaggtcttgcagatgtgcacaacgtgtttcgcgtgtctcagttgaagaaatgtcttcgtgttccagaagaacaagttcccctgggcaataccgagctggaaaagaatctaacctacaaagaaaggccgatcaaagttcttgaagaggcagaacgtcagactcaacgaaagaccatcaagttctacaaggttcagtggagcaaccattcagaagatgaagcaacctgggaacgagaagatcatctccgcgccgagtttccggagctgctcccttaggtgctgaatctcggggtcgagattcttgttaggggggttggtctgtagcgcccgttccgtcgtggcacctagagggaaaatttaaatcttaaaaaccctaattgcgaaatctatttctttgcttgttgtcagtctccgtgccaatctctgatctagaattccctatccatcgtcgaattcaaattccgaatccaactctctccaaattcaaattcctccgcaaaagtctagtttgcctccctcaggttcggtgggccaattcccctctcggcccatctctctctctctctcccttacccttcctctcgctctaccagtgcgccgcacacgcgtgagcgtgcgtgtacgcgtgagccgacgccgagccgagcactatccccctctctcgttctctctccccgctccatccccggcaagctccccgccgcgtttttgagttccatgcgcgatcgccgccgcggtcgccacccgtgccgcgctgagccgccttgccgctgctctg

SEQ ID NO: 89521 - DNA, 3349 bp, Oryza sativa
ttaggatgttacaggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagtccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtgacgtcgggcatggccatcccaacagacccttcaggtacttaccactgcaggccgattccagcaggatactcgaaggtcgaagttgagttggtcgaaggcgcgtacgaggacctcgagctggattaccctggaggagacggtgagacgcatctacgagacacatgacatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaagatcctgcaccgactcctcctcgtgctcctacacctactcccccgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccaaaaaagaagattcctatagaccccactgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtaaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcaacattacaagacgttcatactgttgccatacaacacagagttagtttaattttactgtcttcctacataccaaatttcattcccgtacgaacttgctaagtgtttcatatgtaatgcatcccacgcacattgcagattccactaggtgcttttattcatcgacctggaggcctgcaccgtcaacgtatatgactcaatggataaaaaagagtctacatttgacaaggttttcgaacttatagacaggtaccgtcataagttcctttgttaattaagaaaatcttgttatgttaattgctactatgaattatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtaagtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatatctatatacatatgcatttgcataacatatatatgtataaatacatatatattatgcatgtatatacatataatataatataatatatatatatatatacatatatatatgtatgcatatatatgtattgaaacatatacatgcatggtttatatatatatatatatatatatataaaccatgcagcaacagggccatgcaaaaaaaaaaaaaggtcagctcgatctttagtcccggttggtgttaccaaccgggactaaagatcgatctttactcccggttatttcaccgctatctttagtcccggattggtactcccggtttggaaaccgggactaaagggaggttacgaaccgggactacaaagggtttctccaccagtgctaatagaatgatcaacaagctgcaaactagagtgagccattggaagcaaacatgagctcgacaccaccaagtaacgagcttctggtaggctcgagcttggctctgtcaaagctggattatagcacaatcgcagcagaaagaatgaaaaggttgtatttctcactaacagtgctgacaagaagctgt

SEQ ID NO: 89522 - DNA, 1407 bp, Oryza sativa
ttcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgttaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaatttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtat

SEQ ID NO: 89523 - DNA, 11664 bp, Oryza sativa
cctgcaccccggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtccaagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaactttgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgtgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatcaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctgttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcaaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaatcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatataaaccatgcagcaacagaggcatgcaaaaaaaaaaaggtcagctctatctttagtcccgggtgaaataaccgggagtaaagatagcgatctttagtcccggattggtactcccggtttggaaaccgggactaaaggggggttacgaaccgggactacaaagggtttctccaccagtggtatcttccatattgctagatttgacgcttgcatattcctccatgggcgcataattccttgagcaacttttgttttagctatattcaggagcaatctgaaactatacatgggagcatgcatacgttttaacctagaatataacaaagcccagtccttaatattgtccaacagtcagctgtataaaccagaggcaatagctaggtaggatgtgctttctacactttgacaacaatcaggtaccacagggagaagctcaaagttgacaaagatggtcatgatatagggtgtgtttagtttctgaaaaaaattgaaagtttgaagaaagttggaagtttatgtgtgtaggaaagtttttgatgtaaaatgatgtgatggaaagttgggaatagagggaaactaaacacggccatagaagagaactagaaaccatttcaacacatatagttgatatatgtgtccgccaaagtaaatacgcactgattgatacatagaagatgtaaccaccggaggaatgttcatttagaactatgttcagaaatttcatactttttttccggtttcgcgagaaaaatgctatgaaacaagctaaaacaactgttctacaggtgctacttcttaaccaccgtatagcagctttctcaaaatattttttaacacaagattgtcggttaattttcatttatgaaaagggtttgctgcataagcgtagtgtaaaagagtgcctcgttttgttggagagcaaggcataatattggtagtccttttataaaaggagttgaaatgtgatagtgcatcgttctaatcaatcatgataaaatcgtaatagtaaagattttattcttaagccccatattttggggcaaaaggtagattaacgttattcctaaattgcatatgctatctaaaagtaacaatgcatggaattgccaagatccaatatttttcctttatatattccgtaatgcttcacttaaaacaaaagcaaagcacctaataaaatgctgttagttattcatttgtttccatatgtcatgatgtcctagccatatttaataggattcatcctttttccctagttttggtttgcattcaaaatgtgtgatgaaaatatgagcagctacaaactttatataccataatatagaatctacctgttgtaaagactagtcagatatcagaaggctgtacttcagctcttcgattgtgttcactattagtaacaactcgcactaacccagatcattagctagatctaataaaagtcggatatacactagtatataatactaagctgaggttgttagatagcctacctcatttgtttccaggtgtagtgtaagcctctctatgcagacgtaagatgatagaggaactgagctgaaaaagaaaagtcaatataaaaacaataagtcgtcatctcgaactaaatagaaattatgtagaagtcagtatcaacggcaaacacatctcatcagatctttgcaaagcatgcatgtgacacctgcacttataggaaaggaccaacacctcaccctacgctgtagttccttaggtaaaaaatgtttatactcgagatctcaacaatttttgccctggaaatttaatcacgtgaggtagaaaatattcccaagatcctatcaatcggatctaagatgtctatagaaaactaatataaaatagggatgcttaatcgactagttcttgctgcaacacagatttgctttttttttctcgtaaacaaaaagaaaatataaagacatgctcatttcaaagaactgccaaagctaaacgtttgcttaaccaaagaacgtcagtggaaagagtaggtttgtcttgtttagtctaagcgtgtgcgcttatggcccacaagagctggcccaacagcaacctgcggcaataataattaagaaatctaattgtcaaaaaagggatcacctatacatttatcgacaaattttctactaaaaatttgacagatgtaattatagtacaattgtagtgtaattacactgtaacttatatataattacactgtaacttctatgtaactacagtttaacttgtatgtaagttcacgtaattttgaatcattagatctattacaagatttgttctggtgagaaagaaaaaaatcacagcacacgtatatgtgaaaggatttgttcccacgacctctattttactgaaataacatgttaccaagagattcttgaaagttacatacaagttacattatagttacagtgtaattacatgcaagttacagtgtaattacactacgattgtactgtaattacatctgacaaatttttggaagaaaatttgtcgacaaatatatagcaaatttggtcaaaaaaattatttttgaactaattgtcaaaatcttggagacagatttgttgagataagtccgtgaggacttgcaacttgcaaaatagacagggattccaaattttcgacactgcgaggcagtgagcgcttgtgaactcaaccaatataatacccagggactgatagctactttttctcttggtggaaggaaaaaccatctaaaaagcatgaacttctcccaaccaatatgtttctattttgtccacaagaatggttatttcagagggcagggtcttttgcaaaacttccttaaaaactggaaatggggtaaacgcaaatggaacaaaacaaaatcagtgactactatagagagttattctcatttgaccacctgaacgtatggtgggacgaatccttttcttaccccctcagcaatcaccaagaagtaccaacagatgacaaaacaattcccccttttctacccttccaccagtggctcaaaacaatcgtgaggctcacacccatgttcctagctgatgatgattcattaggttcctcctggatagagccgaatttaacagcaagcatcctacggttccaatcatacggaggtatccacggcaatcgaatcattcagattggacagctatatatatcaaaggggtcaacgatcatggggctcactctcaagatcttggatgatgtcccagggagcttgtacttaaatttaagtatgtattagtggtatggaccactcaaattgagcgtaatccgcactggcaagaaatccaaatcttttgccagtgtagaagacaagaaccaacttaggagaagatgatgaagatggctgtagctagctgtggacggacagggagaggataagcagagggcttgggaatggatggctggatgcaaacactgggcggtggtagttggtggttggtagcccacatgacatcagcccaaaaagacagcagcccgtgtcttcttcttcttttcacaaattcctggcctgtgcttttggcaattgctctagtcccccaccgcatctcatctctcgcacctccctttcagacgtcattctcggctggctcgggtgagttttttatggcttttgggtgaagtgttggtttttttgtggtggggtcaccttctagaagcacaagtgatccaatgtcttccccacaaatggtcagtggatgcagcgtccgtttgcaactatccttgtcaatgatctactagcggctcaggcactgtttagatcctccaaaatagtaaaagttttatcattttaaagcactttttaccattttggatctaaacactagcaaaagttagcaatttgccatttgccatttgctagtccatagtagcaaattgtgccaaaaaaatgctttggatcactctctctctccaccaaaaagtgctagaatggcaaaagttcaggatgcatctaaacaccaactagtacttttacaataccaaaaacttttgccattccaaatgcatttaaacatgccctcagctgcaatggatgtgaaaaaggtggcatgcagtgtgccggaatcacgtaattattttttccaagaaagaagaggcagctgctcctatacccttaagaaaagctgaaactgataacagccagacctttcctagtcatagccggcgcaagaattcaacggcttatcgattaactttaaatccagcatagcggctccattatacaacctttttttttccaatgagaggtttgggttggatcgcttccggcctacccaacgtctaacaaacggtcaagatcgaagcaggcaaactttgatgcactttgtctaaaatcctatcacccataaattatcgggtgctagctagtgagtggtgactggtggtgagtgtgcgctgatatttttgttaagagaacaaaagtgatcttatccttctgcctaacaattgtaacatcacagtcgcatgcccatgatgatcatccccttaagatcttgtccccttgcccatgtatctaagtgggtgtattgtgtacagacctggttatgtaggagtgttggagtcttcagaaaatgtacgaagcatggtgcatgcctgggggtatggaaaggaagtatcaccacatgcgtgcaagcatatataacctacaaaaaaacatatgcaatacatgtgtaagaatactctgcaagttactgtgccattgtccagtctgcctcagctctttttcaaggtgacttacaggatgattatttgagaaaaaagtatctaccttgcaggagcatctgaaggtgctcgtccaagtaccataaactttccaaagtcatggtctttgacaaatctattgattaccattcctttaattttgatgtaccttgaaaaaggaaaccacagggactacaagacgcgcaaacaccaggtcatagtaacctgcatatcaaggcacgtccaaaaaaatgctaagattgagacatcaatacatcataaaaatcttttgttctatttccccccaagtcaaataaaggaagaactatgtgaacttaattagtttgttgagtaatgaaaacagcaattgcttgcatggttactagaaaccccatcctaatctatcagcatggatccaatatcattactgtcaaaacttttttgttctgggagtactaaatcatcgatccattgcatccttagtgttaaaccttttcgtgaatttagtgttaaaccttttgagttgggagttcataagatcaggatatataacacacgtcaaaattttaaattgtgcaaatggtatatggtatgtaactatgtatatgtaatgtatg

SEQ ID NO: 89524 - DNA, 2640 bp, Oryza sativa
cggcggcggcgacgatgccgcgctgttcaaggggtccgccatgacgcggcgcgcgcggtcgccgcgctctcctacatggcctgctccggtacgttcccccgatccgcgccgcttcttcttcttcttcttctctgatgcgtcggctgggtctcgggatgcggtcgtcgttagcgagaatttgagggtggcgtctcgtgatgcggctgcgaatttggggggtagcgcgtggttggggttcctgcgggttcagctcacgaatttgtactactactaggtgacttttggtttcagttttggtcgttaattcagttggattcgattatctttgggaagagggccggttggttgacttgtgtccaacaacttcagaaaaaaaagttcatccattttggcattacacgcaaagtacatgctgcgtggtgcttggaaattcgtgggggtttcacttgacggatgtgttccgggggtctgggaggctgcttgcatcttcaacattaaatactaggacaggaggtgctaagtggtcagcggctgtacaaacatcattatgtagtaattactgtcagcgtttcagtgaaaatctacaaggataataaccttttagaagagaaaaactgcgtttggtgaaaattctgaaacttttgtttcgggtttggccatgatgcagatctgcgaagcaatcaaaatcgatagagatctctgagatgcagatagcatgtcgatgataggttgaaaacctggtgatgattgagttgagaatccaatattatgccacttagttgtccaacacagatagtcagctaggtggtgttcttatgaaacagggattagtcacttaatttcacatacggacatcttgttttcgttctttctacatttgttttcatttttcagatctcaggtatcattttactaactttggcaacttttctatcagcagtgttggtagtgatgtagaacaaagcagcactgtgttcatatgatttcccctgtgcaaatgtcattacgctccttcaggtacttctcatgtccccttggactggactctggaaagtctggctttgctgttatgttgtgcaagtgtgcattacacatttacacatgaataacttgcttgtagtctaggagataaactgtaggatagcataatcaaaacattacatattcgattttatctaatcaaagaacattctgaacttccgacccttacttgagcatctgcttagcaatggatattgctaaaggtcttttcatacctttatttgatatcactgttgatgaacttcttgatgcatatatgtaatctgctgctcgcatctcctgcctctttttttttttgacacttaataaacatgtgcagatggtgtgctcaacaggccttctttatgttctgaggcggctaaagataatttcatttacaaatagcgagccatccgtgccttctgatgcgttattcttcgttccgttcagaatactgttgcgtactacacctctttctttggcttatttactctatatggtatgcttctttcttcacttataatacatttattaaatacacttagtcgcatgtattctatttgaattgaatcctgagtaatgttttccatcatggtaaaagttagcttcaatggaatctgtgcgtggagtcaatgttccgatgtatacaacactgaggcgcacaacagtagtctttacaatgacaatggagtatttcttggcaaaacagaagcatacgccacctataatcggcaggtacatgtctataaaaatgatttttccttttttttactgtattataaattcgtaatattctcagaatagtctgacgtgctagtaactaatgtaagcttccttttgtcatatgctttcttatttatttctatatattatttccatcttttggaaaccctgaaattattagtctatcccagtgaactagcaattagtatctgttgctgttttttgttttctgtagcctattgctaactgttgtacctgtatttttgtagcttgaaataaggttgcagttgtagcacttgttttcttacgctaaaaatttccagaacattgttatgttctgaatatgccatattttactttctgattttttttaccatgggtttgtcagcgtggctttgattgtatttggagcatttatcgctggagctcgagacctgtcgtttgatgctcgtgggtatgctattgtctttgtggccaacattacaacagctgtttaccttgctactataaaccgtataggtaacatttcattttcagttttgccacatacaatcccattctaaactacatagctttctaaccagcagttttgttttgttttaggaaaatctagtggtctaaatagcttcggcctgatgtggtgcaacggtattattttgatgacctgtttcatattcataatatccagataaaccatatttgccttagcattcatatcctatccatttggattccaggacttgtctgtgggccttcagtactttttctgacatatattcagggtgacctgaagaaggctatagaatttccctacctctattcccctgggtttcaggtacagatttcacagaaccatggtcatcactgatcttatttgtgcaatatctaccctccttt

SEQ ID NO: 89525 - DNA, 659 bp, Oryza sativa
tgaagctcaatgaaggccttgagcaaggcaagtgacctttgatcatcttgcacctataatttaaatctaagtatttcttttccgcaaatattgcatgaataggattaacacgagtatttcggccgcggcttgcgagatagcctaccggccccaatcctaattgctgcaattaccctccttgaattattgaacacttaaacctcctttgtcaactgttgtgctttgatgcacgggccttcgggcatgcgcatcggaacacctcccctcaattttaaaatatccaatgatgggtaaaacttggggttttacaaaaaaacttggaaaacccgacaccagggttggtgtttgcaaactaaatgaatttccaataccacagaccgggggacctaccgggagtacggtttcccgctcttgcacttaaggaccgtttcccttggaatttcatccgaacataagtctcaagtgcgaccacatgggtggaatgggacacccctagctgagtaatttgctaatcgggagaaccatgatgccaagagacatgtggattcaacggggtggtgccggggagaaccctcgggcttcctggcacagtatggtctgggacctaacctgttgtcggtctgggacccctctcgttggcatatggtgaacctgtgtcg

SEQ ID NO: 89526 - DNA, 1605 bp, Oryza sativa
aaaaaattatgttcatatttgtggtttgttttcataacgcaaactgataaaattgtatccaaagctcaaatgtctgaggttaaattgatgaactgataagcaattgagatgttgagtttcatctagcaaccaacaaccactaatcatggttgctttagaaattagaataccagagaaagaaaactcctttagaagagcttgacactagagtcatgtcagctttagaaattagaatactagagaaagaaaactcttttaaaactctttttataaattacaaaacccacttagaatgaggcatgtcatctttctaggattagtgtcatctactcatcttggtacaaactgattgtgtatatttgtatgttctgtacttgtgtatggatattgtcgcaacaccctacgtctgcactatgctcaactaataagctactagtgtaaccaaatacattgtagttcactctgagttacaactttttcgaaagaatgctatgtgcataagatgattcagagactaggatacttattccatgatctaaaaaagatactccctccgtttcacaacgtaagtcattctaacatttctcacatttatattgaagttaatgaatctagacatatataacttcaatatgaatgtataaaatgctaaaatgacttacattgtaaaacggatgaagtaattttaatatttaagacttgaatgctccatcatttgcttttcagctcatcaaccgcggccaaaatttaaattaaaaaacttaaattcagagttgttttttatgttttatcgtagttatattggcttttaaatcacgaggaacacgtttaaaaaatttacacataaattattgttttcactaataagtgttacggtttataatcagcagtggacgaaacgatgaaacttgaagtgaagaactgaagatcctgttgagttggtggttggtacatttcaagtgaagaactgaagaatcgtagagggaacaatgtcggagatggaaggagctctgagatcctgcatggagcagctgctcatcgccagggaggagcgggagcagatcatcgtggaggcggccagcgagatctcctcggagaagaagaaagcgcgggagctccagcggaagctcgacgccgcgaccaagaaggccgcgaagctcgccgccgagaacagcagcctcgccaaggccctcgacgccaaggacgcggcgatcggcgagctgagggagtccaagtcggcctccgacggcgagctcgccggcgcgagggcgaggctggacgcggcgcataagcaggcggcgtcgctgcagtacgaggtgcggatgctgcagaaggagctggagatcaggggccaggagcgggagtacgacctccagtccgtcgacgcgtcgcgccggcagcaggcggagagccagaagaagatcgcgctgctggagggcgagtgccagcggctgcgcgccatggtgcggaagcgcctcccgggccccgccgccatcgccaagatgagggacgaggtggaccagccggcgacacccgaaggtcgcgctccgtggcgcctatgtcgccgcggtccgtggcgccggcggcgccgatgacacccatgtc

SEQ ID NO: 89527 - DNA, 2629 bp, Oryza sativa
  unsure (1)..(2629): unsure at all n locations
agaaagataaaaagaagctgaccataataggaaactttaagtcataccctggaagcctggtcagagccttcatcttctagcaaatcagcaccagatacttcagggggagaacaggactgttctaaaactctggcaggaatatcatttgtacacttatctgtgttttgtacagaaagcctatgatggatatcatcattgccaggtttcagcctttcatacttattactgaaagcacattctgtcagttcaccttcaacattgagctctggtggagagctagccccattcgagtcaggagaagttttggaacttgctgaggatgagacatatgctggtctttcttctgaaggttggcagcactcaaccattatatcaagaagcaagtctatgatagcctgcttcaagacactaactcccatcagcaaactgatgaggcttgtggaactcgagtcgcactttgaaacatctttctttccaccagccctggtggatactttggtaggaagtagcatgcgctttacttttgctgggttatcgaggtaaacacgcagaccagtaagaaatccagcaattgcactagcatctgttagaattttctctcttaaagtaacctgcggctgagtatagttttcaccatatgtaagagaaaacccagctctcgagaggaggtttcggaacatatcttcctcatcaccactcatatcctcgctgtcttcagactcaataaagtcatcaggatctgttgacaaatcatcctggtcgtcatctgacgccaaaacctgcaattgtgtgactactataagagatgcagagagcttttctaccagnnnnnncagcaacagttatccaagtacaatactacagtataggaaaagactagaaggccataatgttatgctaccacccgaatacaggaaaacgaatagaagaacacctggactgctactcatgcttatgtccttaaatctagtgaatattgactaaggctgagttctttccccaactttcccaactcggctcccttgtgttccgcgcgcacgcttttcaaactactaaacggtgtgtgttttgcaaaaagtttctatacgaaagttgcttaaaaaaatcatattgatccatttttgaaaaaaaaagttagctaatacttaattaatcacgtgctaatggtccgctccgttttccgtgcgcagcaaatgggttcccaacccaaacaaacgagcacagcctaatagtgcccagaacctggcatcttcttaaggactttgaaattgacatgtcagtaatgccaccagactttgaaatccattggcatggaatactgtcgtgctttagtcctgttgtctacaatggatttgaagaaatcatttttttgatttcctaggatttttgggtagttcaatgaagaatgtacatataaatggaaaatggacacaatattcgatctgaccagtgttgcaatttatttttttctgtaaaaatgcttaaaagaacatttcacctatgcacctttgtagttgtgtgttgttccaactaaatagatacacctaattatcaaatgatatagcactagttcttcacagaagtttaaattatagcctatgtctatatatgattcccgtcacaaaaaattgagcactatagttgttacatgttgtcaacttccattattaatctcttatcataatgtatccactaaattaaaaatatatatatgcagcttgtgcaatccctgttatttactaatctcagctatactatacaaaaaaggtgtgttagcatttcaagacttgtgtcactatactcccaaacattccaaaagcaaactaatccaatatgacccaaatcaccaaaaaatatgagtatcctaggctttttcaacttattattcttttgatctctgtcatatgttatatcaaatgtcaagctgcataatcacattcgatatgaacaattggattttactgtactgcaacaacatttggttagaagcatgcatgctatacaacacgaaggcaatttggatgtatttggagtaactataatagtatcatgactatcatcaatatttaccccaacccagcacaggaagcaaaaaggaacaagccacatgaaaaacagcaaatccaatctcacctcaagatcagagaaatcaaaccatggacagcagtctatgatttcacaaacaaaaacaacagtgtcccggacaagaaaaccagcatcagtgtccaacaggtctgagaccttcatgaactgaagaactgaattgttccatgtttttgtgcagattgatgattccttacacaccgtttttgcagaattcttctggttaattatagccatcttatagtgtacccaaaagttcttatcaggatcaaacccagatggctggtcactttccaggtatatgcagatcgtatcaaacgactcatatacacctgcaaattgtgataagatgagcacaaaaggcaagaaatgtatggcacaagacatgaaaagtaacttcctttacctatacgcaactcacaaccaccagcctggaaatatttactaaaaatctttcttgtctccataatatccttgaaggataagaaattttccaccttccacgtgaatgatggacgttttggca

SEQ ID NO: 89528 - DNA, 1551 bp, Oryza sativa
agtgtacttaacaaaaattgaggcatctatagtttttaaaagatgagttcaaatgaccatatgctgcatctaagagaggagaattggcacgatttatgcaacaaaccaattcatttgtatcatttaattaataaacaggatttgatcatatattaaaacgaaaaatgtgaaacccaagctgcttaatttatttagtggcatactagccagtagctaaactagtttttttttaatcttttgggatttacctcatttccatttccaggttccaatttacacaggccacttaaccttgattccaaaattttcaaacagttaaaagcaccccacacatttagctatgttatagttctgattaaatcaatcaggtgtgtgatgtgtgtgcctgggtatgttaccaaagtttagcctctataagcagtatatgtacttatgtagcagaaatccacaagttgatcttgcaaactaccagatgagtatggagaaaacatttgctagaatgcttaccccgtggatacacaataaggcggcagtctcgattcccgacctgaaactttctgcttttgatgcacagacccgtgatctttcgcttcttgagcagctccttcaatcttgtgaagttctcaatcctccacacaaactttccaaagtgtccatccgactttctagccccagctcgtccactgccagcaccactcatgcctgctatcatcggtaagctgcgagtgaacgagtttgactccttgatcacatgcactgaagcactaaacaccacagcaccatcaagcaggtaacccccatccgcagccaaaaaatcatccatttttatgtaatctccccacccaaggctggcattgtcagccccaaaccggccatacgagtctttgtggatgtgactcccacctggcttctgattgaggatcgaaacacgaaaaagacaccagcacccacggtcaccatcgggcacgccgctgcccccggcactcgacggcaatgctgatgccgaggaccctgatgttgcctgcaccaggggctccttgctctccagacacaccgacaaatggtccgcgccagatacattactctgatagacactaatccggagcccgcagtcgctcccaccggcattggccgccgggaagaaggcagggctcatgatcttctgcgtgcggaccatctcccggaaggtgccgaagttgagcaccttccaggtgaagcggctgtcggcctcggcgaacgaggcggcctcggcgagcaccgatatgtcggcggcgatgacgagggagtcgtgcggcgggaagaggtaggcggcggcggcggacggcgcgaagtcgcaccagccgtgcgaccgcttcttggaggagaagcggtgccacgagtcgcgcgccagggacttggagggatcgggggaagggtgggcgacggagaggcggtagctgaagaagcactcccatttggaggaggaggaggtggtggtggcggacgacgacgacgtcggggttttggggtcgagcacctggaggtagagggagaggtagcccgggagcgcct

SEQ ID NO: 89529 - DNA, 2387 bp, Oryza sativa
tcaaacattaaatccttaagccactagtgatgtattcttacttgttcaaagttactttatggtctatagtattttattaaggtaaatctaaacatagatggtaataataaatggtgcttgcatgcaatttaattaatttgcgtaaatctgcaaaatttaagtgaatgacatacatgatcctattgtgttaagaaaatagttttacttgtcttggattgataccagttggtatgtttggctaagctagctaagaaaatggaagtttttttcgaatgcttttctcttttttttatgggaaagccggaaacagggtgaggtatgatattttccaagcattgatgatagtttctggtttgctctaagttgttttatagactatagtttaaatgtttattaaggttgcttattaaggtaattcaagcatgcaatgtaacaatgataagtactaagttgtaagttaattaatatatagaaaactacatgttttgattggatacataaggattttttccgctgaaaaaagttacatatgctaggtcgtcacaaggttggtgctagctcaaacattaaaaccttaagccattagtgatgttgtctcgattgttcaaagtcgctttatgatttacaatattttatttttaagataaaaccaaacatagatagcaacaataattacctctacttagttgtaagctattgatgtgcacaaagctaagctatgagttttgagtgaatggcatatatgatgttagaaaaaatgttgggggttgacccgtgcgtatatttgtatatggttacatcaacgaagaagtgcaatacaattgtcgcaacatctaagaaagaaggttgaaagttggtgctagctgtatttctagtaatacgttcctaaaatatatcccctgtattttcttataggtctttatatgggttattgctaaaaaaagcatcatatccccttaaatctcaatccctacaaataagcaaagataaaatctctattttccaaaggaagaaaacaaattttagtgcattacaaatagaaacaaatcatcgctaccagctacaagtgacgataaaggctaccgctgtgtcctgctcggctgctcgggaagcggtgggatagaggactagcgggacacttggggtcttggggacgaggctgcaatgccacgccctacatctactcatcgacgagaagcctgatcgagttgagccggggaagccacgtcatccctgccgctattggcagagctacgtcggcgtaggatggagggccgctcggctggagatgctcttaatgacattaaaaacttaaacttatatgtgtaatgtatagatggaaatagttaaattctatgtttgtcttttcggtgtttaggtgtatatgtttcaattgtgatcataattgttgtgcaccgaaaattagcaacccatttgtttttaaaagtaatttatttttgtaagaatcatgtactaatttaactttgcttcaagaaaatggtcatatccgataaaactcattctggctaccacatgttttatcggtttatagtagtgtcatagttatagataccacatacctaatagtagtcgactaagctcggcaggacccaccacataccatgtattatacggaatcatacctcgtgtatagaaggagttccggataaggaaggacaaatatagttctatatggaaacggcaagtacggtctccctagttctacatagacagggggaatctatgggtataaatacaagctctcctatgatgtcacgcactgaagttcccctttccagctttaaaatttgttaaataaatcgcctaaagaaattgttgaattaacctagagctaatcctcaattaataaatgcatttaataatcaaattcggcgtggtggaatttttcttgagttccccatgctccaatacattaacaagacttttagtgcaattttcagagctctcgaaataattttaaccaattaaaattgagcacatgcaatttttaaatcccagggaaaatcttttcctccttttctttttcttttccctccttttcctcttcttgggccgtcggcccagtccaccccaccgccacgcgcaccctcctccttgtgggccggcccaagccgcccctccatctctcctcgggacgccgacaggtgggccccacctgtcggggtcgtccccttcctctggccgcctgccccacgtcggcaaccaccgccgaaaccgccgtgcccacctccgccgctcctcccgcacccacgccgcatcgcccacgcgtcctccccacgtcgccgccctctccccgcgtctcccggcacatgcgtgcgctcgaaaaggggcgggattcgcattttgaatccccccatctcctctct

SEQ ID NO: 89530 - DNA, 1718 bp, Oryza sativa
tcacgcatcaacatatcatgagattattagtaaaagctaagtacaccgatccaaccatgcttagcatatcacaagactaatagacaactcatctttaatcgtggtagagaataaaagagtaaattaaagtttgtactatgtattcttcaaagttttcattttatatcattctttaacaattcttttcatttacataacagctaactttacatttcaatttggaccaccccataatatccatctccaagttcagtgactcttcactctgcaaccactccgcacactaactctctctctctcttctttttccatccgatagttagggaaatgccagatccaaaaaggagtagcccggatctagtatgtccgctttccgtcgggtcggttcctacctccctgagtccctgcaagcctagcacccccgacctcaacgacgaccataacaatagtgtgcatgacgatacagaaggtgcaaagacatgtcggaaattagagggtgtgggtgcgcatgcaaagatggagaggaggaacgatggtggctcatggagaaagagcggcggtggcggtgcgtggagcggcaattagtgactactaatgttctaaaaagtttatcaccgacacaatccctaacctagattgttgcattttttttctctaagtattactatacaccggtcatcataaaaaaaagggaattgctaactggtcgcctgctgatttatttttgtttgtcagccctttcttggcctattggattttgttcaagattcgtgcacccaactactgttcatgcatcccggcccagataacacagcccccgcgccgcatgtcacgtcacgtggtcaagcattgtttcaagcaaggaatccggtggcattttttgttgtccacgcatctgagaaaggagaggcagaagcagcgtcatcgacgacgacgccatagctccaacgcagctccactgcgaagtatgtcccccggtcgatggctctgcaagcttcggaccacgagggaggtgagttcccccaatggtcctctgctggagtttgggttatcatcagcgtcggagaagaagaggaggtcgccggagttagaaaagaagcacctagagtacgaattacgaagcatatccggagatccaggatccgcaagatttaggtatgcatttttttcgtcagaagctttatcagttcaaaaaaaaaaaaactagtactagctccttttagagtatcttcaccttccttggcgtaaaagaaaatctgtctcgtctcctccgctccttgcgccatctcgcggctgaacaggggaggggcgccgatttctccatctggcgagcagagcagggggaggggaggggatcctggtgagcatccacatcctcttcctgattcatctctctcccgccgcgactacttttgtctggaatttgctttcgttcgttaaccctagcttctcttcagagccttaacctttgtttgttcccccaaaagtttgggggttcaactgaaccccccatgtcccaagttggatccggcccctggaggaaggtggatgttagattgtagggtttcttacctccttttgtcgaactagatgcattgttgtttgctgtagaatggacccatgagatcagtgtggaagagtggccagtcctcgttctagataaatccggcaaccgaaagcgcgcatcacatatttggagtcatcttttctactagggt

SEQ ID NO: 89531 - DNA, 2426 bp, Oryza sativa
gttccatcggcattgctgctgccgctgccgctgctattgctgtgttacggatttggaaacatccattgctcaccagttcataggagcagcatcgatctccactcgctgctcgacttcaagcagggcatctctagtgatccaaatgaagccttgaagtcctggaacaccagcacccactactgtaagtggacgggcgtcatgtgcacccaaacgcgaccatggcgcgtctagggcttaacctcactggtctaagcttgggtggccaaattagctcctctctcggaaacctgaccttccttaattatctggacctctcctataataatttctttggcccgttgcctcttcttaaccggctccaacaactgaaaaaccttatcctaggaagcaacagtttgcacggggctattccagtctcacttacaaattcttccagcttgtcatacctggacctctccacaaaccttctagttggtgcgattcctgcgaacataagcttactttcgaacctagagtatttggatcttgatcagaacaatctcaccgggaccgtcctgcaaaccataggagacattacgtcattagaaatactttatctttttcaaaatcaactaagtggaagcattcccgataagatttggcaattgccgaatcttatgcaattggtgctcggtgaaaataatttgtcaggtggaataccacaaaccctccataatatatcttctctacaaagattaggtttggagtacaatatgctaagcaaagcattgccacctaacattggtgatgccctctccaatctcgaagtacttgggtaacaatatgtttgaaggtcaaattccagcttctttaggtaatgcttcagggctacaaataataatgttcttaaacaatgcattcgttgggaaaattcctcctttgggaaagctttccaacctaaatttcttagacctagggagtaacaggcttgaagcaagtgacagtgatagctgggaattcttacatgcactagggaactgtagttatctacaagatttctcactatcacaaaatcagctagaaggacatataccagattcaattggcaacctatcatccaatcttcagagtctcgtatttagtgcaaacaaactatctggcatagttcctctgagtatagggaaccttcaaaacttaacctggctagggctagatttcaacaatctgactggtccaattgacgagtggattgggaagctaacacaactcgtacatttaaatcttggtgagaacgactttattgggccaatccctccatctattggcaatctcaaccaattagcaacactctttctaggagcaaatggattcacgggttacataccgcctagcttgggaaaccttcagtacctagtcaaattggatgttagtttcaataatctccatggtagcatatatacataaggagttattcatcagtgtagcaacaatgatagtatgtgcattgacccataacgatttagatggtaatcttcgacaactctcagagctacacctttcatctaacggggcatattcccgacagtttgggggcaatttcagagatagaaacaattcgcacggaccataactttctcacaggtaaaattccgatatcgttgagcaacatgaagagcttgagcattctcaacctttcccacaacaatttgtcgggtaccatccatatggccatagataatctacaagttctcacccatttctcacccagttagacctatcggacaacaacctcaaaggagaagtaccaactaatggggtattaaaaaattctacggcaataccactcaacggcaattgtacctctgtggaggattgccagatctgcatatgcccccttgctatactgatttccagagaaaacaaatacaataccacttggtcagagtattgatcccagtatttggcatcatatcagttttattgttgtttcactttttactcatagagaggaagatttcaagtggaaaatatttattgcggctctcttttggcaaacatttatctaaagtttatgttgatggaaaatctgacgcaacacatgaaggtctgagagatctgcttaattctaatgctggtcctaaaatcaggtccagaacgtgccagttagtgtgatcctacgactaacaagatagataaattaaatcacaaggccgatcggccaaggggccgatgtgaaatcgtgcgtccagctaatgctgatggaattcggatcaatggctatgtagctgatgggactttagatatgtaatataaaacaaactataatatcatcggctgagactaaataaaatataattgttaataatcctttctttaataaagacaatcttgatagatcgtgctaaaccgagataatataagattgaaactaataatgatagacttaa

SEQ ID NO: 89532 - DNA, 1142 bp, Oryza sativa
agtactactattttatgcgccatagggcaacatatagaatatctaatcttcagttctacgagacgtacgaagatttcaagaaaaaaggactaaattagtacgggtcgatgacttagatcttggggatataacactatgactagtcattgattagttttaaggatcttcattaggagagcgattaagtttagatgagacaggtctaagatcagtgtagcagcttactgaaggtgcctaagtagaggtccttgtttcctgcaaccctccctatccttgcttgccatctcccatgctgatggtgcctgctcaaaaattatatgttaatctatattacaacattggaacaccaaaatatcactacaaaatttaagcatatacagttaacatgagccgtgtacatatatgttgacatagcttagagattagtagttcataatacatataaataaggacaacaagcacatctagtacattgcgtgcttttttgtatactactagctaggaagaaaacataaatcaattaattacctggttacaccacgatatttcgatgcaccacgagaaaatccactgctattcctgcatatttaattaatgaaatcatatctcagtgtgatagtctgatattctgggagtgataattccatatggtgaaacatcagttaccttcttaggtatgcaatatactcctgcctggtcatatgtttcatttcatctagctctttttcatagttacttatctgcagtgaaattttataataaaaaagggaaaatgcaatcaacaagtgcacaatttaatttttatatactgtattataagtggtgtgtagaaaactatgatctattaacaagctagctagaaaactaaaacgacaaacttatatgtttaatttcttactgggaaatttgttgttgttgttgtgccccaatacttcagagctgccaaatcataagctctcgctgctttatcctccttgtcatagccacctgagtagtcgtgatacaagtataatgattgtgcagtcactaatatagttatatacaatgaaaaaaaaactgaaggcgtttgcatgcataccaagataaactgcgcattgcggagcataacggtgtcattccggatagagtcattaggcgatggg

SEQ ID NO: 89533 - DNA, 5331 bp, Oryza sativa
ttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctacgcgttcagggggggtgtgcggcacaaccgcatgctcgaaaagatcgcttccaaagagccccagactactgcggagctttttcagctcgcagaccgagtggctcgtaaggaggaagcatggacctggaacccctccgattccggtgtggcagcttcggccgcccccggatctgctgctcaaacaaggcggcgagacaggaggaggaagaagaggtcggcctattccgacgatgagggtcatgtccacgtcgtcgagggcgtttcgctggccacccgaaaggggaggcctgcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctacgtcgacgacctcgtcctacgccgcgtccaaacgcgtgctggattgagcaagctctcaccaatgtgggagggtccgtatcgagtgatcggcgtcccccggccgggctccgttcggctggccacgggtgacggcacagagctgcctaacccgtggaacatcgaacaccctcgtcgcttctacccctagtgggggtcgggtgtcaggtcttgggctcgggccaaccccgcgccccccccccccggggcgtgcagggttggccgggggcttatcttttttctcttccgtatttcaataaaagcattttcgatttcctaaggactgtgtctgtgccattgtttccttttgaagaatcttggcttgaattagcacgctcgtgctcgatcctgtcctcgggggctcgggtcggctaaaatcgccaaacggggcccagaaccgagccgtgccccgggacgtggtgaactccgggggggaatcggcaaaaacccacaatcgggtcacccataaccctcggtcaccacgttcccggcctggccagcctcgacatgtggatctccccaggcactagccccgacccgagccatttgaggactaggacctgggcacgagcccttgttcaagccaagacacagaaggaccgaggcatagaccatcctcgtctcatacacacaacaaatagaattgacatagaaatttcctctttatttggttgcagattaaattagtctatacaagaagggggcccgaaggcctcggaagaagaaagaaaaagttattcaagattggcgggggcctgggggctcactctgacgcgcccgggtcaccagccttgtcgtcgctgtcgtccgcaccaccgtcaccgccctcctcgtcggagtcgagggcgaacgcgagccgaggggccgtaccctcgaagctgtggacgatgtggtcggcggcgtcccggacctgcgcgcgtgcgccgtcctcggttccggaagggaactcttccagcgctgcccacggggagaagtcagggtccgagaggcccccaagccgaacggcggcccaaggcccccgacggccggagttggccctccacttgcttgtccgacggtgtcaggatagcctcggggccactgcgggaaggccgcgcctgtcgccctccgaccccgaggtcgtcggcgcagaagccgagggcgccccgcgctgcctctcggaggaagagcgccctggagatgcggcccctagcgaagaggatcggccccgccgaaaggtgcagcggcccgtctactttgttagcgaggccctccgggacgccaaaacccgataccctcaggcccagaagatgctatacgctattctgatggctccgagaaaagcaccatcaccatatctccaggcgaagcaaatcggctcgcccagattcgtgcgctgttcaggtaatgtggcagtcttgaagagaccgcccattattgacagccaagttaccattaccgatgtgcatggtttgagaccgttgggtttttgcccaaccatggagaccggtcccacctgtcaccaggctttaggagtggcgtcatgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcacccacctcttggtctccccgaggggggggtcggtcggaccactcctgcctcgcccccgagggccgaggcgccccgacccctcgcgggttctactccgcgtgtatgggttaggtgagcacagcggggtctcacctaatcgcatttattgcgcctcggctaaacgtgtcacgccgcatgaaatacagtgcagtgcactcgattatccggtctgtgaccagtcacagaccggtcaaatcacgggttaggtggcgacaggcggtctgacgcacgcttcgccccatcccgtcaagacgagagcttctaggcactcgtccccagctggagctagcgtgttacatcccagagatggcacgttagccccgatcgatatatgccaggcttcatcctaaccattacaggcaagatgttgtgtgaagaagggcaaacatgcacgttgctaggctgacgcgtggtggacaagaatgaccgatttgtgaccggtctgacactgctcatgtcgtcagcgcacagccacgttcccacgacgcgcctgcccccggcagaagtggaggtaggtatgtgccgtcccatcagaaggacgttcggagggcaaccgtgcaaatctccgtccatttatgaagggaagaaaagtccagtttgaaaaggaggggtgcatgtggtatccccttgaagtataaaaggaggaccttgcccatggggaaagaggatgatcttttccagattcggaacctagaacaagtgagaggttggctcacacttggcccacttagataggagaggacttttggacacaaggccttctccagatccgatcccagagcgattgggggctggttgacactttgttacttgttcatacacaaatccaccaaaacacaggagtagggtattacgcttcccagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcaagttggctatactattaaacttgctctaacttgtgtatttgtatgccccttggattgcgtgatgtgacacttcaacatatgtgcaatgagtgtttgtaagctactattgtgttttcgtctatgtatctttaaggcatttggtaagttaggcataatatgcaattaatttacatatatgtaggttaaaatacttttttgtttttattaaatattacgataacaaaagaagggagtggaacaaaaaccttcaactcctttcaacaaattgaaagagaaaatcaccatatatctctcataagttttttttatctagatggccacccataatagaaaaagagcccccctgaagggagtggagatggttcttctgccattattgcatggagcgatgtcgctctaagcaaaggtgaattgctaaaaattgtcacaatattttaggtatttttttcaaatataaatatactgcattgtactataactgtattacacagctactacattataactatagtgtaattacattataaattttataaaacttatatgtacaggttatatgaaactaagttataatatatacatttattgtatagttagattgtaattatactacaattaaactacagttatatttgatagttttcaaaaaaaatgaggtgatttattttagatattaaattcttaagcgaataggtgaaaacgtaaaacttcaaggctaatgcaaaagcatcaatgtttcttatagaactctttaaagaaatctatccaatatgcacgtacaggtacatttgaaaacctacttgctatattctgaaaatgcaagactagaacagaaagtgtcaatctggtgtgaatctcactctgagcatattatattcactccactgtttatctttcttgatcattccttggtactataatcaaatgatccaaacccactgtcttccccgcatcactcgggcctctcctctctctctctctctctctcttctctctctccgtatcgagaaacgcccagctaaccccaaagagcgagaaaggttaaccctaaagaaaggtcacggtgaccccgaataaagtaggggagctggggttgcaagctgtgccctctacaaggacacacacccttgtcttccgggcatgcacacacacaccagctggggacggaggaatgaacagtgcctacacgcacgcagcatatgcagagagagagagagagagagagagagagagagagagagagctaggagaggagtgccatgaacgtttctacggaacatgcctgcctgatcagccccagcttcccgtcctctcctcgatccctcatatcacgccccggccggggagctagccgtgcatgtgcagagctccaggaccatgcatatacatgattacagggagaatgttaataatgctatctcgcttgcaactagctatagttagctaatggctaggctggtcattgggatataagtagctacaacaggtgacctcgatcatcataccatctgccaacaacttgctcctctatgagtctatctccgcaggtatagaactacaaattgcatgcttgccgtcatatccaaacccatcatgtgtgtgtgtgtgtattggcaggacttaccaacagtactctgcgcaagctttgtttgtcagccacgctattttcacattcctcgttggttaccaattacgctgggtagctctacacgtacgcagaagaggaataaccatatgcagcaggtctctctacctaccaacttgcgaatctagcattgatcaatgtaaatacacagggctagcttccgtgattctgccctgcagagagaggaaaatgtcggttgctgggcacagcatgcagattgt

SEQ ID NO: 89534 - DNA, 908 bp, Oryza sativa
gtcattcttgtcatgggatttgtttgacttttccgtttgctctttcaggaatgcacatggcttcattccttacaaattgcaagtgagcgctggacggatatcgacaagtctgcggtacattattaaggctaagctagctgctaagtattagaggggaggtgagagagagcgagagagagagagattggtgagtggggagtagttcttgtaggctgagtagtactagttttttcaggggcactgaaaaaagagcttgtagtttctgtcgggaacaccgattactagctgaaacatcatcagttctgttcttcttccattgttgattaaaatttccgtggtttcgatcttccgcgagaacacccagcagcagcggaacagatgagctgatagcttcttcgtcctcttcgctcgtgcatgtcacatctgcatgcctttgttctgctccatgtcagcttcagcgtcgtggtcggcgtcggcgtcggcgtcggcgtcgcaggcgacgtgctgccctgtcaacaagcatgtcgagttcgtcaggttgtcagtcacgcaggcaatcgaggcacgcaggccttgccggtcattgccggagcccggagacaccgacctgcctcgtacggtcgtactgtacactcgtactcgtgaccaggttgccggctcggcagacgacgctctctttctctctcagccaaggagtggtaggatatgctgctgccgctgactcttccggcatcgaaaccggacggggagccggaggacttgggagttggcagcgacgcacgccgctgccacggtaacatgcggtcatacggtgtggcgtcgctgcctcagtgctgcaggggcagcagctggacagatgtgaaagtggcatttgggagttggggaaatagcagcagagttggctggag

SEQ ID NO: 89535 - DNA, 611 bp, Oryza sativa
aggccattacatatgttctcaaggcagcatcacaatgcccgcatattgctcaagctgtatgtttaacatccaagaatatgttaccttcctaatttttaaaaaatatcttctcgcttttcttattagtgtgcctttcttgttctccataggctagagctgtccgatggagactaaaagatctgggtactgaagttcccctgtgtgtgcttgatttcttgtctaaaacagtgcatagctggtcagatgtagctgatgctttgttgaaggatattgattctgactgtgagcctgatagcagttgcctctctatgtcctgtagtactagtagtacagacgagttttcagctgaagggatgcattctttgcaaggtcaagctgtacatggaaaagatcatctatcagatgtttttatactgatagaaatgctgtcgatacccagattatttgttgaagtttctcaggttttgcagagggctttattgcgaggagcctttgggctgcaattagtagccatggtgttggaaagaaggcattctcacaggttaagtcttaagtctgggctgggactatggtgaatgattcacagaacaagcaagttctgttagacgggc

SEQ ID NO: 89536 - DNA, 3069 bp, Oryza sativa
tggggggaacccaaggcccggaccatcggacggccccagcatcgcctgcgtgtgatcggacggtggggagggtgggggattcgtggtaggcctaaaattgattttttttattttatttttaccccactggaggggggtggctcactgatgtcatgcatgtgcccgatctgctgtcgttttcactggaaagtactgcttctgagattttgctttgttgtttgttggatactctgtctggctccctgcgattccttgttcctggtttgttttccttctgtttctcctcctccccccctgttttcgcttattattttaacatatatctcattccttgttcttgacttttaatactactatcagcttggcaggttgctagttaatgtttcattcctggttgtgactttggtttgtttgaccagggattgaggctagggggttcatatttggcccggcgatcgcgctggcaattggcgccaaattcataccgttgcgtaagcccaagaaactcccaggtgagtgaggctcgctctctctctgaaaaagtgttgtgcaaatctgtttgctggtgatataagatatgattagctcgcgctggcagcctagttaagtatgcttagttaccttacctgtttataaaagagctgctctgttccattactctgacaacaaagctgtgtcactagtccatccctttttatgctgcccatgatgtaatctgaagagatatgatgtactttctgtctttgcactttccatcacatgttctattagagtatcagatagacacatactgtcgagggtctcttttacacattttgtattggagtatcggataaacacatactgttgttgttttttacatacgctgttgtgttgtgcaccacctttcttgtaaagtatgattgtgtttgccttgcttatcaaatcattttttgcagtaaccgccatccctgacatctgcttttaatttttttctacaaacgtgaaaggcgagtgatttctgagacgtatgttctcgagtacgggaccgattgcttgcagatgcatgttggcgccattgaacctggtgagcgtgtgctgatcgttgatgatctggttgcaactggtgggacactttgtgctgctataaggcttcttggtacgcactacttcttaatctgaaatgcattttaaatgaaacccttgatccattgtgatactatatgcaactagtagtatctcaatagagcttggcaaaaatgctgacaacaatcttgcaatgactatttatttttctatgtggcttctgtgaaatgcagaggtcttttccccgttcgcacattcacaacacgctattcttctggcctgtaacagtgaagctctcgattgtgccttgtgatcccgtgacatgtttgcagcaagcactagtgcttggcagtttgccacaatatcaaattatccagtaccgtgtcttgaaactgtgcccacactccgaacatagtttcttcacactattaatccaaatctatagtactgcaggaatagtgtctgaaataaatcgagtagtcatgaaaagtaataaccaacgacaggcatccgtacctgctagtggtgaccggtggaggaccatgatatcttcgttgcttataggcatactgttgtccttaatgcgatgtgactctataatcaagacaatccttgtttgaagatttttgtttggagagaatcttggctgaagatatgtcctatggagtttgcttgaggacatgatttgattttgacactacatgtttcgagtactcctgtcgtagtgaatccagtaaccccacctcattttctttttcagagagataaccccaccgaattactccaggccagtatgatttgtcaaaacacaacacaggctacatcacaaaaattggtagcggcaattttctctttgttactaacaaacaaagcacaatgataccatactaaaagtttggtagtgtcaaattttcactcttgctggcctagccttggcagttggcactactaaaattttgtagggtcttttcaactgtatatatcgtgtttttttcatgttttaggccatcagcaattgcatttgacatgcttcctttcttttttgtatctaaccaacctgtgcttcaactattaaagaaaaagttgttcttttttttagctttagactgttcgggcacttcactggatgaattataatatctttgtcccaagaacgaataactggattttggcacgactatcttacctagaaatttgctttccagaacgcgctggagctgacgttgttgagtgcgcgtgtctcattgggctcccaaaatttaaggtattcttattgtcacattattcacggttatccatatattctttgacaaacatttccgacatctctctacttagttgtcactttatgtagtattttacatactgctctggagcatggatccacattccaaagatatgaacgcagttccatccaacagttttgcacctgtagtacagtattaactttctcagatgctttctactctacctgacgtagcctgttagtgccatatagattggactcttgagccaatggtttgggtttagatagcggccaggaacaactttgccatactaaatagcaccatgtctattctgctccccacattgagatactcatatcagtaccagctgggcatccatagatttgaacaagaccactcgagaattggtgggtaattgttttttcttccaaagcaggactatagtccttttttaaaaaaaaataaataaataaaagaagccctgtttgtgctatcctaagaacatattcaactgtggctcttctgctgcatttgaagcttactatttgcatcctgcccctcatctgaaagtttgctagggatgaaaaatattcaggtaggagtaaaaccacagcactgtctacactagtttcatctggtcatagtgattattttgtttgagttgacataccttgattcatgttacaacttgcaaaatgagtgctacactgccggcatcttaccgaagtcaggatagatatcatgctggttcagaact

SEQ ID NO: 89537 - DNA, 679 bp, Oryza sativa
ccaggctccagccctacatctttacaccccaaagaaaaagcaaaaagaatgaaaggggagaaaaaaaaaaagaagaacgaatcagaagctctgttctcaaaaaaaataaataaatcagaagctcactatataagacaaccttttccatccttttaatcttttgacctttttacatgtttacatctaggtaacaacatctagaagatacaaacatccatggaaaactgcagccgcgatgtcctaactcctaagcatattgtcagaatcagccattaactgctgctaattcctgtttgacaagtgagccacctgtccctctcatcattgcttatgtcagtctcgtaatgagatctcgaacaggtcggagtcggcgtccgggtcgccggccgacgcgccgccgccgccgccgttctccttcctgctcttgctcatccgcgacgccgtctccagccagccggagtcgacgcggcccatggagaagaggtcgccgctgtcgtcgaagtcgaggcccagcgaaccgccgctccggccgtcgtcccccgccgacgcggcgcggaggaagcacgggttcgccgtgcgccgcgcgttcgccggcgcgtaccggaacttgccctgcccgaggttgaccagcgccatcacgtcgaagctggaggcgaggaccgggtacatcggggtggag

SEQ ID NO: 89538 - DNA, 3665 bp, Oryza sativa
gcatcggcaccaagctcgagcttgccacccaagcgatatagcagcttcgacttcaatgaaacaataccttaatgccaaaatgaacaaatagatccgacatccacgaaggatattagcccaagctaccaaagaaccacttcttacacacagctagcaacaacaaccatataaagagattgtaatgtgttgtcgttgccaagttttgtcacattcctacagtgaagcggcttctactctactcaacagtaaccaaatgacaatgatggtcacccgccgtaaagcaagaaacgaaaccaacgcggcgaaggcctcgtcaaacaccctaggcctgtagagcttcggttccattgcatgagtccaccaatgaccacaattgcatgcgaaaggtttttggtgctaggaggggtcagcgccagaacaatgcctccaaggaggggaatgacgcctaatggcggtggcggcgtcatgccgtcccatggcctggcaaggcttcgctagcgattaccaatcaagaccccacacaaccatcctgcacaacggccattgttggactaccgcgccatcccttcagcgctcaagcccagtccaccaacccgcaactcaagctggctcgcagggctaccggatcagccaccgccatcccatgttgcacgagccagcgtctccccattttctcgaagctccctatgactaaaactaaagcagtcgagcatagaaggggaggagccctttagagaggaggactcttgcctggcaacagagaagatgaactttccaccacctaaccgcttccctgcttgataccaaaagccgttgaggtcaccactggcaactgacaaccaccgctggcgcttgggtaaccatgtgtgacccacgtcagcttcctcctcgtgcaaaccaccgccagccacgacctcacactgtgctagtcatgttgtcaggcatggccgcgtgtcgctccggctaaagcccctctggctcctcaatgcatgctaccggtcatcggagccctcttctgaacagtaccactggctttccctcttcgccgccccgtccgtggcagccgtacgtccccaaggccacgagctccagcctcttacctccagggggggagggggaaggccccgccgtcgtccttgcagccgcgtggttttctggctgcctgcttgggtggcagtgaggcgaagaagggaggaggtgctgggtggcggtgggggagggagacaccacccatgtcgcccaaccctagagcgacacgagggccccattcctggtcactccgcggtagcaataaagttgcagtggaaactgggcattaggacaataatagaaaattggcgtgccatttgacgcgccttattttagttagcccgtttgtgcaactgaagaaaattaaatattttttaacccctagtagataattataaatccattgtttttgtcaacattgtttagggcatgacagaaatttgagaacatgcaaaggcatgaatcagcttatagagcacacaaccatctgtgtaaattgcaaaagtcagtcattctattttgatttctataatgatttgtgattaaatttcgtttgtcttgtcatttgatttttttattattaattattctagtagcatttttgtaacgacaaatctttttggttgcttcaattatctaccacaccaatatttgataatgccaaagctcatagagcagaacatcgtctatctaatttataaaaaaaaatatttttttctatattgatttgtgatttaatttcttttgtatggtcatttgattttttcttttggtgagaagccttttttttaccataaaaattttctgttggttcaattaaatggtacaattttgagagaaacaaaagtcatgtgatgttttttctttgtgagtagccttttttttaccaataaatattttccgttggttcaattaactaccatattgtaatgctacaattttgagagaaacaaaagtcatgtgatgttttgtttgatgccaaacttttacagtgggatttgtgactgataatgtagcacagttgggaggccacttgaatctatataaggtgcttaaatcttcttttgctttattttttttagaaatggatccttggtttgatatccatctatatatttttcattttaaaatggtacttttcaatgtattgatacaacaaatctactactatatgttataaaatagagtatagatctttaacttagaacttgtatttctttgaaatgttgtagacccaaccatctgtttcagatatcagattaggccatcacctccctagtcaacgtgtatgacacggcccagctgccacgttggccggtgggaaccaaacctgtgaatccagattaaccagtcgagaatgggcctggcattatcaactcacaagagctttctagagattctggtaagtagatatcttatcgacacgtggcaaaattttggagttgttcagctaagttatcaggctgccacgtggcccaataacatgctagaattctgaccctaaaatcggtataaagatgagggtggcgatggcggatggcttggatggggagaaagcactagctctcattgttgcctcctactagggctcgagaaggcagagagttctgcgccacctctaccatgaccaggccacatgtcctcaatgccgtcaagtggcatcaccacttgccgaagaggcgataggaaggaagacgtgagaactgtggagccatgggcatttctaacatttaacattatctctcttctattcaatcaaaaatgaatattcaaatagatatacgttgtgagagcgttttccccaaagattgacttttgccatatctagaagttagaactataaattcaaaatgtcctaaacatttttttggaaatatatttgatgtttcgcataaaattaatttgtgcaaacttttgaaagttctaaaatatttagtttaaaaaacatgcatgtatatttgttttgaaaataatcttcacagtctcttagacttagattatataaacttattgtaagatgacttcacatatattattcacaggagagtatatcattactaaaatctagtaaagccacatttttttatgacaataatgttctacaaaaatatacattcattaattttatgtaactccctaattatcaaatatattactttgaaaatgtgtatagtgaaatcttgagggctcttttgaaacatatggttagaaaaaatggaggaatagaaggaacatataattttgacaggaatataagttaaatcagagaattataaaacacaaggaaaacataggatgcttgttgattacgtcacaggaaaatgtaggaatctaatgagagagattgaatcaaagaaaatcttttaagatattagagctcttactaactttctcttttctctaaaatctctataggattgttcattcgataggaatctgaaagaaaatgatagtatgtaattatttgtatcaaagttattcataattttttataggattttaatcctccaaattttatttattttttatacaaatcaaataggccctgatcaaagttactactccttagagcatcttcaacagtctctctaaatttgactctccaaatgtctatttaaccaactctccatttcatt

SEQ ID NO: 89539 - DNA, 635 bp, Oryza sativa
agtactaatagcagacagtttgttccccgtcaaattggggttgaaatgatcatccataccccatctcaggcccgtccctggggaatgcccagctgaattcaatggctcaagttactgcgaccgcgaatgctcgggtgctcggttttcctgccgccagccgccatggtggccctgtaggatcgcgtgctgggccggcgtttctgaatctgcgtgctcccgcacttcgtcatgacagtaaaaagcatcctttgagaggtactgattttcttgcatatgtgtaattttgcattggatgacaatataagctcgttactgcccatacactaacaagtggagaaaaactgaaaattgttatgcatacaggggtgaaatcctggatgatggtctttcaggaaaatgattgttctgagaagttttatttttattgggatacaagtttacaattaccatagttatagtgaacgcacacttgatgtttgtagacttgttactctatcttaaacggtgcatcaattgtgattaagttacttatcagcttcttttttctttttttaaggtgtatgaattcatatttataacatgttatttctttgtttcagttggtgctgcctcttcattattcacaaagtatgatc

SEQ ID NO: 89540 - DNA, 3532 bp, Oryza sativa
  unsure (1)..(3532): unsure at all n locations
ggtggtggagggggaggacgggcaggcggaggaccaggaggagaggtgggcgcggctgctgccggagctgatgtccgaggtggtgcggcgcgtggaggcgtccgggggcgagcgttggcccgcgcggaaggacgtggtctcctgcgcctgcgtgtgccggcggtggcgggacgctgccgtcgccgtcgtgcggccgcccgcggagtccggcaagatcaccttcccgtcctcgctcaagcaggtgaggaaaggggggggggggggtgatgcccttctgctgttttgctaagagctcctatccctcgattgatgggggcttctggccgctgattcgaagtatggtggtagggagtggaaacccccattacgtcgatttgttttagcaggtgtcgttcctagatgcgatttgttatgtctctggttggtgatttagagagtcctctatgcttttgattgctaaatttggagcctgcgtctttaggttccctcagttctggccataggatgctgagatcacttgctcatgctatttttagaggattatttaatttttgaggtttacaaatttaccttttttattcgcgatgtttcgtgggattagttaatttgtttatgtctagtcctagctatttgtttttggagtaagttaactttcaatcgattttgatactagtatttttttttataagagtttgtggatttaacttaaaactaggctcgggagcaactagatttagttagtacaatggatgatttatatcgcacttgttctttttatggctttggcaaaatcaccacatcgttggtagatagcagtatagcacactggaggcttggaaggaaaaacaaacccgaggagggtcgtccgctatgaatgaatagttggaaaatcttatcaccagcagtttgaattttcatgcttttggctacagatttgatgttaggaccatattccagcatgtatatagtctagctttacttagtcccgttctaagctccaacaacatccagatttttcctcgatttccgttagcacgcttttcaaactgctaaagattgtatttcatgcaaaanctttctatatagaagttgctataaaaaatcaaataaatccattttttaatttttaataattaaaacatcattaaccatgcgctaatgagtctcgttttacatgcgcacttaatcttcatccaataatcagattcgaacggggccatatgtgtttagctatttactatcctatcacacagagggtgatttcacttataagtgggagtttagtggctgaaattccccatgagatgagtagcatagttttgttttgggtgattcgtctacgtaggattttagttgcagtcttgcagaggagtgtcgtagttttgatacacagtatttgtatgcaaattaatcggagttcttacaccttttgtcaagcagccagggccaagggagttcccaatgcaatgtttcattaagcggaataagaagaactctacgttctacctctaccttggtttgacaaatggtaagtgtatgactgtacgtgatgtgatatgagaacttccttgactctcatttattttgtgctgcatatgtgcaggcatcaatttgattatgtgcatctagataatcaatttgatttgccatctcaatgtaaggcatgtgacatgctgttttatgattgctgtgcgggttctgtttttctaggaatttgttacttgtctgtggttgacacttgatgcctagcagtagtcaagttgaatgcttttagatttaactcagattcgttgtggctttaattggagatgcatcgcttgtttctcgtagttgatggcttgatgttgacctatcaacttttggcatgggcagtcccatgcacatttgcttcctggctttcattttttttctatagattcaaattatctgtcaaaccagcagaaatgcacagtatgtttgcattctaggaccatgtgatattttgcatttggatcttttggcataattggtatgggatggtgggaggataaggtggaggattggagcacctaatggattagaacctacagcattttacttgaattaggaactaatattgttttgtacctgcctattttttgtgtagcaactgataagaaattgataagagatgccccttcgggattatgtactatgttatgtcctcatgggccaatgggcctagaatatatgggcccgaatatacttaacactgtttatttatttggattggctagtttggacataattgttgaagggtttagctgaattataccaaagtcttcgtgtcctgcaaatagtgattagggtgactggaagtctacttgttccattacatttgatggcctgcttagtcaagtgttttcaaatttcttttattttgacaatcagatccaacagcactcaaattatgtatctagaagcaacatttttctctccttacaggcttacactcagctgttcaagtgtaacatctaacatgtgcggatatgtgttttttttaaaaaaaagaaaaagaaaaaggatgggggttctgtcagttacaccgtatatttttccttctggtttttgtaccaactgcaatgccatatggactttttcaccatcaaatgtgcttgatgattaatatatactttttgtatatgatagcaactgtggataaagggaagttcctcatggctgctagaaggtttagacgtggtccccataccgagtacatcgtatcccttgatgctgatgacctttcacaaggaagcaatgcatacatggggaaactgaggtgaggttctacatggctgcatgttcactcttaatcattcttgcatattctgttattcatcctgcttagtgctaacaaattggttgcagtaatatatttacaattagggaacatgctaatgcactaaaaatatgtatttagctgatctgcagatgttttttttttaaaaaaaattgggtacccataccataagacaatataagccttctgagttctaaatagtatctgtttctttactatcttgtttttcaatgaggtattggtctgttttatagttcaaatggtactccctcgttttttatatatgacgcttgttagttcaatattgaattaactaacgtcgtatatatataaaaaggagggagtatatccttatgttgtaagattgaaccccttaacatggtggcatgctgtgatgccccaaggtctgaactggttttaagtctataatctaaattctaaccccattttggatagagtacacactcacaccaacacacttgcactttcatcctttgtgttcgtgttcaagggtttggttgataccttggactttttctgttttgagggattgataccttggacctggtaagcctgcaaaagtaggccttgtttgggaaagacccggcccatcccctgggattttagccttgccaaacaaggccacaaggtgggactaattcacaccctcatgtgtggacttactcaaaccaccgtagggtgtcacacatgcct

SEQ ID NO: 89541 - DNA, 2645 bp, Oryza sativa
atcgagtcaaaaggcaattgcagacaagtttactttcaatattttcatggaggcctgtgctgaagcaaagaggtggaatgattttgagtatgcatttcgcaaaatgttatctagtggctaccactttgacgaacgaaggcaccttcgtatggtgcttgatgcatataggaacgggaaggtgcttatctcatattcctaactctttaactatccatgaatctccgtaagatgtagcttataaggatagaatattcattgtgcataatctttcatatctgaagttgaagatgtttggttcataacataggtcatgttattgcaatgaatggaggatgtttgattatgctgtttttcccccatatgtatgggatcataagattgcatggtgactgatcttagtagttctgaaatctatacatgtgggccttttagcttatatttctatgccctcagagagaacaaacctcactagatttaaaaggaaatttcaactacaagcacagcataatagtactagccccagtttggcaacaatttgagccaattccttcagtattttatggcttactgtcaatatgaactatgcttagagttcagattttatggacaatgatagaatgcaagatatatgatcattttcccattaaactgcttcgttaattatttggtgtagctattcttagccttactgcctttcactattcaggagcagttattggaagatgtatgggactacatgtgccaatatggccgagttccgcctgcccccatgataatggaaagattttgcctgaaactgagacaaggggacacagtggcggcgatgtcctgcatcaatacctttcaggagagcaagatacgcaatgtttcatccatgtcctggttcaatctgctgaaccgtaatggggatcgcttgaaggaggatattattatcaagctacttcatgaactcaacaaccttgtaagctcaagtggtcactctgattctttgtatcaaaatattataagtagctgtacagaattcctttctgtttccacctctgtagaaaaggcgtcttctgatcagcagatgcttccctgtacgtcatagctactatatattaatatgccattatctaaaagaaaatcagagtttggtcattggtcatttggttcgtgctccaaaaagtttgatcatcaaatccatcggtttgctcactgcatcatactattctacgaggataagtgatcgtatgcatgtagcttggtgggctagttatttgttgggattgcatatcggcagaagtaactaactctgaattggtcgtcatcctgagatgcatggcacttcgcctcgttttaaacatcacctactccgctactcactacccgtgtttctcatgttgatatcaattttctcatgtcagtatgtcagctgcttggttaggttctctttggttgttccgacaaaactttgatactttcagctggtataccaaagaacacatggagaagagctacaggtgtgaaaatttctgggtcaattacacacatagatgtcctcgcataatgaatttacgcatgcagccgattgggaactatcgagcctgacgagtagtccaacaccaggcacttgtttgctcgcacgttcggacaggtctgaatccatcctcttgtctggactctgaagcctccatcttgcgacagtcgcctgattggcgctaccaaccgcgcgagataaggttagctcaactttggagaagaaaacgttgcatctgatcgtcgtgtcagtctccatgagcagtgtctctgtacccctcttgttcttttgataaagaaagaaatttttgaagcttcgtggatatttctattttccgtcaggctagacatatgttaagattaactataagatttcggtaagaatttcaaataaaacactctaattttgttagatgtttgaaatttttcctggagaatatatacaggtgatcagacagcaggaggaggatggcgcgcacgacgaaggcggctgcgcgacgtgggcgcggcgacggcgtcgtctccccaacagaagaggaagttattattaagctggcaaagtggcaactgatgaataaaacagaaaagaaaaaaaaagaaaagaggaaaactaacagacggacagctaggcccgggcatcaaataaaatcgtcggaaaaaatcaccaggaataaaaaaattccccttcctttgcgcgtcccacctgtccccttcgtgggccccaccaccgcacgtctccaccttcccccacctcgccgccggccaccgcctccgcctccgcctccgccgccgccgcctccacatcccattccccgtgccctcttccccaacccccctcgcgccggggggcctctgcgtgaaggaagagggcgctgcgacgccgaccgcgcgccggtaatgagctacccatccaccaaatgcgatctgttcgttcgtctttagatgaatcgatcgaggcttagagccttagacccggttttgctggccacttcttcgttatggaagagagagtgttttatttttgtttatcgttttcgagtgcaagcatttggcgccgctaagaccccctgattgcaattggtcactaaacaaatgtcaatgtgaggaggaggagggtattaacccta

SEQ ID NO: 89542 - DNA, 539 bp, Oryza sativa
agcgagccaatctattcatacaggtacggagtaaatgtccagccaaaagtaaaaaaggtatcatcacttcatcaagaacttatgtacaacagactgccttctgctttcacttaaaaagcaaaagttttacaacacaatttccttctcggagctaaatccatttggtaaaatggtacatttcccgcacaagaacaggatatgaatagtaccttgatatccagagtaaaaaggaaagaaatgaaagaagaaaaatgccgggaacaaccacaacggcatgcatccacaaccacaaccagatggcaatatgaggacatcaaactatgttgctattcacaagctagcttggtaccaaagctgctgaggctgatagcaaaggcttgaaacgctgagagtggctgccggtaatccatcgtgaagatattgtcatcgaccttaccaaactgcaacagaactgtttcctcatccttcgagctagcaggatcattgggatcagcagcagcaactagttggaaattcttgcagatgcaactgtcacccgc

SEQ ID NO: 89543 - DNA, 1071 bp, Oryza sativa
attctagcatttctcacattcatatagattcattaacatcaatatgaatgtgaaaaatgttagaatgacttacattgtgaaacggaggaagtatgtctttaggctagtattatgtatagctttcttgtttttaatcaatatgcaatttcgtataattcacagtgacttgacctactatctctaataattggctatatcttctttaaattaaagaccggaatgaattatattataaaaagaaatactacaaccagcgagggaaaaaagttggtaaatttagcagaaaaactattgcatgagtcaaagcatatgaggtcaaacatacaagcaaataagctggagagaagacaaggtcgatctggagagaaggctggagagaagacaagggccctatttggatctaagggctattttttagccctccctcaaattgcccaaatagctcaaaagatccaaaagggtgagttatttgagggctatttgaaaaatagcccacccaaaaaaaactatcctacccaagaggtgctaattggagctatttgaaaaatagcccacccaaaaaaaactatcctacccaagaggtgctaattggagctatttgaaaaatagcccacccaaaaaaaactatcctacccaagaggtgctaattggagctattttgagtagggcccactaaaaggtgtcttttctctctcccagcgcacgggatcagaaaacgcgacctcctctctctctccgtacgaccgcgcgcgcaggcgcggggcattttcgccgccgccgcctccaccctcgccggcccccaccagcaccgccgcccccacctcctccccaccaacgccgccgcctcaccccagcagcgccgccgcctccccccaacagcgccgccgccccacctcctccccacgaacgccgtcgaccccgctcctcgccgaccgtcaaccgcgtcgccgccgtcccccactcaagccgccaccggccccccactgctcgatttgttttcttgtccatggagggtggtggcttcgatttcttctccgaagatccaaatcccagcgtctggcacccgtcagc

SEQ ID NO: 89544 - DNA, 648 bp, Oryza sativa
aagtaatgctggttcagaaaactaatggggaaaagatcaatttggacatttgtatatgctattatgcttacaaggagcatggcgtcgagttttcgcaatgccgggatattgatgagaagatctctgcgctgctgggtacccatcacctggttgacaacaaggacgaaaatgaagcgaattgcacgatgaaatagtaatgaggttgcaacgatcttgtggatggcctacctccatgctggttccatccgtggacgcctgttgcgaagggacgaactcgacgatgtggtcggtgaccgacagcagccagtcgatctccttgttccatcgagctctccggtcggcagacatgggctcgagccggcgctgctccccgaataccgaagctgcagattttgccacggtgaagaacgggaaaaaaaaacatcatgacaggcaagaacacaagagatttgtagtagatagcatgtgatgagtggtgtgatactgacctgcgagatttgtgatggcgttggagagagcaagagcggaggagacacctttgccggtgccggacatgtcctcgccgagcagcagcttggcgaacttctccttcaccagatcaatctctgcaacagagatcgaacgatcgatcaaatcaatggcgaaact

SEQ ID NO: 89545 - DNA, 659 bp, Oryza sativa
tgtttcagtcatttaaattaagtgctttctgatgcagagataaaaatttgttagagccttctagcccaataaatgaaatttatgatgactgctacaaccactgcagttggataaatcaattcagctcaataattatggcttgatagtccccacacaaagatggaattggcagttaacagttcctaatgcttttgtcctatgttctgcaggcgttttggtacatggccagtagcaatacatgttgggacaaagtacagagtggttctagaaggccccgtttgtaagggtaatcaagtcactggatggcatacaaatcagagaaggggtgtatcacgtcgatttccaattggtttctctggatttgcttttaacagcactatactttgggatcctcagagatggaacagccccactttagagtctattatagtccattcaggtggcagaggtggcttgcaggtgagtttttttagtatttatgtgttcaagcagttgaaaatacgttttcaataagctgtggagcttctgttgtctgatataaactgaaaccgacttcctaatttctgctttacaaagttttttatcagaatgtctatcaaactgtattattatgattgttatcctagttaaacacgccctttcaagatctggtaagctcg

SEQ ID NO: 89546 - DNA, 656 bp, Oryza sativa
atcacaattgagcaatatgaagtactccctagttcgtttgcacaaacactttagttgtaatatcagactacatgtttatgctttcctctaaaccgagtccttttcgcaggtagcagacatgagtgtttggcaagaagtgatttctaaaggaaaaatgcccaagaacgatgacattgttgatcaccatgagcctgtgtctgccgatccagctgggaacgtgtgcagttttggtctactcatgctggaaatcatctcaggaaggcctccatattctgaacacaagggctcccttgcgaacttggtaaggatgacaattaataaatcgagtgtagttactaaagtcgttgcaacttccacaaaatgggatcttgaagcaaatgttgcttcttctttttttccgtctggtgacaggctatggagtgcattaaagatgaccggaatatatcatgtttgcttgatcctaccttgaagactcacaaagaaaacgagctagaaatcatctgtgagttaatccaggagtgcatccaaagcgacccgaagaagagaccaggcatgcgagaggtcaccactagactgagagaagttctagcaatctcaccggacgcagcaacgccgagactgtctccactttggtgggcagagctcgagatcctttc

SEQ ID NO: 89547 - DNA, 2214 bp, Oryza sativa
ctttcctggaacagattataaggagtagaaggatgattccttgaatgacaaaacaagagataacgtcggggccgacgcttattttatcggaatgattccatctacatccagtcaccatatctatgattaatcaaataagcaagagctccgtatggtacttgacttgtgttttctatagataatagttaaatatatggtttaagggaattcgggtttttatgttttactctaaatattccttatgttattcatccaaggagtgggctcgtgatttgcggattggacaataaacgaatctccacctcaccaccaccagaggggagcaaagaaaatccaatggccctcaagaaaggcagcagcagtggcttctctttttggaagcttgcagagtgtgccatggtaggaggcgacggggggcacaatgaggaaggaggatcacgatggcctggagtgaacaggctttttgtgcctggacctaccgacatcgggatggatgagggggaatgtaaagaagtataatatgttagttagagataagagtcaaaaataaattatagagataagatatattttagagatagaatctaagatagagtcctagagatataatcctagagataaatctactcttacttgtattgtactctaagtctctatcccatatgtacttctatatataccagaatgattgtgagtagatttgaaatcttctatttcttcatcttcttcgagtcaccatcatcgattgcatctctggtggacggtcctccacctggtgcctgcgttcccttctgtgtcgtcccttgactctcctctatttcctcccgcagtcatagcgggagtgtcatggacgatagcggtgacacggacgctttgactggagtttccgtagatgattcttgttgtagacattcgtcgatgtaaccgatcatgtagtagccgtggtcgtggtagtcatggtaattgatgtagccgcaaatagccgaaggcgaaaaaaaatatttacactatagtgtgaagacgaaactgcaattgtgagtatcttgcaccctgtagatgtcagaggatgccattggggacgtcttgcatatgtcagaggacgtcgttggtgatgaggccaccacttcggttggtcctttcgcaccgtgtagcagtcatcacaaaagtgatgccgagttgatgcagtcgttgttgtcgtagatgacgtgatcgatgccgtcgtcggtgacgcggtcgttgcggtcgtaaaggacgcggtcgatgtcgtcgatgaagcgtcttgcagattaatctgtcagacgacgtgagatgtccatcttcgtggacgagtcggcggcggcatgttaccatgttgatgaagaccataggagtcgatgtagtcgtacaactgatgatgagtattgtccgtgaagaatccgaagacactgtgttgttggcgcggagggagtcgatctcggcgaccactgatcgcccggccgccgcaaattcatgcatgtgaatcctcctcgggctcggtgcatcgtgctgctgcttgcctgctgctgatgtgtgcacgcgctagatgcctctctgattcttgctgctcgatatgacgcttgaattggcttatacagattgatggacaatggttgcttccgctcaggaggatcgcttttatgttgctaatgaagaaactaatctaatctaatgctaattaatggaattggcgctgattaggcacttgcttcttcggctaatgattgaagaggcatataatggcgttgccacagggggaggcgttgccccagggagagcttatggattcctctagtctccctggggcagcgcgaaggatcggtcgacgctagtctatagctctgataccatgtgaaaaaatctatttgttgtattatgttgtttttatgatatattagatcgaccctctcatggggtatatgtaggagtacatatgggatagagacttagagtacaatacaagtaagagtagatttatctctaggattctatctctaagactctatcttatctttaggattctatctctaggatatattttatctctataatttgttttagagatctctataatttgtttttgactcttatctctaactaacatattatacttctaacagggactgccatattccggcattcttaggtggcatgtggaaaggactttaattaatgacatcggtgacacctgtggacgct

SEQ ID NO: 89548 - DNA, 696 bp, Oryza sativa
actgctaccagttgtaataaggggtatccttccagacaatgtccgggcaacaataacaaagctatgtgcattcatgaatgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatacttttcccgcgtggctgcgacaacatgtgatgggtgacgagtcaatgaaccaacaacttgccttcctggcgagggg

SEQ ID NO: 89549 - DNA, 570 bp, Oryza sativa
gaattatagaattaagcaaagtatttaatgaaattttatctggcccaattttatattggaatttattaattaaacttagattttcttttcaagacttttaaaataaattctagaaattccatttaaacaacaatttatatattttgaattttcagggtgtgacagggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaaggacatgtctagcaaaggaaagaatggcatagggcctgatgagcctaagcgtcaagt

SEQ ID NO: 89550 - DNA, 1319 bp, Oryza sativa
agcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgagtttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcatcgagtacgtccgttttttgtccgctccagggtaggatgatgtaccgcctgcgccatagaataatggcatggcttgtgtctcgtagatgcgtctcaccgtctcctccagggtaatccagctcggaggctcccatcggtgacgtcgccccttgcggactcatacgtgcagacctgtgcggaacgctatgcggaggtaattcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcctcttgcatgttgagttcgtagctcgatacccggaactctaggtctgcaatcttcgcctcggtatctctcttgctcctcatccga

SEQ ID NO: 89551 - DNA, 6495 bp, Oryza sativa
ttgccttgggcgacggcccatccaagaccacacggatcggtggtcttctggatggcaaataggaagacgcgctcgtctccttcctgcgggcaaacgctgacgtcttcgcatggaaaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcaaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagattcgcatggctagggaggatgaggagaaaactgcgttcattacccccgtaggaacttattgttatacgtcaatgcccttcgggttaaagaatgcaggtcctacttttcagcgtactactcgaatttctttgggtagccaaataggacgtaatgttgaggcttatgtcgatgacttggttgtaaaaacgcgcgaccaagaaactttactttcagatttagcggaaacttttgagaacctccgctccgcccgcataaagctgaaccccgataagtgtgtgtttggtgtgcctgcgggcaagcttctcgggttcttggtctcagcccgaggcattgaggccaaccccgagaagattcgagctatcgagcggatgcgcccccccagcaaacttagggatgtgcaatgcgtcactggttgcatggccgccctaagtcgttttatatcaaggctgggagagaaggcgctacccttgtttaagctcctcaagcgctcggggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatccccattctgcgcacccccactctatgccgacttggcccgggagcaggcagggaggagaggcccccgagtcgaacggtggcctaaggcccccgacgaccggagtcggccctctgcccgcttgtcagacggtgccgggtgcccccgaccctcaggaaggccccgaggccactgtgggaaggccgcacctaccaccctttgaccccgaggctacccctgtgctgattcaacccgggagagagcagggagaagaggcccccgagccgaacggaggcctgaggcccctgacgaccggagctggccctttgcccgcgtgtctgacgacgccaggagcccccgaccctcaggatggccccgaggccactgtgggaaggccgcacctgtcatcttcggaccccgaggtcatcagcacaggagacgagtgtgccccgagaggtcacttggacaaagagcaccccggggatacggcccctagcgaagaggatcggccccgccgaagggtgcagcggcctgtttactttgttagtgaggcccttcgggacgccaaaacccgataccctcaggcccagaagatgctttacgctattcgggtcactgtggttacgtcttaccccctcgggcaaatcttgcataatcgagagggtacacgacgggtggtaaaatgggcaatcgagctttctgaattcgacctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctctccgaacggagacgtcctcagatacttggtccgtctcgactttcgagcgactaacaatatggcagagtacgagggactccttgccggactcagagtggcagctggactggggatccgccgcctcttggtattaggcgactcccagctagtcgttaaccaggtctgtaaggagtaccggtgctctgacccacagatggacgcctacgtacgccaagtgcggcgtatggagcgccatttcgatgggatagaacttcggcatgtacccagaagggataacatagttgccgatgaactctcaaggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacccgaggaccgcgaagggagtgaacgtgtacaacgcatttccaaacgctacgtgctggtagaagggaccctctatcggcgcgcggctaacggaatcctcctgaaatgcattcctcaggaacaaggcgttgagcttcttgccgatatccatgaaggcgaatgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttatcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggaggggggggggtcgggtgtcaggttttggctcaggccaaccccgcacccccctcgggtgtgcaggattggccgggggctaccacacatgcacatatatccctttttcctttatttcagcatttcaataaaagcagtttcaattttctaaaggttgtgtctgtgccgttttttccttttgaagaatcttgacttaaaataaggtcactcgtactcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgcttttcgaggactgggacttgggcacgggcccttatttcaagctaagacgcaaaaagaccacggcacagatcatcctcatctcatatatagcaaaataaaactaacacaaaaattttttcatcatttctcattgcagattaagttaaattgtacaaaaaagaggcatgaaggccttagaagaaagaataagaaaaaagttaagattggcgggggcctgggggctcattcaaatgcgcccgggtcgccggcctcgtcgccaccgtcgtcctcgccgctggcgtcgccctcctcgtcagagctgggggcgaacgcgagccgaggggccgagccctcgaagccgttgacgatgtggtcagcagcatcctcgacacgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgcccttgcgtccagctccttttcccgcgcctcgaggtcagcagcccgctgctccagtgcggctctctcggcgcggacgcattcgagattgcggcgcgcctgctcctcctgcgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgcgccgccagcgtcgcctctcggagaccagcggcggcctcgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttgggcccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcggcgcggccccctccgggcgccgactgctgg

SEQ ID NO: 89552 - DNA, 1882 bp, Oryza sativa
agtcaaacattcttaaaaaagtcaacggcgtcaaacattttgggatagagggagtatattgcaagaatgctttcaaaataagtttgcatggattttgcaggggagccaaatgtgcatcccgttaaatcaagggcagaatcgaaaggtatccatcccaaaggttcagcagcaggtgttctatttcacatcctactcagtaaattagtggtcacttctttcctgatgcctcatactcccacacatcctactctgatgcaacatatacagcttcaatctctatttgcttttccattatcatgttagttttatttcgcttgctagtcgctacaaaatgcgctatatatatatgcaccagaaactgcaatgtctctgacggctaaaaactgtcaggaaaaagcaaaataccgtcaggaaaataggtccttacgtgtcatcgtcaggaaaataccgtcacaactagcttgtcggggaaaaattaatttgcctgacgtgtgtccgtcaaggaaattattcctgacgtgaatgcacgtcagggttaattttcctgatgtgaatttcacagtcagtgatatttcccatatcactgataggtttgaccgtcaaagatatttttctaatttttctgacaggtacaaccgtcaggaaaattggtcatccgctattgtgataatttaccatatacagggatgatccatatatatacattatctaatagcaaaaatggtcattatgatattcatcacagataacatataaacagctcaaattccatatttcattcagaaaatagaaagatcaagtccatcatagaatagttctagttcactatttcaacataacacacaagttgaacaactagagtttgcatggcctaagacacctaatagcacgtactttcaaagtctcacactccatctatatggttagaaccatatagacaaaatatccaaaagcattagtatgccgcaactccacattggtatatcaaaaaccttagcccatcttgcatgacatgtgctgtagcagcatcaaggagaagcattcaaacaaccgatacaattgttggtcgatgttgttactgccaccattgcttgaagcaatatcacatccatcattgttgtggtagccattgcagtcaacttgctgtgagcctaaatgggaggaatcagttccctgtagcagtttgaaaagtttatgattaattattccaattctaactagtaataaaaatgcatgcccatgcagcaactaaaatagcaataatggtcatccaacccctgcagcaagttggactaattgtaactatctaaactatttccattttaagcaagattcatatcatgacaaaaagttctattttctactactgactctaagattacacataacagaaaaatacagctaatataaatcaatcactaattcactaatgattattacatgatgtcaacaaattattcattgcaatcacaaatttgcacgcatgattaatgtagcgcccattctgtcgtggcgcctagcgggaaaactatctcttaaaaactctatttgcgaaatccgtttctttgcttgttgtctagtgtccgtgccatctcagatctcaaatccccgatctatcgtcaagttcaatcccgaatccaaatccttcccaaatcaaatccctccgcaaaagtctatttagcctccctcgagttcgatgggccgaatccctctcggcccatctccccctccctccccggctccctctctctctctctctctctccccgctctgcccgtgagccgcgtcgagctctccttctccactctcgcggtcgttcccgccgatgccgcccaaatcgccgcgccgcccgcgcgcgcgcgcgccgtggtggccgaccggc

SEQ ID NO: 89553 - DNA, 673 bp, Oryza sativa
gtggatccctttttaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctacccagaataactctgctgtaccagcatcaaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacaaaaaagtaactctcaacagctatgatggtcgagttgtaactgttcatgcattgtcatctgagtctttaaggtcaagactgaaccagataac

SEQ ID NO: 89554 - DNA, 529 bp, Oryza sativa
tcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttagg

SEQ ID NO: 89555 - DNA, 681 bp, Oryza sativa
tacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctcca

SEQ ID NO: 89556 - DNA, 745 bp, Oryza sativa
tttgacaaggtttttgaacttatagataggtactgtcataagttcctatgttaattaagaatcttgttataattaattgctactacggatcatagctttaaactccatgtagggcttggtatcggttccgtcatttggtccgcggcaattggagagaaagacttaggcggaagtttaattttcctgtgagtacacatgctctaaatttatattgaatctccaattcaaatacatacaagtgtatattaattagatctctcaccatttgtcatttatatatagtgcgcaaagcaagcccagggaactaacttgtgcggctactacgtgtgcgagtattgccactgccttgcagaccaaatcatcaccacaagagagctcgatgtacgtacaaataaattcaaaatttcattgcgtacgtatcgatttgttgtttactaattaatttcatacattcatatagtttattcgtataagggataatctcacacacaaggaatttatcgcggtggttcaagaacaacttatgggattcatcaacgaacaaatccttgatcccaacggtgaattctactacgacggaaatacaattcatatgttcttagcttctgagataatgactactactacgtcgaaatcgtagctagctaggacatcataatggattgtaattaatacatatctatttttttatatgcatgtacacatttctttaatgtaaatatatattttggtcatatatatatgc

SEQ ID NO: 89557 - DNA, 799 bp, Oryza sativa
cccttgcaacatatatgcccctttagacaccaaccttaaagatttgaaacggtccttcccaatttggtgaccacttgccgaacttgttatcccgagttccaatcgacaaaatcaacttccatataagttcaccttccgaaaaatccttaggcactactttcttgttataatgcctagcaactcgttccttatctttggtaaccttagcaagggctcgtaaacgcgattgaaccaagtcctccctctcatcggccataaggttataatactcaccggctgtcaaactgtcttgcaactctatccttctagagccgattctaacttcccatggcaaaacagcttcatgtccataaacaagcttataaggaggaacttgaattgatccatgacaagccatccgataagaccacaatgcttcggccaaccgggtatgccattgctgaggataatcagaaatcttccgcttaattaatttgatcaagctcttgttagatgcctcagcctgcccattagcttgtgcataatatggtgaagaattcaacaatttgatacccacgctatcggcaaactgaacaaactcatcagacacaaagattgaaccttgatcagttgtaatagtttgaggaataccaaatcggtagattatatgttcttgaacaaattgaattgcatccccagaatcaactttcttcaaaggaatggcctccacccacttggtgaaataatcagtcgccaccaatataaacttatgccctttacttgatggtgggtttatcataccgatcatatcaattcccca

SEQ ID NO: 89558 - DNA, 3655 bp, Oryza sativa
aggccagccacagtactgcctctcttgtcgatcgatcgacagccacagcctgcaggtgtggggattcggctggccgtcgccttcgtcttcgtcttcgtcgtcgtcctcatcatgtcgtcctcgtcctcgtcgtcggctgtcttcccactggaccacctcgcggcgccgtcccccaccgagcagctctgctacgtgcactgcaactgctgcgacaccatcctcgccgtacgtgctgtggcgccgatcgagctagccacctacctaccgacagcgtgctagcttcagagcttcttagcattaattcttcgtttgttagttcgtttcttgttttgatcgatcttttgtttctcttgatgcatgactaacctgtgagtccccgtgcccaacttcgatctccacgcaggtcggcgtgccgtgcagcagcctgttcaagacggtgacggtgcggtgcggccactgcgccaacctgctctccgtcaacctccgcggcctcctgctccctgcgccggcgccggcgccggccaaccagctccacttcggcccttccttgctctcccccacctccccccatggcctcttggtatgtacccacctaacttgctctatatatctctctcaaatcctcccatgctagctctcacgttttagtgaggtgctcagctgagaatcatacattatattcatactgacgtttagctctcatgggtgtgactgtgtaatttccggtgtaggacgaggtggcgttccagacgccgagcctactgatggagcaggccgcgagcgccagcctgagcagcatcacgggccgcagcagcagcagctgcgccagcaacgcgccggcaatgcaaatgcctccggcgaagcctgtgcagcaagagcctgagctgccaaagaacgccccggcgtccgcgaacaggcgtaagtacagtactactactacaagcttggtgttctttctttgaaacgctagaattttgtagtcaaaggtacttatgcaccacagtgtgttctcctgctagcttgttgcttattcaccgttgtttgggaggtttaagaacagaaagcttgctaagagggggtaattagctacttatagctcctacttaggcatatatgcacacattagcgtactagtgtacgtgttgaatttcaaatttcaatccagtgtttctttcgagtgtgtgaaattaatatgtactatattcacttgaagaacgctcctcagcactagaaatgatagtacagatcaacaaggcatgcgatcatgtcttgttgtggcagggccatgtaagcccatgcttcgatcgatccggtcagtatttgcagacagcatgtatactgatagcttaggtgagcttacccatttgtccatgtttcctcggatgctgtctgatccaaaacttttgcagctccggagaagcgtcagagagtcccatctgcgtacaaccggttcatcaagtaagatttctctataaaccttctgcctaattaaaactgatggatcctcctttgagctttggttaatcagtattcgtggtatcatctcgtaaaaaaaattaattctgcttataatgaattgctacacagggatgagatccagcggatcaaggccggcaacccggacatcagccaccgggaggcgttcagtgcagccgcaaagaatgtaaactttcttcgtctgatccgcgcattaatgaactcctactcatcctgtagtatctagcttgatgctagctgttcgcgtgtcttgatttgactggacaccttacattgtcagcacggacacagcggcagcttgtgcccggccgcttgcgagatgccgagagcaagcggctgtggtttctgggagcttttagccccacagctgctatagctagggttcgttcggatttgtttcgatctcctttactgatccaaacctgcctttgctttggctttactttccttgtgcttgcaatcagtgggcccatttccctcacatccattttggcctcatgccggatcaggggttcaagaagaccttcaagcctcaggtaaccagaatcccgagagaattaacgtatactactatgggagacacaagcataacctagttatctgtgtaacctgaacactcatatagccttatcagaattcagacccacccggcaaacactgcatatgcactgctcttatttactttagtgctttgcgagcaattcatctgtagccgcttcctgtgtcgtgattttcaggatggttctgaagacattcttctcaaggatagcctgtatgctgcggcagccgccgccgccgctgcagccgcaaacatgggcgtcactccgttctagcgagctttggcaaagcggccgcaagcaccgaattcttggtggtggccctagctcgctctcatgtgtggcgccattctagctatatagcaagggtttaattagcatcagatcatcatctcttaatatcatgtgtgttgcttaattagagtacttctgagtgtgtagaagagagatggggaatcctgttgagtgcctaggtttatgcttataaccatattcctcgtagagacttttttccctgtttttctcttttcttttccttctttatttttttatcctttctttctttcaggactatcttcgtactccctattcacctgtagagtgtagagaagttgctgttccgttgcctgattgtgtcccaaaagacgtgtcttaattacgaactcatgaacatcatctagcaatataaattctagaaacccatgcatgcatgcgttgctttctttaatatttcatgtgcttttcttcaatagaaaatgttttgggtttttatcaccatacattcgttatgagattaagtgcttagtgctaagattttggcaaataaatttgtaaaatttcaaaaagagaataatataacttctttgattccttcaactaaaaaaaacttttacactctgtctatgatagttacaaaaatcccttgccagatatataatcgactaccacgacattggttaattactatatctgttcctttatatttgtcgtcgctaatataagcattgttcatatttaaactttgatcatttatcttttttcttaaaaaatctaaatacttaactagatgaatcttatcaaagtgtattacatactaaacataaatttaatttaaattttcatttatcataatctaaccatttaaaagtttttagcggtccatgatgagtacgaacagagataaatataaaggaatgtatggagtagtttcatccttaaattgctagctgaagacacaacaaaatataaaggaatgtatggagtagtattttggaccttggtacgcaaagatattggtttaaaataaattaattgaacttgcatgccttagctcgaattattaaaatataacgacctataatttagttatatgaaaattttcgtcaatctcaatataaggatttgctaaattttcgtcgatcaaaaatcaagagaaaaacttccaatatttcgtccatcgtataattacattaccattatattacgttgtagttacattagatttctttcaaaattttatcgtagtccataaatatattcattattgaccaaataaaacaatgcacatactggtttgacttggcaccctatttttatagtat

SEQ ID NO: 89559 - DNA, 1807 bp, Oryza sativa
aactccagtacgatgaatgcattaaggactgtgataaggctgtggagaggggaagggaacttcgtgctgatttcaagatgatctcaagggcactgacaagaaaaggaacagccctagccaaacttgctaagacctctaaggactatgacattgccattgagactttccagaaggctctaactgagcatcggaatccagacactctaaaaaagctaaatgaggctgagagggcaaagaaagagttggagcaacaagagtactatgatccaaagttagcagatgaagagagagagaaaggtatgggatccagtagggtatcatgctgtcatctctagttctcccccctgctttatttatgtcctcacctgtcccttgcagagatttcccttgctgccatattttttagagttgcaatgtgccatttgtaggttgactggctagctaatccttatggtttgtaggtaatcagcttttcaaggagcaaaaatatccagacgcggtaaagcattacactgaggctatcaggagaaatcctaaggacccgaaggtaatttcttttggccctattgcttgaacttgcttgttcgaactttggaaatataaataatgtactcggtttcttcattttcttgtgttttgaagtttgacttggatcattgtttgtcatgtgtgtatgtgtgagtttcaactatatattacgcaccatctaatctatctgtatgtatgcataacaaaaacgtcttttgtgtattactgttttggattgctctatatcatcattatcctaaattactgtcatttttatttatcacctgtttgcatgcatcccttaacataactgcttggggtttcaattatctacaggtgtacagcaatagggctgcatgctacaccaagttgggagccatgcctgaaggtcttaaagatgcagagaagtgcattgaactagatcccaccttctccaaagggtatacaaggaaaggtgcaattcagtttttcatgaaagaatatgacaaggcaatggaaacttaccaggccggtttgaagcatgatccgaataacccggaactgctggacggtgtgaaaaggtacagaagcgtcatagcacaaatcactagtgatagttattcttatgattgtatctctctttgctcctaatgagttagggcatcgcatgaatccgtctcacctccttgtttccccaatagaatccaagctcactcacctttttgtttgcataaaccaactctgaactattgcacatgtttgcaggtgtatcgaacagatcaacagggccaacaggggtgatttgactcaggaagagattcaggaacgacaggtaagcctgttgcacttttcatgccccttgttgctttaaaagttaaatactgtacaactgtattaactggtccttttttttttgtgtagaacaaggctatgcaggatccagagatccagaatattcttacagatcccatcatgcgacaggtaacacagaatatttgttcttagctgaaatttagatgtcagttcataaagtatcacaaatacctgtctgtccataatcttaatgatatcgaaaatgttttgcaggtactggtcgatttgcaggagaaccctagggcttctcaggagcatcttaagaaccctggagtgatgcagaagattcagaagcttgtaagcgctggaatagttcaaatgagatagtcgaccaaagcaagaagcgctgttcgtgtctatgttcattgctccttactttttttccatgctcagtctttgtggacttaagatttacacagtttggggc

SEQ ID NO: 89560 - DNA, 1970 bp, Oryza sativa
ttaatccaaaaccattatttgtctcctcgaatatatccctaagaaaatgaattcatattagccttttttttatgcaagaggcatatatatagaccaaaaaaatagtttagagtattatttgagagtggacattttcatatttatgtatctgccaatgcgcaattcaagatacaaaataatactttgactaaatcatcctaaaactataaatttaagttggtatatcacaaattatatatttagcatttaatttatcacagaactacaaatttaagatggcgtatcacaaaactactaatttaataataaagttatcataaaaaataaatttagcaccaatttagtcaaaattctataacactcatagtttcgacataatggtaatacaaggaatttaaactctaaaatctatagttttgtgctaattttatatttagaaatctatagtttttttacttgctttaattatatagttttgtgataaatttaatactaaatctatagttttttttatggagcagttttttaaaatcttgatcaaaatatctgtagttgctatttttatcgtgaacggccagaagaagcattacatgcctgttacttcaagtatctgccatacccctctgtgcaaacaaaatcaaatctaacgataaatctgaacacagatttacatgtgatcagatttatccctagtttgattttttatataggaagtagacctttaagagaatcccctgcttgcacctattagtaccaataatggtctcctgtttatgcattccgtccctttcaaatcaaataaacatgatgaggaagtgacgtcgactctagatgagaaaaatgtttaatataaaatatacacaaatcattcatacaaaagcagtactttatggtgaagtaagttttttttttgtggggatggttgaagtaattaagtcggttaaacaagtaaaccaaaaaagctagcgtgcggttagttatgatgtttcgacaattcattcagatttaaaagtctgttatgcacttttgataatgtaaaatgcgggtggtaacgagtagcacacaactatagggtacaaaatttagctacaacaaactgcaggatttggttaaacaaacagttaatccttgcattcacgggaacttcagatactataaattttcacatatatagctataaataaaactctaagtacgacatgaaggacacaaataaaatgaagtaaaatgtaaatacatggggctatcaaggatgacagtatttgtaaaactgaaaaagaatgaatttaagaagcgcaaatcatacctagctattacgcggacgtgtgtgcattaatgaggtccagaattgctaagttttgtctattataaacataaattgcatctataaaatataacaggagaagaacttggtgcaagtcactaggatacacctgccaccaccgctcacaagactacaaggatttgctagagaagagcaaggtgaggggaagaagagagctagtggagcagccccggtcgaggttctatagaaagggaacttttcacaaaggcaaaatttgctacagtacaccgaaagattgtggattttgctgtgagacacccgaagatcgtgtatttgattgtggacactgtaaaaaagtagtaattagctgctggacacttctcccattattttattattacgggttaaaatggagagagaaagagttgtgtaagtaccaaaatgccccttccctctttcttttcttttccccttcctcttcctcacgcttgctattgagccgagcagaggcgcgatggtggccggcccgagccaggacggctcggccacagaggggcggcggcggcggcgcatcaccagggttcgccgccgacggcgaccacgcacggtggcatcccggcacacggcttcctctctctctctaccatttatttttcctctttctctctagacgcacgccgacgtg

SEQ ID NO: 89561 - DNA, 1976 bp, Oryza sativa
gtgtgccacatggtctttagaatagcatttgcatcttcctccgtcgcaacatgtctgattaatgcctcattccaggcgtttgttccagggatcaaaagctcatgtacatacgtgagcctattccaattcttcttctgtataacctcaactttctcaccatgcgccacccatctattcctccaaatcttggtagtccgcctgtctcctatcctccaaatcagtcctttctttagcaattccagcccatgttcgattcctttccaagttggtgaagtattggacgggaaagctgtatcagtaagggagccattggggtaatactttgctttcagcaaccgagcgcacaagctattcggctccgcgatcaacctccatgcttgacgtgctaataaagcctgattgaaagaccgagtatcccgaaagcccaggccaccatgaagcttagggctcgtgagcttttcccaggatatccaatgtactttcctctcccctttgtcatgtccccaccaaaaattgcgaaccatctattcataatcattacaaaaatgttcaggcatcttaaacactcctatcgtgtaggtggggagagcttgagctacactctttatcagagtatccttccctgcagctgatagaaacctctcacaccaatctgttaatctcttagaaaatcttcccttgattggttggaattgttctgatttcatcctaccttcgggagttggaaggcctaggtatttatcttcaaaacctgctctttgaatctgcagaacagctttgatctcctcctgcctctcctatgagcaaaattcactaaacaacagagaacactttgctgggttaataagctgccctgtgcttttctcgtatagactgagcgcctccagcaaattctcgcttgatcaacctcggcttgaaaaaacaataagctatcgtcagcaaaaagtaagtgggagatccccggggctccccgacacaccttaattggttggattgaaccttccaagctcttcttctccagaatatgtgacaacccgtcagtaataaacagaaacaagtatggactaagaggatcaccttgccgcaatcctcttgttggggtaaaaggatctagcaggttcccatttaaacagatactgtatctaacagatgtcatacatgacattgtccacttcctccatgattctccaaaacccattctttgcaacaccccatccagaaacgcccaatcaactctatcataggcctttgaaagatctaatttcagagcacaaaaattctggttctcccttttgcatttttggatggcatggaagcattcgaaagcgatgagcgcgttgtctgtgatcatgcaacctgatacaaaagcactctatgcatttgatattacatcatgaaggagcggtctgagtcgattaacaaggcatttagctatcaccttgtatatcacattacatagattaacaaggcatttagctatcaccttgtatatcacattacatagactgatgggccagaaatccttcatctcctccggtgacttagtttttggaatcataactatgacagtgtcatttgctccctcctgcatttcgcggttttcaaaaaatgcttgtaccactctgttgacgaaaaaatcgaacacaccggcctgggagatctgcttagctcctgtgcagttccaaagattgatgagatgcgagcgtgccagtcaatttgatcctacaactgacaaaatatgtaagcagcagataaaacagccgattggctgacaagccgatggagtagttccaaccgatagctgataatagccgatgtcgataccagccgatagcgatagggtttaagcaatcggctatatgtccaatatagataatgatataaaggcaatcggttgatgatgatgtaataaaataacaatataaccgagtagaaaccgggtaccgagctcgaattcggcataatagcagtactca

SEQ ID NO: 89562 - DNA, 3749 bp, Oryza sativa
agtcggtcaggaacttgcccgagcggtaccgaaaggccgatgaggagaagcggcagagtcaacgggagggcaaggcccccgcgacccccgctagcgaccggcggggggaggccaataaaaaggcccccgccgatgatgatgatgacagcgaggacctggaattccagatacctcagggaaccgtcgccactcgcgacggggggtttgcgctcacacctcccgccgcagtttcaaggccatgaggcatgagcttctggccgcgatcccaactcacgaggcaacatggaaggcgcgctggtcggaagtgaaactgaccttcgaccagagcgaccatccgacggtgctcgcttggggagggaagttggccctcgtgatctcccgaaccatccacaacatcaagatgaagtgtcctctagtcaacgggggggccggcctcagcatcatctccccggctgcctttgatgcccttaagtccccggggatgaagcttcagccgtacctgccgatcatcggcgtgaccccgggacacacgtagcttctgggtcacgttgagctcccggtaacctttcgtgactctaccaacctccgcaccgagcgggtcgacttcgatgtggcggatcttaatatgccctacagtgcggttttgggaggcccgcgttggtgaagttcatggccgccacccactacgcctacctccagataaagatgccaggccacagtggccccatcaccgtctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatcccttccctttaccacgcatagatcagatagtcgactccactgcggggtgcgaccttttgtgttgtttagatgcctactccgggtatcactagatccgcatgactaggaaagataaggaaaaaactgctttcattattcctgtaggcaccttttgttatacaactatgctttttggtctcaagaacacaggccctacattttagcgcatgactcgtattactttgagtgatcaaataggcgtaatgtagaggtgtatgtcgatgacttggtggtaaagacgcgccaccaggacacgttgttgcaagacctagctgagactttcgacagcctcaggtccacgtgcatgaaactgaaccccgagaagtgtgtgtttggtgtgccggcgggcaaactcctcggtttttttagtttcctcatgaggcatagaagctaatcccgagaaaatacgcgcgatagagaggatgcgccccccaacaaacttagggatgtgcagtgcgtcacgggatgcatggccgccctgagtcgattaatatcgaggctgggaaagagggcgttgcccctattcaagctcctcaaacgctctgggccgtttgtatggtcggaggaagcggagcaagctctcagccagctgaaagcttacctcacctcccccctatcctagtggccccgggaccagaggaaccgttgctgctctacttggctgtgaccccccattcggtgagtgccgcccttgtagtagagcgtgacgaaggtgacctgcgtcgcgagcccggctatgggaagggaccaggggtccccttaactagtgatggcccctcgtcccccaacagcccgatgcccgaagcccccaacccccgggaaggccctgaggtccccgtgggagagagagaggccccggcggacggccccgaggcctgtcgcactgacgtggctcgagaccccctcggggcccccgagcacgggcgccccgagctaggttgccctaacgacaaaggtcgaccccaccgaaaggtgcagcgccccgtctatttcatcagctaggcactccgagatgcgaaaacctgataccctcaggcccagaagatgctttacgcagtcttgatggcctcaaggaaattgcgccattacttccaagcgcatcgggtttccgttgtaacgtcttaccctctcggccagatcctgcacaaccgagagggcactggtcggatcgtgaattgggccatcgagctcgctgagttcgatctgcactttgaaccacagcacacgatcaaaagccaggttttggctgacttcaacgctgagtggaccccggcggacgactctattccgtcccatattccctccctccccggagatggagaagacccgaacgccgatattcgcaccggacattgggttatgcactttgacggctctctcaaccttcaaggtgcagggaccggagtcacgctgacttcgccaagcggggatgtcctcaagtacgtcgttcgacttgatttccgagccacgaacaatatggcagaatacaaaggactcatagcgggactgagagcggcagccggaatgggcatccgctgcctcctagttctaagcgattcccaactggtcatgaaccaggtcttttggcccaacccgctcttttggcccttcgcggtctggggtctagacatcctagggcccttcaaagcggccgaggcgggtaccagcacctatacgtcgccatcgacaagtttaccaagtggcccgaggcttacccggtcgtcaagatcaactggcattatgccctcaagttcatcaggggcatcacatcccgattcggagtacccaaccgtatcatcacagacaacggcacccagttcaccagtgagctattcagcgactactacgacgacatgggcatcaagctgtgcttcgcctcgctcgcccaccccaagagcaacggccaagttgagcgggccaatgccgaaatcctcaaaggcctcaagaccaagacgtacaacatcctaaagaagcacgggtattcttggctcgaggagcaacccgcggtgctgtgcgcgaatcggaccaccccgagccacgccacgggggaaacgcctttttccctggtgtacggccctgaggcggtcctatgctcggagctttccctacgtttgcctcacgtcgcgctgtacgatgaggccaaccaagatgatcttcacagcgatgacctcgattatttggaagaacggagaaggcgcgccgccctatgtgcggcgcgctaccagcaaagcttgcggggctaccatcagcgccacgtccgagcccgatcactacaagtcagcgacctcgtcctacgccgcatacagtcgtgtttagggctgagcaagctctcaccaatgtaggaagggccatacaaagtgatcgggggtccccggccgggctcggttcgactaaccatggaggacggcacggagttgcctaaccccaggaatatcgagcatcctcac

SEQ ID NO: 89563 - DNA, 2783 bp, Oryza sativa
atcgagcatctccaccgtttctaccaataatgtcgcgcgttttttgctttcttggggctcgggcaaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaacgagcccgaggggcgggacaaagggagtaaaaatggcaacttgatcgtaaagaagtcaactaaatgcgttcgctttgtttttttccttgccgcaggcatttagaagagaaagcaaggatgtaaaagtgcaaaggagaagctttatttacaaccaggatggcacaatggcctagagtttcaagcgttcaccacgagcacataacaaaataaaggaggagaggcgggggcaatcacggagtgcctgggcctccaagtacagcgccgctgaccaccttgtcccaatcctcgttgccatcatcgccgccgccgtcatcactcccgctctcctcatctgagggaagcgcgagggtgaaccaaggggccgtcccctcaaagcttgagatgatcacgtcggccgcgtcccgaacttgctcctgagccctcgtctcaatccctgggggaaatcctcgagcacgtgccacggaaggatgttggggtcgcgagcttgatgactcgcgaggacaagctccaccgcagcccgtgccaaggaagccgatgacgacttcacggcttcgccgacctcctccttcagcctctcgagatccgccgccatctcgtccagccgaagcgcgagcgccggtcttgtgggcaggagcttcttgtcccggcgcacggagatgcccacccggcgtcccacgcactccagccgttcgatggcatcgtagagttggccaggcccgatgtcgttggtgaggtggagggccgcgatctccccagcctggttctgtaccagacaccccaggttggcgagagtatcttgggccgcggtgagctggctgaccaactcggcgtcgccgggctgcccgcgcgctgccagttccttctccctggcctccagctcaagcgccctcgccaccatcgccgtgcgctcaacacgggcgctttccacatggcgggtctcatgcccagcaacggcctcctcacatttggtgagctgctcgcctagccggcgcgccgccacctcgcggcggttcacctcggcctcacgctcggcgagcgcggcatctcgttcccgccacgcctcctctcggagccacagctcctctgtgcgacgggccactaaagcctcagtggcaatggtggtctggttgcgctcggtcgcggcctcctcgcggaggcgaagggaggattccgcctcggccgctgtcgcctcgtggacggccaaggtagtctcgtgctggtccaacgcgcgcgcccgctcctcaagcgctagggcccgctccttcagctcctgggcccgctgcgcctgtgcccgaccgcaccccttctgttcgcgttggttgcgatcgaggacctcgatccgccggcgaatcgtggcctcgaactcctgcgcgaagcgggtgcgctcgtccaaggccttgcgctcggcctcaagcgccaccgaccgggcccgcagcgaggcgttgaccttcgatgcccgccgaacttgggccgcggccgcgtcgaggaccccgcagggcgttctcaaccctctttggcaggaccttggcgtaagcctcatactgcaggcggatgttgcccagcacctccgctaaagcgcttgatgtgatgagcgccgcctggcgcttctcctccgtcttacgcatgaccgaatcaagcgtctcctcgcgcgcctggatcttctccagctgggcttggtgcattttgcgccccgtctcccttgggggaccccacccttttggcggcgggggcgggttaaattttttgacccacgggtgaggtggggtccgggccccacatttttggggggaggggactggggaagccttttaccaggggtgacccgcggggcctccggggatgtaaattcaaccctaaaatgtcgaccatggcaaaccccaaagagctcaatccaacaattggcttgcaattaaaaactataccctatccttatcctctctcctttccaatctcctcttcccgtgacccatacacacaaatgcttgtggtaagttttctccataccttggcaaacatattggttttgaagcacttggcgaagtggatataatggtatctcataacccttgataatcataaaaccaacattttccacttccaaaactggttaccagccttctataaataatccaattgtttgtccccttttgctcatttcccgcaaattggggatttcggggggaaaaaacccccccgctcatacaccccaatgtggtgggaaaaaagttttttataaacagcgcttttcagtgtggaacaggttggatagccccacccttcctgggtcttcaagtctttggt

SEQ ID NO: 89564 - DNA, 3530 bp, Oryza sativa
  unsure (1)..(3530): unsure at all n locations
gctggccntttgagtnagataggtcgcatgcctgcaggccgactctagaggatcccctttggttttgggtgcgcgcaggacgcggaggtgccgcccgttgtgcccggcgtgtgcgtgccgccggcgccgccgacgcagcagcaaccgggggcgggattgggggcgggcgacgtgcgggtgttcggcgatcaggtgccagtgggcatggcgcccgcggcggcgccgccgccggcggcgaagaggaaagcctagaacgcgccgaagctgtggctgaacaacgccggcgcagcctccgaattcccggtctcctcccgcgccaccaaaatccgccgtctcgtgcgtactctaactcaaatctccccccaaatcacactagcggcgtatgccatcaactaactcgcgtcgtggtgcgtgcaggacgcggatgtgccgccgcccgttgtgcccgagctgtgcgcgccgccgccgccgccgcagccggtggcggaggtgcagatgcgcggcgaggaggttccggtgatcgccgtgccggcgccgaacgaggagagggcgatcgtgctgtacaagccagacgacgccgcccgcaacctcctcctcggcccactccgcccggaattccctctccgcgtcagccccgattggatccacggcctcaagagtacgtaatccaccaaatccacgcctaatttgagtcgaatttgtttcaacctgaagctgctgagatcaaattaactgtggtttgatcctgcaggcaccgcgctgcgagaggcgagcgaacaccgtgctctgttcgaggagctagccatggacgagacctccaacctggccatggtaccatgggttcccgtgccctcaaactcccaggaagcctccacgtcggccgccgcgacggcgacgacgacgacggagatgatggacgccgaggacacgtccatggaggtcgagcaggacgggggatcgggaggatcccacctcgccgccgccggcgaggcgccctactaccagtggccgcagcactgcatggcgccgccgccgcagccgccgctcccggcggtgagctaccagccgagcccggtgacgtggtcatggtgaagcgcgtgacgcacgcaacgcacgctgtttgtagattgtagtaccatagacacactggtgggctttcatggcggtctttggctttcatttgcttcctgctcgtgtagtttttcctcgttttggcagcgcagtggagactgagcaggagttggagtgagaatcgagatgagatcgtacgtggtgttcttctctttctgtaggagtagtattgtccttgatcagttcatcgatcagtggagaggggaatggtgtattggtggtgaactggtgattacgcggagttttgttctgcttgtacatggtcagtgtggtactggtacggttgacgcctcgacggtcgtttttttaaaaaaaaaatcgtacgtgctgatatttttgctgccagagcttgtaacgtgaaagttgaaactgatatacgggtacatagactgtatgggtggtaagattatgaatgttgacttcacaatgctcttgctaagaatttctccgctattcacactgtgcgcccatctactggttttggatgtgtttggctcggtctgactgaattaatggatgagtaatgtgggtagaaacaaatggatttttttaatcttgaaacaaatggaattttaaccacacttgaggcatactatttgattctctactctaccaattctatcaaaatctaaaacataagcaatttttagtactatcttctacttcttcttttggacctaccaattctatcaaaatctaaaatctaagcaatttttagtactatcttctacttctttttttgggaaagttagctagcccatatttggtttgataccaatgcgaagtatggtaaattttattagtacggtgaataagtttgtagaatgtgaccaaattaaatatgtgcactatcaattatttggctttaatgatttcaatccaaaatggtccataagtggacggggataaaattgcctctacaaaatcagtgcctctacaaaatccacatgactataataaatttaattaaaataggcttagataagcttagaaaagtatatggatatggttgacaataagcaacctgatccatatttaatcctacaattgaagcgccctatgtatagatggctaaatgggccgcgtggcctggcacgacccaagtaggactgggcccagcctgaggtcagtcgggtcaggccgtgcccacccacgggctacaccaactgcccaggcataacccaataagactcgagccgtgccgggctggcctaaggcatgataacccattatgcttctctatgaataagtctattttcctccctcgtctctttaggccatgtcttatatggttgggataagtctacttttgtattcctaatctctttggccgtgccttaaatgcccaatatgtccattttgggtccctcaactatttttcttcacgctcattagaccgtgcggagctggcccaccatgccaaggcatcggcccagtcatggcctaactatcatgtcgtgccatgcttgagttgtgccgtgggccagggcatcaaaccttgggccttatggccatctataactttatggagagtatagaaagttcgtacaaagatatccaactaagaacaaaatcagaactatttttttccacgatctctacaattccttactctataattgatctagtgtgatactagtaacatatgctcatgctttagaggcctagttttaatgactatgtgttttaaaaacatgtgtagtaatgctctagtcatattattatcttattgttattagtgtacggtgacataatatctagtcacaacataacaccctcgaacggtggtccatagatgaaaaataaatagttacactgtttaatacatagtcatgggctcatggcaatttatatcatcccaaggagcatatgccccgtttgtataatgacgggtggttcatagatgaaaatagcagttacatcgtttaatgcataggcatgggctcatgacaatttatatcatcacaaagagcatatgccccgttcttgtaatgacaggtgacacctaaggtctgtgaaacatactcctatattctaattatatgatggcgagtgacaactctaagaaagtgaagacaaactgataactatgggtttgtttggtagaactccaacctctaaatttaacttaggagttgggtctgaagtgaagttgcgaacccaactccacgtctaaatccaactccacctctgtagtttatttcgtaataacaactttactttattttctggtgaagctaaaattgtttggttggagctttggccgtgccaaatggaagctgagcgcagtcgtccctatgagcccaccgccaaagatcgcattgacgaaactacccctgtctgtgccacccatctctccagattaggaccagtgaattacattttttgccgatcccgtc

SEQ ID NO: 89565 - DNA, 2308 bp, Oryza sativa
agtgcctcaagaatttcctcggcgttagactcctcgcaagtaagttcgctcgcccagtggcttgcgcggatctcaatccccgcaagctgagcagggggagggcgccgcctccgtcgtcgtcgtctgtcctgctgcttccgccgcatccccggtgagcacccatccgtcacgcacacccttttcctcatctgtctctacggacgttttttttttctcttctcgaatttgcgttaaccctagcttcgcttctagatctggaagctttttgtcttaatttgccctaaccttaatactgcctcccccactaaaatgtttgggggtttcaattgaacacccatgtcccgcgttagatccgcccctatgctcttctccattcaatcagcttagaaatcgttaagttattactgtctgtgtttattcccatcgtgatgattaactgctgccatttatactgattggaatctatcgtagtagtttagatgtgtctgaacaaaaactgtatgagctgattctggagctcgagaactctaatttactcacgtgctagacagataatccatacgaacccattttctgaataacaaggaggtgtcaccccacgttttgcttctgatattcgcggttgtattttgggggctgaattactgatatgttgtggtgtgattgggtgaagtgcgacacaggggcaaaactaaaatatgctttaccaggaaagcaaatggagctcatcttgtcaataacaattatagccacttctgtctagattatctttatttatctccagttgcttctttttatcactgtcagtgaagtgaagtgaagtgaagtgcgttttattgtttattatgaatgacagttttttattcataagcactaaatggattgggcttcttatttgctttgtatgagatggcatgttttacgtctcttatttgttttgtataagatatcatgttctatgtcaacattttcttatggttatcaactgcaggcaaatcttgtaaaaagcctatgggaaattcaaaaactcctcaaccatcaaagaagtcccgaattatgttgtcagatactgatggccaccaactggacaatgatgagttttcatctgaaagtgcatcaaatcaaatggttctgttcaaccctgaaactgtagctaaagggcaagatgaacttggagagaaccattcaccatctttgcagaaatcagccaataatccgaaccgaggaatgccatctattggggcattcactgtccaatgtgccaagtgtttcaaatggagacttattccgacaaaagagaagtatgaagaaattcgtgagtgtattatacaggaaccttttgagtgcgaacgagcccgtgagtggagacctgatgtaacatgtaatgatccagaagatatatctcaggatggaagcaggctttgggctattgacaaacccaatattgcactacctcctcctggatgggaaagacagatcagaataagaggcgaaggaggcaccaaatttgctgatgtgtgagtaatgcttttctgccactgatctaacctttttagtccatgtttctgcaaggacattgatttcattatttatttcctgacatttctgtatgtaactaatgctctaaaataatagaaactatccaagtagcccatgcgttcacatggcaaactttactattctcttacccattaattgtttcaatttgttttgtatttttatgttattttcccccaatcattggcttcctttggactgttaaccaattctctatgccttagttatgtacaaactttgactagttcaacttaggtagaaggtagtagctacagtagtggtgagcacaggtcactccttggtacttgcttatccactctagttcaatcaaatgaactaaatacacaaatatgcattaaaaagtgcatcttagttgactttgtataacaaaagaaccgtaccaattaagtgatccacgcccattgataagctgcagtatcgtcctttctattattggctacctaggaaaatgttatactatgtgtttgtagctgtaatctctttatatgatggtatttgagcctattgcttgctgtaaaatgtgattattgctgaccagatgtttaattagtccctagcattgcaataacctcatcctaattggtaatgaagtgaaagttgtatggatgaacatacttaatttgttcttagtacatcagtctaaaccaatgagaggcagttttggcatcatgacgagaatcaagttcttgacgctgaaaagcaattggtgggaactcggtcattttggttg

SEQ ID NO: 89566 - DNA, 4199 bp, Oryza sativa
  unsure (1)..(4199): unsure at all n locations
cacgcgtgatggcgtcgcaggtcttgtcctctttgccgtactccctcgccgtcacgcgctttggcactgcgccgccgccacggcgagccgccgcgcgggtcagcctccgccgccagcaaacgtcccgcgacggcgccctcctccttcgctccctgacgacgacgcgctcggtacgtaaagctcgtgccaccgctatcgatctctctcttaaattctcctctcctctgatgatcagagatctctcttgatcggtggaaaattgcagcggtgcgctccggcggcaaaaggaggcgacggcgccaaggaggcgccggaggcagctggcgaccccgacgacaagctgtggccgtgggacgagttccccgagaactccgtgttcgtcagcaagggttagccgccgtacagccaagatttggtgcgagtcggggaagacccgggccgcgctcaaggacgccgcagcagacgtgctccgcccgttgctggacaacttcaaccatctccgctccctcaacaccgtcttcgacaccgaggattaccatgtcggcatgccctttggtaagtaattaacgtgagtgatgcaatttcgtactacctagcaatcgcattacaactacaactagcccaatttaattttacgagaaacaatttttttcctcattacatagattataagatagacgcacacaatcgcacacaccacactaaactcgctcctaaatacatggctgtgttagcatgcagggtatgggaacacattcccttcgcacggaaaacggagcggttcattagcacttgattaattaagtattagctatttttttttcaaaaatggattaatttgattttttaagcaacattcgaatataaacttttttttaaaaaaaacatatcatttagcagtttaaaaaatgtgcgcgcggaagacgagggagagttgttgggaacatggggttccaaacacagcattcaaagagatggagttcttcacttaaatctttcgcagcgcgtggtctgcctctttagcatggcgtctaagtgttgacgagtaacgtgatgtgatttgatgagcgcgtaagtaactatgttttattttgctgttgaaatattaggtatgctcattgcatgcattgggtgttataacctcttcaagatgaatccaaccacgttcatagacgcggccctcggttacacgttctacaggctctgcatcgtgtcgtcgcagctccggagaagaggcttttccaacgacctcatcatccgggttaaatttggtcagttactgcatccgcaatctgattcagctgtttcctatttcttaaaagcaaattcttttggtatcgctatgcctctcgatgatttttcctttgcagtcgtcatgttggttatggctatcaatgatatcaacaactgcatttattggcttgatgctatcaggtatgaatgtatgatccacacactcacaatgtgttatggttttttttttaaaaaattttaaccatatcgatccaaactaaaaattagacataccgcctaatcgagaggggttgatcgatcccaaagactatttggttgtgttttttgttttgagaggttgggagcccctctccttcgcacataaaacaaaatgatagattaacgcatgatcagacatgtaaaacgtctctgatatgtaaaacaaaaagatcatggacgtccctttaaggggcaaaatgactaggccagattagataaaatttgaaggaaaaaaataattaggtgattgaaaatagtagaccaaactattgtttcatgcatggttgcatattcctttacatattgacttgctcctttacattatattgacttgcgttgacatgctgtaattaactacgcgacatgcatgcatgtacagggcacctgtctatttcctctagagcttaacgtttgcttttgagttggctggtattacggcagtcccaacccatactactagacatggttttcataaactctacagcatcaagaaactagtattagacaatattcttccaatgcaaacatcactattccatacttcaatttaatactacttatctcacatgatgtcgatgtcttggatgttgtgtagaaaccatgtctcatgcaatacatggttttcttctctttcctcatttattcacttgctacatcaattttttttgtcctaggtgacaacttatttaatgctatggacactatcctagtcattgggttggaaatgcccttaagaagtgtgtgaagtatcttttggcctcagttgccctcttgggtaagtcatgaaaaaggaagacgcgagctgcgcaagctgctgcccaagtttgaacttgcacctgtgtctgagaggctatcaaaatggtaataattaatacttcatccgtttcatattataagactttctagtattgtccatatttattatatgtatattaatgaatctagacatatatatgtgcatatatttattaacatttatatgaatatatgtaatgctagaaagtcttataatctgaaatgaaggtggtagatcgatgtgtattcatggatggccaggctatactacataattggctgaggaaattttgttctgccctacttggcacactttgagagatggttatttggttaatcaattactttgcgtttcagaagatatgtgattcaggctccaatgaagtgcagttgcttctgtaatttcgtccagtttattatgcgtttggatcaaacaaggggggttaacaagttaattctcactgtaaatagacaaaagcattgctgtctgattgagatcgagaccatgttttacaatggtgctgctacgtgtttggccagtttttgaacctatgaccgatgacagtcaaatgaacaaaaaaaaaatcagtaagttggtaaaaacaatactccatcacgaaattatacaactactgctttctaaagacaccaggggtggatctacccattagatagggtgagtcgaccaactcagctacgactcgtgtcaccccaaagtccaaattgaaaattaaaaatatagcgaagggtgatccaaagtaaattccttagcaatagaaggtgctccaaattgtaaatttactgtatggagatatatagttaggacaaaacattcttctgaaattcacccttggttttcagaagattaattgtgaggatcagataattccttgcatatttttttcacaaaaatatataaaataaacaaatgtagaaagatactatagagtaaatactggcatcctgcgtcaagaaacaaatagtcattaaccaagtcaaatgatgcacagtgacatatataagaacataagcaaaagtatataaaaacatcaatgataatatcccaaatgggaaaaataaggatatcggtacgagaacagaagtgaggcatataaagaaaaggattgcacaatactgttttaatcaaacgacgaatttagaaggctgctgtgccaaacaatggtccaaaacattaacacagtcgtaaggaatacgtaatgctagaaaggtcagcttgaaaggtgacatggagatatatataaaacagacacacaaaacaaccatttcatttctgaaatataccaaatgtgcaaaatataaatcttcattggccaattacacaagtatttcaatcaaaagactagaacggggaaaaaaaattacaaaagtattacagcctacaaaccccatacccccacccaaaaagaaaaaaaaaatgaataagttcactggaggtcccttaaccacaaaaccagaaatcttcacctctaaactatacaaaaccgtctaatttaggtcccaagtcagtatagttgcctggttttgctgacgtggcatcctagtcaacaaaattaataaaataaatatgtgaggtcctacatgtcagtgagagaaaatgatgtgggccccacatctattttttcttttatttttctcttctcttctcaacttctcacaggtgggcgggcagatgcgagtgggcggcccatggcggagcgggcgcggcggcccgcgcaacggggagagatgcaacaatcgccgcggcggcgagcggccggagcggcggcgtcggaggtctaagtcggtggagggagagtgcgattgctaagcaggcacgacggggatcctctatagtcgtcntctggnggcgggaagcgatgttctagcgcgcg

SEQ ID NO: 89567 - DNA, 768 bp, Oryza sativa
  unsure (1)..(768): unsure at all n locations
gagaaaaattttgtanacccaacatcttgctgtcctgcaagtcgactctagaggatcccccttggcaacaccatctggttgaacgtacgacatatttggttcatcgaatggtctgtcaaccttcttaattcgcataggaagatcagtaaacaatggtacatcgtcgaactggatggaatcattggggtctttgatgttgtcgatgccgacgatctgttgttttccggatatgacaataggttttctttcatctgaagggtccttcacataaaacacttgagccacacgctctgataaaacccatggatcatacttagggcctgttttactgtgatcgactatcgttagcccgtagtcatcaacggaaacccctattgtgtctttaacccattcacaacggagcacagggatctggatgtttaggccatagtccagttcccttatttcttgaatggtcccataatacgacctcttttctccactcgtgtcaatcgcttcgacacggatcctactgttttgtgcagtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccaccgaagaaagcgacgcttgtgctctcttgatatccaatcattggaccggcctgggaagcaggctttgatttcttctaggtgtcgctcaat

SEQ ID NO: 89568 - DNA, 2707 bp, Oryza sativa
  unsure (1)..(2707): unsure at all n locations
gcggcatgaaactgagcttctccttcgtccagcncgncgactttagaggatcccccctgtcaaagccacaaagtaaagaccttccaaactaattgcggtacactaataagttattgtgctgattattcccatccaaaaaaggcttacactaaaagatattttgtttttcattacatattttatttacagaggattgatgttttaacttaacaagatgtatatgaaggaaatataacataccattgacaatacttcatcaaccctgtacaatgaaggataaataaaattgagctgcttttttgcaggcagtatcatcatgctgaaaccagcagcacaacgttcatcaagagaaacatctgcgtaaccaccacgaagagcaagagacttgcatatggacagaatgtacaacggcaagaatcttaaagattctggatatataagtctccctcctatccggtgctgtacaacatataggttccggtattccttcaaacttctcacaagctttaattgtaattgttgccgaacactgtccagcttatcagacagtgaattttcaacagctgcaacatataataagtcaaaactatgaacactcaaataccatatatactggcatttacaaaatggcaggagcataaatctagtactaaccgattctactcaacaatgacacaatggcaccagtatctgcttgacgatacatttcaccaagatctgtgaccacaggtgcagctgctgtatgcaccctgatacgcctttcaccagaagaggatgtatatctggtggtggttaagaacaactaccacttcatacaatatatgctgctaaaaatgtatcaaacagctaacaataacaaatatcacacataacagaatcttctaataataactaatatcgaacagctaacaataacaacaaagcagtactccagtgagtcatgcagataagtattgacacatctaaatgcactcccaaaatgtttgggcataaacagattttacaagtttcatcaagctatcacaagttaagggatgtcccaaacagcctatgctaatgacaatttgaggaaaggtgttaacagtcaatttgtcaggttaaattgtccatatgtaacattatttttttctaatctaaatgaagatttgaataagagtgttgcataaccagattggcaggaaaggatacagcaatgccacttggaaatatacagtctgtgtggtcattagggtctcctctaaagaaagttgcattgcaaatgctttatcagagtcaacagctggaagtgctaataagtcggtggaccttagcatgaaatggccatgataagttgtgaagcgcacccctgcaagcagacatcagtttgtaagtcattgaatgttaagctgataaataaaactttaaaatattgtcagctcagaaccttttccacatctgatacgcataacagattcccatgcagtttcccgtgtaaggtctctgctaagctcatgtttgagtttatccccatgagtaactgcctggaaggatggataatggtacacctgaccaccagtgtatttcgccagagaacctacagaaatgtagcaaaattaaagaacatggttaattgcaatgcacctttccaaggtttggcagaaaaatctcacctaaagaagctatatcacagtatttatcactgaaagaaaatatgtccactgcaatttgatttttcgtgaactcagcagccatctgtttataaaaaggatcttctgggactctgagagaatgctccttatctgttccatatgcacggacatcatctcctcgaagtctcaagcgaccaacaccaagagatggtaatgtgctctggaatacaagtaacttccctccaatttgactctacaaaagatatgacacaattatccatatctgggtagtgggtacaactaatggtagcagaagcaattgtaggaaaattggcatcttaccataaccatgaatgctgctttaagtgctggaccaagagcagattctacatttacattgtcctggaacatatttggcaagctatcgagaaatgaatcgacaacatgtctagagtcaaccaaattaaccaagaggtcatcaggcaacggcaggaaaacatcatccaaatcagcgaccaccatcatttgaggttgtgacaaagacgactgatacaaccagataatacaagtcatgtaagtaacctcacataaattgaactaaatttcagacgctagtatattattgcagagcaaatggataaaaggatagatggatataccttgaaattatgaaagtgcaatgtgctatcaaaagttaagaatccaatctgtgttcgtggaaaccttgggaggtcatcaaggcatgatttgatggtctttgcaacaacctgaaagaatgcaagcattgaatttgtttgaatccaaactacaaagcataacctataagaatatgctgcaccactagtacatattatgagttacagagaaaaatatgatcccctaagtgattgaaatcaaactgcaaaacaaatagcacatacctcaagcagcccgcttcgaactgcagatacggacacatcaataagaaagaaataggagggtggcattggtggccgcaccatatattcagtgggagcaacaaactctactgttcccttagaaagctcaggtctttgatctgcatcatatcttctgccgct

SEQ ID NO: 89569 - DNA, 700 bp, Oryza sativa
  unsure (1)..(700): unsure at all n locations
gggcctttaatatagacgnactccaancgcncactttgagtacccacagcactcaaattcgaatttcttaggcttggcaagaactatcattgtcatcgagaactacacaaaatcgctcacccatgggcatttttgaagaaagaggagagattttctgtacccccatgcgagaggcgaaccaaactctcaaagaaaagctggtttctcgccagtgttaatcttgccggatactccacggacttatggtgattggacacttccgccaagatggggtgcgtgctatgccggaggtaatgtgtggctatgcctccgcagctaaagctatgaaggcaactaccctaccatgattggagtagccgggtggatatgctctaaaaattgcggattatctcattgggaatgctggaaatatatactgacataacagtgaaataatcttcactcactcggacctgaatcttcgcaaaagaaatggtttgaactcatcaaggattacgacgtgggaattcctatcattctggtaggcccacagggtcgctgacgctctaagatcaaaaagccattgcaacacttctaacgttccgtggttttcaccccaacttaaccaacagatggaagccctgaatctgaaccgtagggggcgtcgacttttggctgcgttggaagcccaggccacacttgctcgaccaaatccgcaagg

SEQ ID NO: 89570 - DNA, 747 bp, Oryza sativa
  unsure (1)..(747): unsure at all n locations
cggcgctcttaaaaatgacagtaagtatgnctgccntgcaacnnnagaggaccccagatggcagcaaatgaactggctgaatttaagaaacagttgtattagttgaaagaattttggaatataccttccaaaacttccttgtggggttcttgggtgatttttggggggaggaaagacattacaatgaggatgtgccttgactacagagctctcaatgaagacaccataaaaaacaagtaccctcttacccggatcgatgatctgttctatcagcttaaacgtgccactgtattctccaagattgatcttcgttccggatattaccaattacgtattcctgaataagatattgctaagaccgcattcaccacgccataccgactgtataaattcactgtgatgtgattccttttaaccaatgctcctgccttcttcatgaacttaatgaacaaagcgttcatggaatacttgtataagatgttgtggttatcattgatgacattctgctgtactcacaatcagaggaagaccatgagcaccatcttcgtttgatgttgtgaaagtatctgaaacatcaattgtatgctaaacttagctagtgtgaatactagttgtgcgaagtcaaattcttaatgcacgtgatatttgctaaaggagttgctgttgaccccaaaacagtgacccgcgtcaatgattggaaacaacccaatataatcacttaaattcgcagatttttaggcttggcag

SEQ ID NO: 89571 - DNA, 747 bp, Oryza sativa
  unsure (1)..(747): unsure at all n locations
atcgcctctaatcgctacccgtgacgtacnccttncaaanncgaggancgccaaatggggaggcaccacattaacattgaatttatcctcccgtgtttatttttatcataatctggaacggtacactctgaatatgcggttgccatttccattctatagcgggggtgccacactttgggcaacattccaattccgcatattctttacggaataatatacagcgattcttacaagcctgaatcttttctacaccaagacataaaggacatatgagtttcttcgtttgatacccgttcgatggtacaaagataggtttaggaaacaacatatgcaacaaactcatcagatcattaaaacttgttgtcgaccatccatgtttaacctttaatcttagaatgtcaagcactgaacgcaagactgtgaaatccttatcacatacgttcgattcatcgtaaagaagatccttcaatgccttctctaatgcctgccaattatacaattctcgtgacctggccgctagcacctcttgtttaacatggcgtagcatatcctctaaatcaaaactaccatcgaaatcatcactatcggtggaaacatccacaaccattctttcacgcgacatgtattcgattataaaattctctgtctcattcatctagaaacataactcttcatcgtcatctttcggattggctaattccctgttatacgttcaaaccttgtacgttggcggagaattcggactcc

SEQ ID NO: 89572 - DNA, 1555 bp, Oryza sativa
  unsure (1)..(1555): unsure at all n locations
agggcgatgtgttatatacntnttattgagaaagagaaggcgccctccacaagatatttataaaaaaaganaccggtgtcgcgccccccatatcgtgttacgcagaaaagcacaaaaatataatatttctttagatcacgcgggggggtggggggcccaccccgcgtaaaatatatgtttcgcgcggaattaatatattatgtgcgcacttatagaaagaggcactttacaaatacccagtccgtcacccaacggggggtaatttcttttcccggtatatgggatattcttattaaacacggttaagggtaaaaacccgggctataaaattatggcccggccatatgattttcggctttacataggcgtttaaacaaatagaagttatggcgttaaccatattttaaaggccaaagatttaatgccagtttatttcgaagaataatttgttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattggaatagtcatatataagtagcatatgaaagatagtaaattaaattgtgaaaaactctaatatatgaatgataattttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtctttcacgaaaaagacttgcgttacatcattggcaaggacaaaaggttcgtccgagtatccaaccttgttaaggtcaacagt

SEQ ID NO: 89573 - DNA, 745 bp, Oryza sativa
acaaatgcatcagactactacagtcctcctcaagcaaaccttggcaggggtaccgaatctggagcttatgggtatagctcttcgttccaggtggatatggttgcaacggacctcctcaagcaaaccttggcaggggctagccatttcggggtcgcaaaaggaaaggaacttcgttgcagcctctaccgtctgtcaattaagagacggacaaactatcctcttctgggaagatagctggttgcaagagggttgcattcggtcctttgctccgaacatttatgataaaattccaccacacgtgcgccggcgtcggacggtggctgaggcactaacaggtcgccaatggatcaaagacatccgaggagcacttgggatccaacctattctagaatatctaaagctttggtcgcttgtccaaatggtggatcttgatcctactactcctgattcaatcatctggaaatgggagagttcgggccaatacagctcaaaatctgcctataaggccttgttttttggtcgtgtcgcctttctttccaccccaatttggaagtcactcgctccgcctcgatgccgcttcttcttgtggttggtcgcaatgaacagatgctggaccgctgaccgtctgcgcagtcgagggttgtcacacccggatcgctgtgttctttgcgatcagcaggaggaaagcattgatcacatcttggtagcatgccctgaatcgagacaattatggtggtggacgctt

SEQ ID NO: 89574 - DNA, 2048 bp, Oryza sativa
ttgagactaatttggatagcgttttctgttcagatatctagataagtccattgccactctacaaatggagctggcaggtaagcgcagcacactcgagctacttggcaatggaaatggtataagccagcaaaggaagaaagcttttgtagtgattgggatcaacactgcattcagtagcaggaagcgtcgggattctgttcggcagacctggatgcctcaaggttcatacttttcaatgcaacacatagtactgcaatgagacatggctatttgcatgctttactaactttactggatttcttattcatagttagaagccatgcagaagatttgtgcatttgatcaaagtagaacgatcgtgcacctaacctgctttcagaaaatgatcatgcagctaacaaggaaatatagaaaatgatcatgcagatatctagtcaaataggaatatttatcatcatataagccttctaatataaaacaaatgcagttgtacctttgtcacctgcacaatttcttttaaatttgagcctttccgatgaatgaatcattttgttaggcgacaattgtttgtattttgctgtgctcctgtactcattgcttgtaagactaatttcatatctcccactcctattttcaggtgaggaactcaagaaattggaagaggagaagggaatcatcattcggtttatgataggacataggtaacatcatctgcagtttgtttcattattcgtaatacaaacaaagattttctagacatctctgtagtaacctttccgttttaggggcgaaaaaaaaagtactggacttgtgattcccagattagactgtagttagtcattttgctcaaactcgaaaagacagatttttcattgagtagctttgagctctagtaacttcataaacaaacagtgaactaatggctggatttgaaatttcacagggaccattaaaaacttatattgtttattaggaaatgcaaaatgtgcatacaacagctcatactgcacataattgatttcaaaattcttgctagaggttcatgggattttactacttatttctcagcataatgaatacgaatgcatcaactaatactaactactttttatgtattacagtgctacgtcaaacaatgtgcttgataaagaaatagacgcagaggatgccgctcatcatgattttcttaggctggtatggtgacatccaccaaaagtagaagcacatcattctttacctatttctgttaaaccaaaatctgttttactgtgattggggctgtagtccatactaatgtttattctgctgcaaccacacatgtatgtaggaccatgttgaagggtatcacgagctatctgcaaagaccaagatattcttttccactgctgtggcattatgggatgctgatttctatgtcaaggtggatgatgatgttcatgtcaaccttggtaagctttattatttagcctttgaccttgatgagagatttgttattcagtaattaactgatgggagtgatgcaggaatgctgatcacaacccttggtcggcataaattgaaaccccgggtttatattgggtgcatgaaatcaggaccagttcttgctgacaagtaaatattctggaaacaacataaaactacttctggaagctccatcgtatgaaatctctagatgctaatattcatttttccctgcatctttttatcagaaatgtgaaataccacgagcctgagttctggaagtttggcgaagacgggaacaagtatttccgccatgccactgggcagatatatgccatctcaaaggaccttgccacatacatctcgatcaaccggtaagcctagagaatggctgcacatgattcttcagacaaaatattcattttactgaattgttactgatactcttgtgtcccaccatataacccaggcctatattgcacaaatatgcaaacgaagacgtttcacttggcgcatggtttatcggtttagacgtggagcacattgacgacagagacatgtgctgtggaacaccaccaggtcagttt

SEQ ID NO: 89575 - DNA, 1804 bp, Oryza sativa
gaattatttggcccccaccaataataatctcccacatgtttcccgtaatcatttgggagagatagatagatatagatcatgttaataatcaccgttggtcccgtcccgactgatgagtcccgaccgaacagacatcccattctgccaggcagcagccagtcacgtcccgtagattaactattccgccgcgttcatcaggtgttgcgcgcgcgaaaacggcgaattcaccgcgcccgcgtcccactctaacacctgttcaccgctcgatcgggcgattcggcgttgcccgcaccggcaaaaactacgtgggggctacgtacgcgcgccgcccggtgaatagcctcccgcgcgcgcccgtgagatcgccactggcgccacacgttgcaatgccgacgtacgccacgcagcggcggctcagatcagtgtcgccgtcccaccacgtgcgcgcggggcgccgtacgtctccggccccctcgacgcggagaattctatggcaaaggaatggaggaggaactagcggacgcagcccagcgcgcgcgcgcgagcggcgaaccacccaaccaatctcgggggggcggattgcctgctcccgttcgattcgacggatcgcatggtcccgcgtctcgatgatttgaggcccaagggggtaggagtacagcttttttgactcgtcatcagcttcgatgatccgtcacgcgccgcgcgccgcgcggtgcagatctggcgagcgagagataagaggaagaacattccgcttacttttctgtagtgacatgtagtaccgtcgtactggtagtgtagtacggctgttaaatgaacgcacgaacaaatgtcggttttacacaccaaataggagtagtatcagtgcttcttccatccatataacgagatatttaactatttataactcttaaaagattactggaccatatgtcatacatatataaggattcacatattatagacttaaaagtggcaaaaagttaaacgccccttatataataaatcgtttaaatatttttctagttaaaatattttaagtttaattaaatttatagcaaaagatagtaacattatctccacaaaccaaacatattagcgtaatatattcaatactaaattaatgaaactaatatggtgttttagatattgctaagttttttataaatttgttcacacttaataaagtttaacttatagacaaatcaaaacaatttataatattgaacgaagggactagtagcaaatatgcatacttgtacgatgtactactacataggctaacaaaatggtagaggttgtagctcttacagtgatgtctgccgtgggggaaaaacaatggtcataggccgcgcacattgtgctggctttgatggacgatgatcctctcggagatggatcctaatcactccatggatatccaccagtttattatgttaactaaataactataaaaaaattgaaacaaatagattgttgtgcagtatattgtcagggttcctagttatgcacgatcgtgatcgaacctactattcggaatatcacaatcggatattgccatgggattgttgtgcacgatcgtggtcgaacccactattcggaatatcaagatcgcgcgagttctgatcgatggcggcagctcgattaaccttctcttcaccagcaccttggacgcgatggggatcccacgaagcgagttgacacccaccgatcaacccttccatggaatcactcctcagtcatcatccaaaccattgagcaaaattacgttgtttgtgactttcggccaaacaaataacttccg

SEQ ID NO: 89576 - DNA, 657 bp, Oryza sativa
acattactcggaaaaactttttgacaagggtttttctgcccaaccaccctcaaaaatgcctgcgacatggttcaccggtgtgaagcctgtcaattccacagtaaacacacaaagctaccagcgcaagcactccagactatccctctacttgccgttctcgtgctgggggctagacatactcgggccattcccacgaggacagggcggctacaggttcctattcgtggcgatcgacaaattcactaagtggattgaagcgacacccacgggggaaatcaaggccgacaacgccatcaaattcatcaaagggatattttgcagattcggattgcctcaccgtatcataacggacaacggctcccagttcattagtgccgattttcaggattactacatcaggctgggagtcaagatctgctttgcctcggtttctcacccttagagcaatggacaggtcgagagggcaaacggcatagtactacaaggaatcaagaccagcatctacgacaggctcatgtcacacgacaagaagtgggtcgaggaacttccatcagtactatgggccgtgcgtaccacaccgacaacgtccaacaaggagacacccttcttcctcgtatacggctcagaggccatgctccccaccgagctacgacatca

SEQ ID NO: 89577 - DNA, 1090 bp, Oryza sativa
aaaacagctactagctgtttccgattaccagtttactttttttagaaaaacaaaggagaaacaaatttaaaggcaaaacattttcctttgcagcaatcaaaggcacatgtacatagttcatacaaattcaattttctgagttgccacaaaacaaccacgcgagcacaggacaactctgaccttctaacatcaaaggatcagggaaacacttttaattagttatatgaacatccgttcatttgttgtatgttaactaaattatttttatttttttaaaaaaattgacaagataaattcacatgtgaataatgtgatatgccactctataaacataaacatgtaagttcaaattcgacttctatcaattacaacaaaaataacaaatcaaactctaattagtacacatatatttacagttaaatttgatatttttattataacttatagaagttgaatttaaatttatatgtttgtgaagtgatatatgtcgacggggatatccgtagaccggatatagagggtattggtgtacgctggtacgaggatctacgtaatacgacatcaagcaggcagaaaacaaagattatactggttcaggccccttgataggtaatagccctaatccagttgatatggaattatatgatggaaaccacatattacaaagggaaaagcggaactcgatgataccgacgaggtcgtaatcgaacaggttcgattagatctcccggcgacttggctcctgtgggcttcaactccgtaggctgtcgtggatgtgttggctatgagattcgatgccttagatcctcccgggggtcccttttataccgcaggtcaactggtctccaagtaggactcggagacatcggacccggcacgatacaatgacgacccagttctgtccgagtaggactccttccatctgtgaactccatgatgaatttccttaacgtacgccgaaaacgtccgtatacgcgcaagtataccatatcgatatgtgacgtatatcgaaggtagagggtataccttacccgtaaccctgacagtagcccccgacttctgcttaaatgaactcatgtaactgatcgtg

SEQ ID NO: 89578 - DNA, 3357 bp, Oryza sativa
tgctcccgcaatggacctcgacaagtctacctccaccagcgcgtcgctgaagaaactacaggaggatggcgcccttcccggtcgcgggaccatggagagagaagcaggaggtattgaaccccagcctgtcctgggtcgcatggttgcgatcgaggactatattctctgtggttttcttcctccgccttctgaatttcttctcttggtcttgaatttctacggcctttctttgctccatttgaaccccaattccatggccttctcagtattttttcgcatctttgtgagacctacattggggtagagctgtttcttgacctctttcgtttctactacgagttgcgttagatggaatcaaacagggtatccggatgcgtcggtttccgactccgggatggcctgaagtcgtgctatatccctttccagtgcccttcctctcgtagcaaatggcgggcgaggtggttctatcttcagatagaaaattcggatccagtcttcgttgttcctgaggaacaaccagacaagatttcgtcttggaccgcaaaacccgccttaaccccttctcttcagcccttcatcgatgccatcgatgacctccgaatacgaggtttgtcagggtatgaagtcgctgccgacttcattggtaggcggatccagccgctccgggctcgagcccacccatcctttgactattttgggccggaggacgcgacccgggtttcttctcggggtatttttcttgtatttaaattgacttccttatgtgcgtgttcctcctgacttatcgaattctggttctcaatctgcaggtttgaacagcgaaaccatggagcgccgtgtcggccaattgatgatcagcggcgcgacaacggcgagcaaagtccccgtccccctttgtgagaagggggcagctgaacgcgaagctgccatcaatgtaagtgtactcagcagcccttttgcacttttcttccgagatcgcattgtgacttcataaagcgtaggctctccctctgactgatatcatcgggctgctcgtggattatcaggcggcggcgtcgctgaaggaggacgtcgccaaggaggcgtccgatgttgctgccgctgctgccacaacaagtggcggcaacgtttcgaaaagggggaggaaattctcctccgtgatcagaaatcgtcggaaggcgcccactccctcggtaagctttcctggtcctttatcgcgtagtcggaaaacttccacctcacatcatacccgttatactccaggcctcggatgcgtctcctccgcctccgtgacggcagtggcttgtgacgcttggcgagaagtaagtggatgaatttgaggttttgtcacttcgtcaaactcttgcagcctgtctcaactgcagccttccacaaggcggcgtgggcgaaggcggcgcaagacagatctggagggacctccagcgcgtctcctgctgtggcctcgacagatgtcgtggtcgtgcccaggagccgcgaggcgacgcctagtggcccagccagcgatcttgcggctggtcggggctcgccggctgtcgtcctcacctaggaggagctccaggtcgagatggggctcctccttgaggctggtgctcgcagcattagccgcgagatcgcggaggcgagggcggcggcggcgtcgtcggtgaatgagcgtgccgaccggctgacgcgtgattttgcggaggttcgcgaggacctccagaagatgacggagctggtggccggcaatgagcgacaacgacaagaactcgagcatcgtatgtcggagcttgagaacaacttgtcggaaacccgtggctcgttgcgggtcacctatactggtctgcaccagctcgccggggagtgtggcgtcaaaactaccatcccggcgaatcccgacgagttctcgctgacgtcttcgcttgcagaactggcgacagcgatggaggcgatccccctccaagcacgcggccaggatcggagaggagacgtccaacttgatctataccggggcatgccatgtcctcgcgtgtatgaggctggcacaccctgaactctatttgcggaagatcttggatcagggggcggctagcgacgcgcgcaaggacatgatggaggaagtcggcgatctgggggagtccgttctcccgctttttgaagagtaggatctttagtcatgatttgtaaaactctcattggttccaaccgcctttgtgtgtgcagtcaacaccttagttttctttagcatgttgatctcgagtactttgttgtcatttgtagagatgttgatgtcgaggatgtccagcagcgtgggcagcctgagttgccagtgatcgttccggcacttgcgttcaagccatatgtgccgcagggcgatgtagatcaaaatatgcctgtggaaacgggcatggcgacgacttccttaggttggttttttttttcatctcctttactcttccgtctggatcgacttgctttgttgtgttcttgggagagaagagcagtttgccttagtcatttacatgctgagcagacctcaagagtgcgcttgctgaccaagatcgccgcatccagtattggaggacgaaatttgaggtcgcggaactcgagaggattatgctggaagtgaagaaggatcaggccgtggaaacactccgaggtcgcgaggtgtggttcagctcgtatctgaagagttgttgcacatccatgacaagggtctgtagagagctccgagtaccccgtggggatcctgaggaatcggcggccggatacatctcgtggctaaatggggtttgcgcccagctcgaaggcatcggccagcgtatcgacgaggccctgaagcaggagtgccgtcgatcgagccgatatgccgggggcatgtattggcttgcatacgatatcattgtccgcagctgcacctcgagttcctccatgaagggttttctcgttctcggagaactcctacggagatagatggcctggcgaagtcgatggcgctgctggcggagaaggtcttccagtccatggactggcgttggccttcctggtagtcttcgtgtcctgtgacaaatgtcttagggaaaagtgtaatataattttggatttttacggaattgtaagaagtacttgtaaaataaaaaagaaatctatctaactaagctttcttactctggacatagtgtgtaagagtgtcttcttacttcgcaacttcgatcagtcgtttgagttatatactctccctagcccccaaccttgtcatcggagaattcttcttggaagataaggctcttggacctttgacctacctcggttgaacaagaactgatcctagcccccagccgtgaagttggaaagtta

SEQ ID NO: 89579 - DNA, 1485 bp, Oryza sativa
tgaggctgccgttcgccaacgggagcagccccgacgacggggtgtgcttcccggcgcccgccgtgggggggggccgcgggaggatggcgcggcaagtggcggtgcccaggatggtgttccacttccagggcgccgacctcgacctgccgcgggagaactacgtcctggaggatcaccggagggggcacctgtgcgtcctcctcggcgactccggcgacgacggcgcgacgatcggcaacttcgtgcagcaggacatgcgcgtggtgtacgacctggagcgggagacgttgtcgttcgccccggtggagtgctgagagggcaccacgtgtcaactgaaaatcactgtagttatttttttttctttctactcctagttgactctttttcctgggccgtacgatatgcagaccgaatcgtggagcggtactggtgtcctatacgaacgacgagcgagcacacaacaataaaggtagccccttgaaaacacgtttaatacaggggttaatcataaaattttaaaccccaaaaatttgaattcaaatcatggttactgggtgaaccatccgtttcatatactcggcaattttaactttgatctagtttgatcacttctattttataaataaactggaaatatttaaaaatatattatattattggagtatgatatatgataaatataaaaatataccctacaccttgttaattataatcaaatgatttaaatataacattgctcaaactagagcaaacgcaagttaaaattatcaaatattatgaaacgaagagagagtacttgcttgctcgaataatagctattgtgattactcaatttaattttctttggggtttcacatcatttgcccacgaccttttattgcccaacgctgaagaagaatatgagtttagtttttaaaaattttaacgggtttttaaatctaggcctttcatttctttttgccaataaactacaatgataatatcaactcaaactcgtagtagaaccaagggataattatttctcctagtgatagaatttatatcgctagtaaaattactagaccttcgtaagatacaactaatccatagttaaatatatgccactattgattttatttttttttcaattctgaacactatttttctcctagaatatataatatactaataaaaatatatttgaaaaatatttataaagaaaaatctatccatttgatttttaagttttcaaactaaatattttgagctattaatggtcaagtttttgaccaaataaaattacctgcaacacatttaaatatgaagagattatgattttgatgtatgattagtcaggcggctcaggtctcaggcgaagaacttggaactctgatggagacatgaagcccaaggcttaaaaaaaaaacatacaactgaccagaacggtgttaggacatcactcaagtttgtattgcaaaaatcatagtatgattgtagcatatattt

SEQ ID NO: 89580 - DNA, 1878 bp, Oryza sativa
tcacataagcccaaaagaatttagctgggcagtaaataaaattttataccaaaactttattcatagagatttgtccaaaatccagtaacagaaacttgaaagcaaaatctcataagcatctctccatgaagagacaaagtaactaataagaaggtataaaagctgcaaggcggtcgattgaactgatccacgacggagctttccagtggttcacttcgaaagcttggacataaacctcttctttgcccttatctgaaaaatcagacgaagaaaagaaacatcagatgtgtgcaacacaactggagcacagtaaagcatagcatcgcaagagcgtactgatcaagccaatcacaactattccaacacacagtgagaagtgccgatatatgacttgataagataaagtcatcaacagcagatcaaaacaaagaacatgaacaatggcaagtggcaacctagcaaatgaaggtttacctcattgctgtggccacacttcttcttgcggcagttggtggacctgaggggaaggcgtgcatagcacctgcaggagaagacagtgcgtcggattcagcacacaaggatcaatcttatgaaagcattcgattcaagcgtaaatgcacatgaatcgatcggtcgagtgcgcgcgacgcgaagcaaatgtacctgcggcaaaccagcttgttctcgttgtacttctgcgcgagctcgcggaggttgggctcgatccccttggggtagccgcccctgctgccaccgcggaggcggagcaccaggtgaagcgtcgactccttctgaatgttgtagtcggccagggtgcggccatcctcgagctgcttccccgcgaagatgagacgctgctggtccggcgggatacctaacaggcagatttggtgttatgagaattttaaatttagacaaaatgcgatcatgaaatcgaagcgtaatacaattataatcctagaaactagaactgtcaaaagtacaaaaaactctccagatacagtttagatgtgcagaaaagcattggtttcttccgttacaagaccgatctgctgatctgcaccgtttcaaataaatagtagcgactaagggcctgattagttggcaaaaaaaatttttttgcccgtgcatatcacatcgaatatacagacacacatttaaagtattaaacgtagtataataataaatcaaattacagattccgccaggaaactgcgagacgaatttattaagcctaattaatctgtcattagtaaatgtttactgtagcaccacattgtcaaatcatggcgcagttagacttaaaagattcatcttgcaatttcctggcgaactgtgtaattgatttttttacatgtaatactgcatgcatgtgtccaaacattcgatgtagcagcgtgaaaaattttgtttgggaactaaacctgccctaaataaggcaacagggaacacgcaacgaagacgactaaccagaatgctatataatattgcttaattttctcagtaacaaacacaccgctacatgaacagatcgatctatcacttactactcacgtgcgatatatatacttgggcactgcacgaaacaaaatgagaaaaccttacagtttacacgctaccagggcaaaggacatgatttctagcactatatgttgcctaaacgcgatatatgcacctgcacggtgtgtgaacgtacggatcaacggagcaatcagcaataacatggcaacaacaagaagaacaacagttgaacggatggagaaatggcgaccaatgcgcataccttccttgtcctggatcttggccttgacgttgtcgatggtgtcgctgctctccacctccagcgtgatcgtcttcccggtgagcgtcttcacgaag

SEQ ID NO: 89581 - DNA, 1475 bp, Oryza sativa
cctcctccgtctacggcggcctcaccaccccggactggatcagcgactccaacggcatcctcggcgccaagcccgacgccgccgtcgacgccgggacgactctgttcgtgccgctgcactgcgcctgcttcggcggcgtcgacaacggcctccccgcggtgtacctcacgtacgtcgccgggaagggggacaccgtcgccgcagtcgcgcagaggtaccggaccacggccaccgacctcatgagcgtcaacgacatggccacccccgagctcgccgccggtgacatcatcgtcgtcccgtgccaggtgagcccttttctagcttcaattcatagcttcttcttggatctggtagtttttggttttgttgctttgtgctaccgagatgtattgcgtggttcgttggtaattagatccatggccatgggtggttaaccgacaaatttggttggtaattttactccatactcagtaagaagtagcagtaggagtactatactgacagcgatgtgattagtctagtgtgtccttggtaatttagtgcaatgcagtaaccgcactggccacaagccttgctactgggagcatgagatttactccgaattctggatacgggcatgtgcagatttgtagtactagaatgcgtctaatccgatcctaagttgctatattttgggacggagggagtatctagctttgatatcagaaaggccatgtttagttcctatgcaaaaactttttatcctgtcatatcgaatatttagacatatacatggagaattaaatatagataaaaaaactaattacacagattgcgtgtaattgtgagatgaatcttttaagcctaattgcgctatgatttgataatgtggtgctacagtaaatatgtgctaatgatgaattaattaggcttaataaatttgtctcgcagtttacaggcggaatctataatttatttttttattagattacgtttaatactttaagtctatgtccatatatccgatgtaacacgccaaaacttttcatcctgtaactaaacagggccaaaatgcttcaagattcgtgaggtgaaacatgagtgccagcaatgcagcgcatcactgcttgtctgctcaaattgtttactagtgccagttcggatgctctgtttgtgtatctgcacgtactggcgctctcagctttaaaataaaagggtccatgcatgaaactttacctttccactgctccttttgatcatttgctgtcaattaagctgacacccaagaaaaggagatgaaaaaaaaggtgtagcatgcagcacgattgcacgacataaatttgacaattaagaatgttcaacacaaacttagagagactttaatttcactattgtgagaaagaaagtgttgtgtcgttttctctgttgtgaatagctgaaaggtcttctagagttcttaagtgcgatccatgtgtgatgcattgaaaaaattaacg

SEQ ID NO: 89582 - DNA, 1681 bp, Oryza sativa
ctgttatccctataccgttttctgcttcatttatcttacatgcaattaatcatgacggggtaccattttttttctctcgaacatgcagcgtgcacatcatcattcccggcgttcacggcggactacggcctggcggtggcgaacgggacctacgcagttactgccaaccggtgtgtccagtgcagctgtggcccaagcaacttggagtaggcaccgatcgatttcaccctcccatcttcaatctgctccagatcttacgcgaaccgagagatttctctcctgtttctgacgctgccgttgcccgttgctttgcttgcttttgctctgctgttgcagcctgttctgcgtgccggcgccgctcgccgactcgacgtgctccagcatgcagtgcgccaacagcagcatgatgctcggcaacttcactctcctcatgaccagctccggctgcagcgtcacgtcctgcagctacggcggattcgtgaacggcacaattctcaccacgtaattgatcagcttttttttttttgtgtgtgtgtgtgtcccaaatccatctcgcattttgctattcagaaaccgttgtctcaccgtagcgatacattttgtgcatctttcaggttaaccacagcactcaagcctcaatgcccaggtataaaattcgtgctcaattatgtctcagttcaccatttctgccttgaaaaaccgagactttatgcagctcttgcttttcgtgcaggtccgcatcagtatcctccgctgattccgccgccgacgtcgtccttcttcgagacgtacctcggcccttcgccgacgccgatggcatccgaagaaggcgtcatgtccggcatggcgccgacgagcaccccggcggcgagctccggccctccttcggccggccggcacgtcgtcgccgacgttcttggggcgttcgctctctgcctcgtcggcaacctgctgtggtaacagagcggctctcgccgttgatgctacataattttgtacagaagctgtggccggctgtgtttttgtcgggcagcgtcgggttgtgcccaatttttgttgcgttcattcgatttgtctgccactcactcctgtggaatggcaaacacaattacagaagcgcagatctctccagcgcggctgtaatggtcctgaattcctgatgctattgagaatgtgagtaccgagtagtgtgctttttatcgacgctttttactgtaccttctactactgatatgctttttagggcacccacaatggttatttataaactctctacaggagattcatatcagcatatttttctacttggaagatattaaataaagagagagagcaaaactgtttactaacttagagatagtctatagagaaaaacgaggcaatacatgagagagctatagatacccatgtagacatactattgaggtgatttactattaatctagtctattgctgagatgtacatgttttatagagagcaccttactttactattacgggtgctcttatatgcgtttccccaacgctaatcatcaatcaataactctcctaaccccactgtttttctcatttttttaaattctttttaggctatcttatattgttttacacgtcgctgctaatccctcttgctccttgcgcgtaagggggcaaccgcccataagcggtgcgctggttgatc

SEQ ID NO: 89583 - DNA, 687 bp, Oryza sativa
ccgttttggtattggttgatatttcacaaaggttgcaggcctcttgctattgacaggtgaaaactaggatctcgactctaagaaattgttagaaactagaaacttaaatgcctcattcaggtttttctgtgataaatacttttctattggtgcagatgagtgagcaaacatggatggtgatggtattctgacatctcaatgtgaaccagtcaaccaggtcggtattctattgcatcctttttccccttacattgtctactcgatatattggcatggttgacgatttttgatactttagattgctgattttcagtacagagttgatcgctaatccatgtcatggactctaaaagcaaatggtaagcttggtgtgatgcttgctttggtagatggagctgagttcttcagtaatagatgtgttcatggccttcaggtgaagtatttctagaactaattgcactgctgcatgttaatattaccctaaatttctgaactacaactctctgtcatttgaggaaccaaaattcaggcattgctatatattacatgtgattaaccgagtcattttttctgccatatatgatatattcatatcaagaattttatagccttaaattttctcttacccacgcaatatagattcggtttagcccatgtatgactatgatttgaagactgcaaatcgag

SEQ ID NO: 89584 - DNA, 1974 bp, Oryza sativa
aaaaacgaagccgagcggatttctaggcgcagcagactttacattattcacgaagctgaactgtacaagaaaagtccatcaggaatactgcagcgctgtgtatctttggagaaagggagacaattgttgaaggatatacattctggtatttgtggtaatcatgctgctgcacggaccatcgtcggcaaagcttaccggcatgatgcggacaagattgtgcggacatgcgaaggttgtcaattttttgccagacaaactcatttgccagcccaagagttgcaaaccatcccgttgtcctggccatttgcggtctgggggcttgacatggtcggcccatttaaaagggcagtcggcggttacacggggatccttgtgggctatcgacaaattcttcaagtggattgaggctaaaccggtcatcatgatcatagcagataaagcttgagattttttcatcaacattgtgcatcggtttggggtacctaatcggatcatcactgataatggcactcaattcactggcggagcatttaaagacttttgtgaagacttcggcattaaaatttattatgcctccatggcacaccctatgagtaacggacaagttgagcgcgctaacggcatgatactgcaagggatcaaagcacgagttttcgaccgactacgcccctatgctggcaagtgggtagatcagctgtcgtccgtactttggtctttacgtactactcctagacgggctaccggccagtcgccgttctttttggtttatggcgcaaaaacaatgttgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttacgtcgttatcataatcggaatgttcgatcgcgagcctttttagtcggtgacctggttctgaggaaaattcaaacaacataggatcggcataaattatctcccttatgggaaggaccgttcataattgctgaagtcactcggccgggttcttatcgactcaagcgcgaagatggtactatcatcaacaattcttggaatattgaacaccttcgtcgattttacgcttagacatttcgtttgtatctttcctctttgactgctaacttcaagtttttcctcgaagttttcagtcagggggctactataataataatggagtgtgatttttatcaatttaatttgcttacttgatgtatcattgccctgtttgatttcttggcttagtcaatgaggactgaaagttttttaacaacttttgcggattttaggctcaacaaggtttgacaaaaacttttaagaaatcaggagctaagttaagatatcaagcacaacataaattcatcagtattgtacaaattgtgcctccatcatcattaatcatcaaaattatcggtacattaatcagtatcagtcttttcatcatcagaattatcaggaccagtcggtcgaagatcggtgtcctgaaatctctcaactacatcagcagcaattttgtcagccgatttctgcgcatcactgatgaggtcaagagcagcttcttcgctcgtcccgtctgcaaagccatcaatggcgtcaatatcaactcttggataaagggatttagtcatcgccaacgccagacttgctcccatacttccagcttctttgatgttcttgaaatatgtattcggagcgactctcagcttgtcgaaaatttcagaagcatcaagtgcactcgggccgttgttattgaagaacatcgcttgaacaattggggtagcagcgttagcaacctcatcccgggctccttcaagttttttgatcttgccaaccaggatgtcgaattgagcttgagatttgatcttgcggtctgcatcaacagattcacattaatgattcagcat

SEQ ID NO: 89585 - DNA, 1395 bp, Oryza sativa
cagaatggctttctcaagaaacggaagagatttcaaggcattaactaagtgaatggatttgtctgaggaaacttctcaacatagaactcagtcacatggcagatttgcatatataatatataaaatctccattatgtttagagcttatagtatacacgccttggcatataacattatcgaactaagtcatttaattcttttaaggtgtttcaaatatatgaaggttactatcaatctttttgtcaatcaatattcaatagcaaaaggaaattaatgtatcaatttaactgtggatttttttatctcaaaagacataacaagacaaggaatgataggtagaatggtataaagtccacaacaagtttagttgaatcttgcctgtatggactctttttaaatttctcagcaacagataatagcagctcaaggtacttgtttcttccttcggcctttgaatccaagatatctggaaggaaagatacaaagcaaatggcagcagaagcacatttctcttccatggcgtcctacagaagccaaaccacctcgtcaaaacatcaatcccagaccattgtctccacaaaaggataactttgttaatatcacgaaaacttactgggccagtcaactcagaaacttcaggtggagcagcattggcttccaactgctccaatgcaaaggactcgatagcagaggcaactctagccccctggtaagggaatgggctctccttatcggcaccaaataccaaaatagtaggaaagccttctaccttgtacttgctcatcaaagactgcaaaattcaagtcacacgttatgttacataagtggtacttgaaaactaggttgtatagtttgacaaatgttgtacagaacgcacatgaatgctttaaaaaggtcaaacattaactgggttttataaatatactgatacactgcctgaattttctgcctaagttcatttaaactcactcggtaacttttatcaactgaccaaacacttgaattagtattctagaaaaaaaaacataaaacttcaatcatagtacatcatgttaaactgttaaagagacaacctaaaacagcacaaaataagatcccaacaaatgccttagataaagttaggccattgctttccttgatacagcattttgtactttcctatgcatatcctgattgtgtccctataaactagagtgctaaccctcagtttaattttattttacaatacctttatcaaagtcctttgaattgatgaaatatccaatgcattgtcaaatttcagtttataattttgtataaattatttgcaaacaagaaatgcacatacaacaaaaacttatgaccaaatagaaaaagggcaagaacctttttagcatcacaatccacatgacctag

SEQ ID NO: 89586 - DNA, 2260 bp, Oryza sativa
tgagattgatttataagttttacacccaagaacttataaatcaatggtcgagatcactttcaaagcgaggatagtaaaatagtgtcagtagagagcaccatctcgaaagaactatcaagactgaatttataatgccttgaaacattttctaaaacaactctactccactgcagctcgattatctatatattaccttgtcgtcttctcctgcaccagatcagcagcaactgatcagctgatcggtttatggaactcaaaaaactaatacagttgattgtggactgtaaaaagccatggcaatgcacagtttgactgatggcttagctttgggaacatctgatgttcagagattcttaccttgaacacctcgacaaaaaaaagtgaatgactttttatcacattagagttcagtttttgcaagcattgagatttgacagcactttctcaaatcgagaaatatgcatttgtaatgcaaatgcaaaccgtgtttatattttcaaaccggctcaccactcaaaagattttcaaaccggcccaccactcaaaaaaggcttaaactgtcaccaaaacaaatttggaacaaggcagatataattaaagcccaaaatgtggaaaggaataaaacaatggcaattcctctactctttattgcatggttacttcatctgcctgcccattaacagcctaaggtgtgtgttcttcagtaatgtgatccatttatatacatggttatataactccacaaagtaaggtggcaacatggatctgctggatgcttactacttttacataacataccccctatatgcactgacaagcaggttggatcattaaaacaacaatctggaattccagtaccccatggataaaaaactccttggagtggttgaatgcttgatccatctgcgtaagtgaatgaaagaatgtgtctcactctcgcttgccaggggcagcagggctcaaagacatttcgatttcctcaagagaacgtcctttcgtctcgacaatgaaattgtaggcgaaaagtgctgacaagaaggatactccaccaaaacctgcatagacggctccaacgcctaactttttcacaagctccaggaaatacagtcccaccagaaaattgcatatctgatgaacaacccaatccataagtattgaattagacaggactaataaactgcatatcttgacttgaagcggcaatgtagagtacatacaaactacacactacacaaggagagttacaaggcgattttatacagttggaaagtgcatacccaatgtacagtgaagctgaagcccataactttcgagcgtgtccgagcaccactcagctctggtatgatgattcctgtaactggtccggctccaatggcgaatgtaaatatgtacctggaaatgtaaagatgaataaataagtgagataaaaaaaatcggttagtattaactgttccataaacacaaaatgtgtgagacctgatcagttgccagatcatgaagtagagtataaatatgctagaaaaggatccttaaaattgtccatcagcaatgcaaaggtgaatggcttaaattatccatcagcaatgcaaggtaaatggcaaactcagaaattaaacacgtgaattttccatattccaagcaaggattttgattcacagcaatcataaatagacctcaaagcaaaggttccaaaaaagggacaccctttgtagtaacctctgtaaaaaaacagctatcatgttcaacaagtaaaattctttcaaatactaattacaagtactttaccagggaacattgtatcatagcaagtggaatgaagaatatgaaaaagaaagtaatgcagaagtacatacaacagagttccagtaattgacaggccatggctaactccttcatcaagggggaagctaatagcatatactattaggaacattgcaagtgcctgcaaaaagtagaaaagttgcatcaggttttgtttaaggactacagcagatcacaacaatatttccagaacagtaatcatgctataaaaaattatatactcatcatagcttacacttgccataactcctccgaaacaagaaaaacaatgcagaatttactcaactataaaatattatattaaaacttcctgaaaagcatcggtagaagcaatatataccattccaagatagcttcctgtcaagagtttctttcgaccttgcttattcatcaaaattgaagcaacaattgcccctgaaatttggtccatgagcttatg

SEQ ID NO: 89587 - DNA, 1194 bp, Oryza sativa
  unsure (1)..(1194): unsure at all n locations
aagagggtagantctctnctactgcaagcagttcatcaccctccttgtcctggatcttggccttcacattatcaatggtgtcggagctctcaacctccaaagtgatggtcttcccagtcaaggtcttcacgaagatctgcataccaccacggagacgaagcaccaggtggagggtagactccttctggatgttgtagtcggcgagggtgcggccatcctcgagctgcttgccggcgaagatgagacgctgctggtctggggggatgccctccttgtcctggatcttggccttgacgttgtcgatggtgtccgagctctcaacctccagggtgatggtcttgcctgtgagggtcttgacaaagatctgcataccaccacgaaggcggagcacaaggtggagggtggactccttctggatgttgtagtcagcaagggtcctgccatcctccagctgcttgccagcaaagatgaggcgctgctggtccgggggaatgccctccttgtcctggatcttggccttgacattgtcgatggtatcagaagactccacctcgagggtgatggtcttgccggtcagagtcttcacgaagatttgcatgcctcccctgagacggaggacaaggtgaagcgttgactccttctggatgttgtagtcagcaagggtcctgccgtcctcaagctgcttgccggcaaagatgagacgctgctggtccgggggaatgccctccttgtcctggatcttggccttgacgttgtcgatggtgtcagaagattccacctcgagggtgatggtcttgccggtcagtgtcttgacaaagatctgcatgccaccacggaggcggaggacaaggtggagggtggactccttctggatgttgtagtcagcaagggtcctgccatcctccagctgcttgccggcgaagatgagacgctgctggtctggggggatgccctctttgtcctggatcttggccttgacgttgtcgatggtgtcagaagactccaccctaagggtgatagtcttgccggtcagagtcttgacaaagatctgcatgccaccacggaggcggaggacaaggtgaagggtcgactccttctggatgttgtaagcagcaagggtcctggcatacttcanctgcttgccagcgaagatgagacgcttcttggtccggggggatgcccttcttaatcttg

SEQ ID NO: 89588 - DNA, 961 bp, Oryza sativa
cgcgtgaacgtcgactcacgcagtggcaatagcggatgatagtgcttgccgggcagagtcctgacaaagatctgcatgccaccacggaggcggaggacaaggtgaagggtcgactccttctggatgttgtagtcagcaagggtcctgccatcctccagctgcttgccagcgaagatgagacgctgctggtccggggggatgccctccttatcttggatcttagccttgacattatcgatggtgtcagaggactccacctcgagggtgatagtcttgccggtcaatgtcttcacaaagatctgcatctgcaagaaataatcaccaaacagatagggtaagaactagcacaagattaaggacacaacaacggatcaaacagcaaacatattccaacagaacatacatgtattcaaaaagatagtaacaggcacatcacacatgtattcagataggtagtaacagcacacgtatcctgaacttcagaaataagtagaatgaactagtggcaataatcttcacacagatagtaaaaagaaattaccacaatagattatatagatgaactacagattgtaacatgatattactacagattgtaacatgatattctaatatagttcttagcataaattactggcagatagtaacatgagatcattatgacagatatagcgacaagacttcctatttaccattgacaattaattaaaagagttcatcattatctaatctgtgaacatatgaaatcaaatcgaaacgcacaagctacataattgaaccatgtgtaagaagaactaccctacagatctacatcaaacacaaaacagatgtaacatattaaagcctgtgtttgcaccaacccatggcaccaataactcaatcaagagcggaacagtagatctgaacatgctcgcaacatggcctacaagatggaacacgctacaaatcgcaccaatactca

SEQ ID NO: 89589 - DNA, 1094 bp, Oryza sativa
taaccttttaataccgtcattatatattgctgggtgaaccaggtaaataacataagcggccagttactaataaatattatttagcaagctctgctatcatacttaggctgcgtttggttgcaggggttcccaacccctcttcctcgtttttcgcgcgcacgcttttcaaactgctaacggtgcattttttgcgaaaagtttttgtacgaaagttgtttaaaaaaatcatattgatccatttttgaaaaaaaattagctaaaacttaattaatcacgcgctaaacgctgcttcattttgcgtgccgggccaaccctcactcctgaacacagccttaatttgctaacagaagttcactaaatagtgagaactacacaaagcaaaagaatggaggtgcaattgctagcacttactgtttagttactaatagtggtttaaggttggagcatgaagagtagatttaatataatatactggattataaatatttacctacctgccacacagctgacaacatctttatgctgccggacgctctgcacaattcttccatcaccaagggaaatgatctgaaaactattctcccaattaccacacagaattaaataattatcaccatgaatttgaactgctgttaggcattgccttccaaaatcaacgttttcggccagggaagtgctaattttacggggagaaattacatcagagccaattccaaagaaaggttcctacaagaataaaacaaattaatgaataaaaactaaatgttatcaaaaaagtactgctatctttgattgtcattaggaagataccagtgatccagaaaacgtgaagtttccaccagactgcaattgtgtagttagccaaagctttactgacagtacaagtccttcgttcatcacaacaatgtttgagtccaacaagctaacaaacaatacaggtgatgaggagctactagagctagggacaacagaagtcactgttatcgattgtggggcaaaatatagtgggtgagcaattggtataggggggcctcttcttgggtgtttcttccggaaaatttgaataggtgtttgtccaaaatttgcaatttggt

SEQ ID NO: 89590 - DNA, 3270 bp, Oryza sativa
  unsure (1)..(3270): unsure at all n locations
ttgactccgagcgtgcgnagttctattttgtcgactntgctagtcgaatgtatttgactccgagcgtgcggagttctattttgtcgactttgctagtcgaatgtatttgactccgagcatgggagttctattttgtcgactttgctagtcgaatgtatttgactccgagcgtgcggagttttattttgtcgactttgttagtcgaatgtatttgactcctagcgtgaggagttatattttgtcgactttcttagtcgaatgtatttgactccgagcgtgcggagttctattttgtcgactttgttaatcgaatgtatttgactccgagcgtgcggagttctattttgtcgactttgttagtcgaatgtatttgactccgagcgtgaggagttatattttgtcgactttgctagtcgaatgtatttgactccgagcgtgcggagttttattttgtcgactttgttagtcgaatgtatttgactcctagcgtgaggagttatattttgtcgactttgctagtcgaatgtatttgactccgagcgtgcggagttttattttgtcgactttgttagtcgaatgtatttgactcctagcgtgaggagttatattttgtcgactttgttagtcgaatgtatttgactccgagcgtgcggagttctattttgtcgactttgttagtcgaatgtatttgactccgagcgtgcggagttctattttgtcgactttgttagtcgaatgtatttgactccgagcgtgaggagttatattttgtcgactttgctagtcgaatgtatttgactccgagcgtgcggagttctattttgtcgactttgttagtcgaatgtatttgactccgagcgtgcggagttctattttgtcgactttgctagtggaatgtatttgactccgagcgtgcggagttctattgcagtcatacacagaggcatgttttttatacaggttcgggcctccattatggataaaaaccctacgtcatgtttatatacattaacttggatatcattcgtatttacatctgagtgagtatactacaaactcgagctcccgtgttctcctttttctctttctctctctcctctttttttttttaggcataaaatttcttcaaagaaatagcattccaagtatgctttaactcttcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcgacccttatttcatctagcatttcaagagttatctctcttccttcttcatctttttggtcaaatatcattcttggagaatgtgcccctacttcgcttggagtcattgcttcatcgccataaaccaatctaaaaggggtcatgccagtcgaccttactaccgtggttcttagtgcccaaagcactgatagcaagtcctccggccatttcccttttgctgatccttctaacctcttcttgatagcttccgtgattttaccatttgccctttccacagctccatttgtctgaggatggcctacagaggcaaagttgatttgcaaattaaggcctttacacatgtcttgaaattttccagattcgaattgctttccattgtcacatactatttcctttgggattccaaatcgacatattatgttcttccaaacaaacttttgtactgctgcagaagttattcttgccactgcttctgcctcaatccatcttgaaaagtattcaattgcaacaatgacaaagcgcagatctcccttcgctcttggaagaggacctactatatctattccccatctgtaaaaaggccagactggcggaattggttgcagttctttgggtggtgcttttgtcattggaccgaacttctggcatgctttgcacgtcttgatgtacttctctgtatctttcataattgttggccaatagattccttgtcttatgacttttgaagccactgaccgtggtgcttgatgagctccacacaagccttcatgtatttctaccaccatcttcatgccctcttcccttgttacacactttaacaaaggagcagtaactccacttttatacaactgtccctctaccactttgtatttcttggacgttagttgtattctctttgcttcttcttccttttctggaagttgtgcactgacaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaacaaaacgccttcatactctgctgtgttgtttgttgaaggaaaagctaattgaacagaatacttcaacgtttgcttcattggtgttttcacaactgcagcggctcctgctccggcggcattgcatgctccatcggagaatgctatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttacgtcatgcgatagaaaataatgcctcaactttcttgaagccatcacaattgcataaatcaacttttctacttctgagtatcgtgtttttggtccttgtaatgcttctgagacaaagtataccggcacttgcctattttcttcttcttgtaccaaaactgcgctaactgtcgctggagttgctgccacatacattaacagaggttgaccttttggtggacttgctaatgttggcatttcatgcaagtatttcttcaagtcatcgaaag

SEQ ID NO: 89591 - DNA, 522 bp, Oryza sativa
tggaacaagagtgatcctaacaaatttaggagacaatattatccacggtataataataacaggaactcatataagagaaaaagcatatgtacccataataaacttaacaacccgaggaaatcaatggccatttaccttgtgtctgacgacagttcccaataaaagtgtgctattctatgactataaataaaaccaaggacaaactttatctaatgttggtttatatctaaaaaaaccagtctttacacatggccaattatatgtcgcaatctcacgagtaagcaatagttaaggtttaaaaattctaacagaaaatgaagatgggacatgtgcaacacaaacaaaaaatatagtatatagagaaattttagattcatttacatcttaatgtatactatatttttctctatatactatataaacacaaacacagtactaacattttccattgcttataatttgcagatgaatatcattgcaattgcagagctgcgcccagggcgatatgactacatgatatgc

SEQ ID NO: 89592 - DNA, 1166 bp, Oryza sativa
gcttggcgcctccgcccccgccaccccgaggcagcagatgatcacatgcgatgaggtcccgttcaaggaggtcgcctggggcgacggcccgtccaagaccacacggatcggtggtcttctggacggcaaataggaagacgcgctcgtctccttcctgcgggcaaatgctgacgtcttcgcatggagaccggcggatatgcccggggtccccagggaggtgattgagcaccgtctcgccatgcggtcgggcgcaaggccggtccggcagaaagtgcgacggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacaacaatgcccttcgggttaaagaatgcaggtcctacttttcaacgtactactcgaatttctttgggtagccaattaggacgtaatgttgaggcttatgtcgatgacttggttgtaaagacgcacaaccaggaaacgttactcacagatctagcggaaacttttgagagtctccgctccgcccgcataaaactaaaccccgataagtgtgtgttcggtgtacctgcgggcaagcttctcgggttcttggtctctgcccgaggcattgaggccaaccccgagaagatacgggctatagagcggatgcgcccccccagcaaacttagggatgtgcaatgcgtcaccggttgcatggccgccctaagtcggttcatatcgaggctgggagagaaggcgttacccttatttaagcttttcaaacgctccggaccgtttacctggacggaggaagctgaaaatgccctcacccagttgaaggcgtatttaagctctcccccagttctggtcgccccggagccagacgagcccttgctactctacttagcgg

SEQ ID NO: 89593 - DNA, 565 bp, Oryza sativa
  unsure (1)..(565): unsure at all n locations
tggagcgcgatgaggacaattcttcattttgcgctttccccaccctgtggcgacttggccccggagagaacagggaggagaggcccccgagccgaacggtgggccaaggcccccgacgattggagttggccctctgcccgcttgtcagaccgtgctagaagccnccgacccccaagaaaggccctgaggccactgtgggaagnccgcacctatcgccctttgaccccgaggctaaccctgtgctgactcgacccgggaaagagaaggagaagaggcccccgagccgaacggaggcctaaggccccagacgaccggagttggccctttgcccgcttgtctgacgacgccaggagcccccgacccccaggacggccccaaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgcc

SEQ ID NO: 89594 - DNA, 856 bp, Oryza sativa
ctaagttagcttaagccccaggggaagaagagtgagagttctccctagagtttaggaacctttgtaacactcaaccctaaatcccacgcacaggagtagggtattacgctccctagcggcccgaacctgtataatcccagctctcacatgcggtctcgaaagactctaggcggatatacgttcttgatcagcgcgccctttcccccggccgaactcacaaagggggtccctcgatcacccgctagagaggatcattcctcggcactaatcacggtgaatctggtcgaccgcccataaccgcgggaacggctattcaaatagttttactctggccagaggtgcacaactgtacccacaagacacagccccacgatacgtttccgtacgccgacatgccaccacgacataccggaaagaggccgtgataggacccttcgcataactccctctaaccaatcgtaccacacctcaggtttcgcccccgtccccagcaggcaacgggcggccccctctcgtgccacggtgaatccagaaaccgatcaacctgttgacgcaaaaaacacacactggcctaggagatctgcttagctctagtgcatgtccaaatcttggtgaggtgcgggtgtgccagtcagtttgatcctacagctgacaagatatgtaaacaacagatcaaacagccgatcggttgtcaagccgatggagtaattccagccgataggaatagggttttgaactatcgataatatgtccaatgtagataatgatataaaggcagtcggctgatgatgatgcaatataacagtaatataatccagtagaaaccaatcaactaacaatatgatatgatagaaca

SEQ ID NO: 89595 - DNA, 2429 bp, Oryza sativa
ccgcaagaacgagaatctgttgtcggacatcacaataaagtgtaattagctccagaacactcggggccttattttattatttcctgtgaatttggagagagaaacattggtgagagtacgattttgcccctgccctcacaccagccagagcaccgccaccacctcctccgtgcggcggccggcgcggtgagtgcgctggggagagggggagaaaggcgagcccgctctgtgccgcccgctgccacacccacgcaggccgccaacgcacgccgccgccggtggcgacagtcgacgcacgcgcgtgccgctgccttctctaccatctgcgccgttgtgccggaagacgaggaagacgacagcgacaaggatgacaagaaggaggaggccgtggagctcgagatgctgcacatcgaccacgcgtggaagtccgtgaagctgacgagctccgctggtgaccaccgcgggctgatgcaggtggagctgctccgttgttctttggtcgccggacattgtcgtcggcgtcagtgtcgtcaatcaacacgtctgttagctccacgccaaaggggtcatcggcggcgatgagcccacgcacgccggctacagtgcgaaacatcccggcgatggctgccgccgctcagacctgtcacagggacagaacacaagcgctgcacatgttcagttccatcgccgccgttggccaacccaatgcgtcgtcactgtccaggtcgagacccaagggcaaacttgtatttatttagtgtttctctctctaaattcacaggaaataataaaataaggccccgagtgtccaggagctaattacactttttttatgccagatagcaaattctcgttcttgcggtgtccacgagctaattaaacgtttttccgataccctgtagcaaattttgccaaaagaaattggtgcttcatgcgtgaaggtaaaggagagtatgcagatacaaatcggagtgtcatttccttacttgcttgttctgtcaatgtcaccgacgtggagtagccgccggttgtttctcttgacccagatgaacacctccttgctggttaaggtgatgtccgacgtccggcgacaaggcccgaagcagcgccttcgcctcaaccgccaccggccaccgccgttaaccgccacggtgtcatcgtcctcctccatagtgtgtcaccgatctgtgggctgggatggtggatcgattcagatccggggaagttgtttttatcgaagtaaatcatttactccgataatagtgggagcatgatgacaggacgtggggtgggatcggaagtagggaagttgtttttattatcgaagtaaatcgtttactccgatatcaatgggtgcgggatgacgggacatggggtgaggtgggcctggactaatacatgtttggcgctcggaatactaaggaacgcactgcgctcctaatagtactactcttttttttttacccttttgacatatattttttactcttacatacaccatagtttttttccttttcctataatatatgtaagggtaaattggataactcattgtagattttgcatgggagggtgataccgtttgtgcgtgtggcgattttggtaggttcaagaactatattaacccacatgataaatttgaaggactcgtttggacaatataaaagctaaattaacccacgaatagaactttagggatcatgataagtctcaggaccaccttcacattctcgtgttttgtacacaggtgtacggaccaagcatgtgccacccggaactcattcgcttgcgtacttgcacgggtagacgggtgatcaaagtttttggccaacgttacgcgtgactactcctattcatctttgcttcaccaacgtgtcaacggagaacactgaagacaacgaggtgaacggaaacgacaacaacactggagacaaggaggtaacggggaccgacgtcgacgaaaaacactgaagagaaggtgaacgggaacgacaccactggagacgtgaacggaaacgacaacaccaacagagacaatactgcctcaaactccagcggcggagtgccattcttatgatgctccaatttatcaactgcactaattcataccctaatttatcaattgcactagtttatatcctatatgcgtttatatcctatatgcgtcatgtttattgtcttaatattttagattaaaatatgtcaaattatgactaaatttccaacatgaaaccacatcgatatcaaatatatatgggcgtatcaaatatatatgggcagcttcacaaataggcataccctaatatacccatgttcaacatatgggcaaatccgtattaaaggtcctgtgggctgtggatgtaaagtgtattcatctgtgtcttcaatgtgcaagtttcaggctgaaacataccttaatcttgcatcat

SEQ ID NO: 89596 - DNA, 568 bp, Oryza sativa
cattggacctgaactacaggataatagagttctctgacaaggcaggtattggagtgaagcagtatctcccaaactataccacagaacaggagtggcagtcccattttggtgcaaggtgggacacatttcaacagaggaaaaaagcctatgaccccttggccatcttagctccaggacaaagaatatttcaaaaggcatcagcgtcactacccttgccctcatgacagtatctaatgtaaatatttatttcctgggagcaaacgtttgtagtttgtacagaactgtaggtaaaatttcttttacaaaaggcaattaactgtagcatgggcaacacagtttactaactactgaatatcagcagtgaactagtggtgcactcatgaacattctcatcaagaagattaaaggagagcagcattgccttactttcaattttctatgaagctctttggaagcaataatttgagcattgtaccaatccaagcaaaatgagaattccagcagtacttacagccgaaagataagctgtgcaatgatgaaactgaccactaacaaaagaactcatgct

SEQ ID NO: 89597 - DNA, 1157 bp, Oryza sativa
cctttcttcatttcacacttatctcattacagggttccttacttataaaggtcatatatgccagcctggccgcttggccgaatcacacaacacacatgctcacacacccatccgacacgttactgtaaacgtcatcctggcgttgtagctcgtcacgcgtgtggtacagacgtgacagtaccgcccgccggagaaacagcttgtccccaagctggtgctgatggaaagcgggtcttgagcacttcataatcctcccaggtagcctgatgcgccggtaaagaagaccacttaatcaacacctgaacatgtgctgcattgccctttttcacaagccgacgatcgagtatttcttcaggtcaaacgtcagcggcatccaaaaccacagggtgaggaagagaagtaaagaccggtgtatgatcaggaacatgtgctttcaactgagagacatgaaagacgggatgaatcaaacttgagtctggtaactgtaaccgataagccgactgaccaattttctctagaatttcaaatgggccaaagaacttgaaagctagtttggggtatggacgattcaccaccgaagattgagtatatggctgcaacttcagaaacacataatccccaactgcaaaggatcgttcagaccggcctttgtctgcttgatgcttcatgcgcaactgagcccgttgcagttgttgttgtaagaaagcagatagctgattgcgttcagaaacaagatcatgactgatggactgaggagagaagtactggcacttgactgacatgaggatcagctccaaacaaagcttgatgaggagaacaacccaatgcagtgtgaaaagaggtattgtaccagtattctgccaagtgcagccatttgttccacttagttgatgttgcttgagtaatacaacgtaagtacatttcaagatattgattaacacgctcggtctggccgtccgtttgaggatgataagcggagctcatactcagagtagtgtcccacactttgaacaaatcactccaaaatcggctggtgaaaattttatcccgatctgagacgatagaatgagggatgccatgtgtcttgaaaactgttttgtcaactgcattggccacttgggaagcagtaaatggatgacgcaagggaataaaatggg

SEQ ID NO: 89598 - DNA, 1846 bp, Oryza sativa
tatagggcgaattcgagctcggtacccgtgatcgagggaccccctttgtgagttcggccgggggaaagggcgcgctgatcaagaacgtatatccgcctagagtctttcgagaccgcatgtgagagctgggattatacaggttcgggccgctagggagcgtaataccctactcctgtgcgtgggatttagggttgagtgttacaaaggttcctaaactctagggagaactctcactcttcttcccctggggcttaagctaacttagagtcgtcccccctttttggtgagaaaggtcctccttttatagttcaaggggataccacatgcaccgccttggaaggagggcgaagcggggcgacggcgggcggagcggtgacacgcacgaagccggcggggcggcagcgggcggagtggggcaatggcgcatgcgggcgaagaggggcgacggcgggtggagtgccgacgcgtccgaactccgaaaccggcggggcgacggcgcatgctggcggagatcggcgcggggcgtacagcgatcgacggcggcctgggggccccgacttgctgatgctgttgaagacgaacaggagggcgtgtacaacttgctgcttcttgtggtgatggacgacgacggcgggagcttgctacttgttgctgctagcttgcttcttgtctgtggatttaacagcttggcgttggatcttgcggcttgcctgtggatctggatatgctcgctgcttgctgatgaagatgcgcttgttgctgacgggagagctgatgggatgacgagaccgacggacggtggctcgccggcgacggatgcttgctgcttgacaccggcgatccccacagcggaggtgcgtgtcctcctcctcctcgaacccatcgccatcgtcgtcgtcgtcttcagcggcgtcggcatcggcatcggcatcgtcgtcgtcttcagcagcggcgtcggcatgcgtcgtcttcggcggcgtcgggcgccgcgtttggggtgtgtatggggggagtgcggcatgcgcgtgtttgctacatcagcggcggaggtggaggtggaggggtgaggtgcgggatcacggtgacgccgccgccgccggtggtagctcctccctcgccggccgccgcccgcgcccgctgcgcccatctgctctctgccagccgcccatcgcacgccgtctcagccggccgccgctcagccccgctcggcgccgcccgttgctactcccccctatcccccgcagcaaagagaactaaaaagaagagaaaaaacaaaggggaaagttgacgtggcacgctgacatgtgggtcccacgctgactcagctgccacgtagatcaaaaccggggtcaaaaccaccaaaggatctcaggtgaccggatttgtatagttggttttgcggttcaaggacgcttttgtatcccggtgacaagttgagggaccttcggtgtactttttcctttgcaatattagatccgatgcttggtgggctcagcccgtttagtacatgggcctgatagtccacatgtatgtttcgttttttgttttctaaaattagtttttgaatttgtttcaaatttatacgtataaagtttctatatataaggtttatacaaacaaaatatattcttttctaggccatgctaacataatgctgaattgatttcaaattcatatatacaaagtttctatggcacaaagttttatatgcaacaaagcatttacgtatgcattttgaatagtttaaatttataaacctttttatataaaatttgtgtataaagaaaaaaaacataggtgggttacctcgtgggctggcaaccccgggaatgagaaaatcactact

SEQ ID NO: 89599 - DNA, 1136 bp, Oryza sativa
aagtgtccctcatctttcttcttccataaccatagtactttttgaaagcatgatattaaaaatagtgtgcagcacatacaatggatttatcagttacgaagctaattaagacagccaatgcataacgaagagattgccgatggaataaaaataatcaaaatataaatattcagacatgtcaaatactttttccttatatgtaaggagttttttctaatacagcacaagcatgcaacgtaccaatacattgaccttcatattgagtccattcctagcaagggcttcatttaggcactgagcaacatctttcccgacctgatattccataggtacaaaaaacagagtgaaataacctaagaaatcaatagtaaaacaaggaggcaagctggcaaggtactgtgtagtgtgtagacaaattgcagcacttcagccatgaaaaaaacgatggaagtaagacgtataaaggtatcaaggtaaatgtaaggggtaaaacatttataagattttgcgttacatattcacaataataaagctattgttgtgatcattgaaaatttagagttttgccagctttctatctatcttgtagtttattgctcatagaattctggaatagaacttacatattacttttctcttcaatttaaatggaaggcatacaatgtaaagcagattaattgaagacatagttttgtaacttacagcctcttcaattgaaaattctttagtccatcgaattaatgtccccgaggaaatggaagtctgtctcacagggaaagaaaatgtaaaaccaagtgccctcccctcaacctccccaccctctctttcaataaaattcttcagtgccgaggcaatgaaattgaacaaatcctgcaaagaaattaaaactcacatacagaaactactaaacgttatagggaagtgaaataaaagggtgaaacatacatcgcttgtacccttagtcaaattttcggggataggctgatgttcaacttttcgattgatgattgtagaccctgcgccaagttctactttcaggactctaaagcttgttcctccaagatcaatggcataactgatgccttcctcgctcctggtcatgtcatgtgaactactgtaagacaattatccaattt

SEQ ID NO: 89600 - DNA, 741 bp, Oryza sativa
aagaaaataaatctgacgggtgagtaacacgtgcagataggagagtagatgaaaaatgtgatgacgatgatattacgaatagacgaattataatgatatttatctaaataaacatatttaaaatggcacggatcgaataaacccaaacaagggtatccgggagggacgcacgattctacctgtttttgttatttttggcccatattgagtgggctttccttttacctttgcaataggaaaaagtacaccgaaggtccctcaacttgtcatcgggataaaaaaatgtcctcgaaccacaaaaccagatatgcgaggtcccttaactatacaaaaccggtcacccgaggtccttcggtggttttaacaccggttttggtctacgtggcggctgagttagcatgggacccacatgtcagcgtgccacgtcaaatttcccctttctttttctccttttttttagttctctttgctgcggggagtagcaacgggcggcgcctggtgggctgagcggcggccggcggaggcggcgtgcgagcgcgcggcggccgggaggcggagcatggcgcagaagaggcgacgccgcggatgaacgcgttgccgacgatggtgtcggcgcacgacgcgaggccgagctcgaagatgacggcctcgacggcggcggcctcggcggtggcgggcgcggaggtcgggaggcggagcatggcgcaaaagaggagcgtctcgcggacggtgaggtggggg

SEQ ID NO: 89601 - DNA, 543 bp, Oryza sativa
tcctcaaatacgtcgtgcgtcgcaacttccgagccacgaacaacatggcagaatatgaagggctcctcgcgggattgagggcggcagccggaatgggcatccgccgtctcctggtcttgggagactcccagctggtcgtaaatcaagtatccaaagagtatcagtgcaccgacccgcaaatggaagcgtacgtccgtgaggtacggcgcatggaacgccacttcgacggacttgagctgcggtacgtgccctgacgcgacaacacaattgctgacgagttgtcgcgtgttgcgtcggcacgagtcccactccccccagggacctttgaggaaaggctcgcgcaaccatcggtgcgaccgagccctttgagggaccccaatgacacgcccaccgactcgactccgggcgacccgcgcccctcggggcccgagggggtcaaccctaacccccctcgtcaggtcgtgtggatgaccgacatctgggcttatctcgaaggcaatactcatcctgaggatcgcgcagaagttgaaaagctcgcgcgca

SEQ ID NO: 89602 - DNA, 1056 bp, Oryza sativa
ccatgcagcagtgctcttggcaaggggaaaaagggttcaggcattatagattctagattaatttgttccactagatcaatgagaacagtaggtaaaaaatcaaatgtcagagatatgcattgaaagcaaatattaaggttggttaaaaacctgggggcaaaaacaacactttaataaacaaaaagaaggtaaggttaatttagaaaaaacttacaagattaaatacaaattcaaggaagtatctctttttgcttcatcctctacagataaaagtcgggtgcgcgcctgcttcagatcgctatgcttgttcaaaacttttggtgacaatccagagttattagcttgcttttcaataagtgatatgagcttccgtaaatcattagcagcttgtccataatccctgatcatttcgtataaggtggctcttcttgaaattgcctgaaattaagaagccattaatgaaatccatgcacaaccacataaggctaaaacagtccatatataataaatgtatcacatattatgcatatgtaaatgtgtgcaaaatgataactgtgtatcataaaacaagagctactgcactttaccttcagataagttgcatcaagaaccatggctagtgaacaatctgctatagcatcagtaacttgaccgagtgcttggtatgaagcagcacgattgcaaaaacagacagctgaaaaggggcgtgaatcactattacgtgccaatgctgctgaatattgttctacagcctctgagtatcgacgagcttgaaatgcttcattcccagcagcctaaaaagcaacatgagcacaaaaaatattaagttatcattaacaaaaatgaaaggctatctaatcggtttcttgctcattctgtgatgttgcgtcaaacataggaaatagagatgcactcatagttactaattatcctgggagtcaataagttgtttatttcttgcacatcctactcagtaaaacagtagaagttgctaaagttgaataaaaaatgcagttctgactgcaagaaagaaatcatgtatcgatatgatagaca

SEQ ID NO: 89603 - DNA, 2472 bp, Oryza sativa
ccaacatgttgtgatcattagctatgacgtgagcaccagtgagaaaacaccgtttaaagatgatatgaatgtagtacatgcactgtttgttaggacaagtgatagatagttgattttatttgttgatgtggtggacaagcctatccagttggtgactaacttgttagtttcagaggtcaatgagatagcgatgcatgaggttgtgacaaccaggtaaggtgattgtcacgcccagaaattcccgaatagaattccaagcagaatgtgcattaaaattcccgtccaggaccggccggggtacacaaacgacaaagttgacatacagatccacgtcttacaaacattataaaagtcttacataaatgtagcggaaaacttaaaaggataactggagctaagccttgacttggactgcagcgggaacaccactccacaggcatcctcgacggcacggacgaagcctactcctcggagaaaccaccatctaatgcatactcaaattctgggggttggggaaaatagagcaagactgagtactacccactgtactcagcaagtcataccggaataggggtatgatgcagggaattatcaaggggtagctataatggttcatttgcataaagcggacatttataaacagaagttgaaagcagtaaaacagttgtaataattaatcaatattaatcatccactgtccaacgctataccacgttgcaacaggcccaaccatccacctatactattcaattccagtagactagtctagggtgagtctaatcacggtgaatctggttgaccgcccataaccgcgggcacagctattcgaatagttttactctgatcagaggtgtacaattgtacccacaagacacagccccacgacacgtttccgtgtgccgacatgccaccacgacataccggaaagaggccgtgacaggacccttcgcataaccccctctaaccaaacacaccacacctcaggtttcacccccactcctcgcaaggcagcgggcagtcccctctcgtgccttggtgaatccggaagccgcataggccgtcgcagggcccattcaaactccatcacgcccacccttgcctggatgcgtcggctagaggaaagctacactacaagcccagccgttgcccacgctggcttgtggtaagtacgaggaattcttccagggtttcccgcgaaccggtccttaattgctctgggcgcgaccatcaaaaccatgcacccacggcccaccatttaatattaattaattaaccaacaccggagcagtgagcattaaccgacatcaatcctagaatctgatatctatgcattaatgtagttccccattgtgtgctagttgaactaagcaaaactaagcattccctagtccaatctctagtcatgttatatcccaagctaacaaaggaacatggtacaagatagcatggctatgacagtaggtaaacatcccatagtgatattataaaacaatgcaatatttgaaggaaaacaatggagcatttgcaatataggatcaacatgttcaagtgacaagcatgacttaccttgctctgcagctggaggaacttcggcgactatttcaaggtacaccggagcgtcgggagagccggaatctaagcgacaaacaaagcaaacaatacaaacaggctataagactactgaaacagagaacaaaaccatttttaatggattctacacatttttcttgatttactgagacttgaatgggcttaaacggagctgggatgaattagttataaattttagaagattcattgtgtttttactataaacggaaaaatccttaattgatttattgcgcaataaataaatcccagggagagagagggggcagcgccaacatgtgggccccacatggcagtgacccgaggtgggcggtccacggcggaccgggtccacggaccggggaaaccggcgcaccatgtggtgcacacgtggcgccgacgtggcgcacacgcggcggccgaaccgacggccccgatctaccctacccaagggtagatcggacggcgggtgtggctcgcggccggcgtgcgcgggcacggctcaagccggcccggcggccatggcgcgcggcggctagcggcgcgcatgcggcggcggcgcgagacggtgaccggcggcgacggagggcgacggcatcgcggcgacgcgggcggcgaagcggcggccaagcggctagcggcgcgggagagagagagagaggaaggggaggggggagacctcaccaacgacgaccgacgacagcgagcgatggagggcggcggcgacggcgggacgatctccggaacctcctagcgaacacggtggaaggggttagagagggagagggaattggaagagggcgaggacgccggtcgaaggcggcggccatggcggtgctcaccggcgaacggcgcagagtgggttccggcggcgggatccaacgg

SEQ ID NO: 89604 - DNA, 1283 bp, Oryza sativa
aatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcagaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgccttccgccttgctagggaacaggtggcggaagaagaaggcccgggtgcttccgctttttcaaaaaaacaagcgtcacctccgctttttcttcttcttcttaacggcggtcttgtagcccgcgccggccgcttccgccgccgccgttggcgggtggggatcggtggggcagttcgggctcgtcgtcttcctcatccagcgaggtgatggtgagaccacgaagcttctcggcgttggactccatcctcggcggcggcgtgggggcaaaaatgcgtgcgtgttcggcgactcgcacttgagagtcgagacggggaaatggtttgggcgaaaaaccctagctagcctcctctcgggaatctcagccggggtgccgagtaggaattcaaaattcaatgggccat

SEQ ID NO: 89605 - DNA, 4443 bp, Oryza sativa
ctgctcaagagctgcgttgcttttcctcggcatgccttctctgtcctgcaaactctacagcaagtgtgctggacgggcaaccaaatgctcttctccaatgaaaatctggattagatggccatggtagctgcctaaactcatggaccaagggcaccaacacatgcaactggaccggcatcgtctgcagcacaagtgatgatgccccaggtattctcagtatttcgcttaactcgtgtggcatctccggcaatttggacgggttctggtttgcagaattcccccatcttcaaggactcgacctcggaaacaactctatctctgggcctatcccatcaagcataggtcgtcttgtcgacctctttgatttggatttgtccagcaataggttttctggatccatcccaacaccttaggtaatcttacagtgctaacctctcttgatctctcttccaatttgttgtcacaagggctatctgattcaggaattggcacactagacatcttggaggtcctcgatataagcaaaaacaaattaaccggctcaataccttatagcttgggaaacttgtccacgttgtattttctagaccttagcttcaataagttttctggtcatattcctcatgagctagggatgcttcaaagattgatatccttgtatctatttagaaatgaaatcacgggttccattcctaatgagctagggatgcttcaagatttagtatcgttggatctatccaataatagaatcaccggtttcattcctaacttaggaaatctaacaagcttagtgtcattggttctatccgataatagaatcgccggtttcattcctaacttaggaaatctaacaagtttagtgtcattggttctctccagcaaccaaatcacaggttccattccttgaaccttacggaaattgaccaatatatagcaatactgggatttgagctagtccaatgagtcaagtggtgtactctaaagaaaaaaaatctaattaatttaaccacctaaaatagcttttccttttcctttttgggatttatcaccctaaactacaattcataaatcccaacaaggaaaaaaactattttacgtgggtatattagacttttttctttagagtacaccacttaactcattggactagcgtccaagtagcccaagttccatatatagtagaatgtggttttagtaacccctgtgataaacgaaaaaaaaggatgattcaaagtttagtgacgttggatcttgcataaaatgtaatcagcacatttttagggtataattgtttcacagaacaccatgttttgagcccagttgattataaaaagaaaaccgaaatccgatatcctgccgccctgcctttagctgacatacggaccccaccagtcagcttcaagtctctcttccttcctcctcttgttagatgggctgggcattgcagagatcgccgccgatttgcacctgattcagtgcccattcttcagatttaacaatggaaggaaagagcagatctgcgactccgctacaaaattttggtaagggaaggtggtagcggcgatggaggagctcgtcaaaccaaatgcttcatcttcgtcgtgatgccacatcactgtcaaagaggctgtcaagtaaaatgggcaggaatggctggctctggctgcctccaaatccaataaaaaagagtgatgaccttgattgtgatctcaagtctatagatgtaattgatctctcttttccttctctttacctcctgaaaatctgatgtaatcgtgtccatgcattcgtgtgtaatcttatatacttatgttgtaccaaagtactccccccgtttcatattataagtcgtttgacttttttcctcagtaaaaattatttaggattgattaagtttacagaaaatttagcaatgtctatgatatcaaattagttttattaaatttattattgaatatattttgatacaatgtttgttttgtattgaatattactatattttgctacaaatttagttaaatttaaagaagtttgaattaaaaaaaatcaaacgacttgtaatatgaaatggagagagtacaacaatttgaagcaatagttttggttccctagctacatgagcacagcgccgcctgccttagagcaggtacaatagcaggctattagccagctataaacatattataatgagataaacgataagagagaagagcagcgggctataaatctgtagccagctgcagcacggactccaagacacactgtgtgtatgataagtgggaccatatattaataatatagtaagcaactattgtatgaattaactattagattggctatacatgaattgaagctagtagtgggctatactattagacttgctcttatgtcaattgccaagtctcgtctgaattccattgcttggctggtaagagggaaaaggtaaatatatcatatatgtgaggctggctggtggggccgtatgtcagatgatggcgcgcagcctgcaggcagaaaagggtaacggattttggttttcttgagttggtcgattgggctcaaaatatggtgtttcatgcaacaattactaccctaaaatctgttattttgggatagttttgccctcaaatcgtacggtgggacttgagtcccatcagatgatttacgtgcactgtcatcaaagtaggtttatttttcccacataattattctagcaccacaggtagcatttcacctcagagatataggacaatgtcagaatttgatttacctccacctttcaagaattttattttcctaagaatatcaggtaacttagggtgtgtttgagaagaaaggattgggaagattggtaagatacgcaaaacgaggtgagccattagcacatgattaattgagtattagctattttaaacttcaaaaatggattaatatgattttttaaagcaacttttctatagaaatttttttaaaaaaacacactgttcggtagtttgggaaacgtgcgcgcggaaaacgagatgattttctctctcaattccccagattgcctaggaacgaacgaagccttagtaactataacaggtccaaatgtccaatactgcacgagagcttgatcattgtattaacctgtatgaactatgaactcagatcggagatagtatcagagcatcaccaacataatagcaataatctatccgcaaaatttgacttttgggtctcctaaactaaaaataggaaatgaaaaaaacttctcccttcaaaagaaagcctaaattctatttctaaaaactaaaagtgggcatttctattaaactacaaacaaaaatttccattttcttccttccccccacgcagaaagagatcgcacccacacgcgggaatgggaggagagaggcggggagcgcatgattaggagctatgccaccggtcagacaaaatatatatagtgagtgtgggttattttcaaatctagtcaatatttcctattttctatcttagataccaaatttatgtgtcaacattttggtgggctatggcctgggtgagctagtctagctgagcaagatctatccaaaggtccaaacgtaccctaagaatctgtccataccttaaaaatccttgaaaacaaaattttgaggatagattgttgggcattattaatgatgttcttgttaatttgccgccgtggtaaacgttcttgttattttgatacccaaagttagcagtccctctgaacttttgccaatttctcctctctttttttttagaattttttttccaatttctcctcgtcctattttcattttcgttttcaatcttttagtctcaggctctcagcacctgcacagccaagcctaatccttttctctctctctctctctctctaatctctccagggtcgatcgaaggaatgagggaggctgggctggccggccataccaccttcttccccatcttcgtcgtcgcgccggcgccaccgccggcggcccaccatcacctaacacctgtgtcgctactgttgccctacctgaagaatggggatcttctactacaagtacccagattcttgaagggcgggaaggattcgccaactcagagagtcagagtactgaatcttgccatggttcagttatcccaatggtgaatcattttttttttaaaaaaaaagaggtactattcccctctatttgctgctactaagccctgacaggattcttgtgcgattctgctttcgtattcagtttgcctgattggcgtttctctggattttgcttatattccacactgcctagagcttagcattttggtaaaaataataaaaagagcttatcctagttcagtcacatatcagcattggcgttgttttcttcattcccaaaacacaaaagctatacgtacccgagggaggttggatacatacatatatatatatatatatat

SEQ ID NO: 89606 - DNA, 1292 bp, Oryza sativa
  unsure (1)..(1292): unsure at all n locations
tacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttggtgtagggtataactgaacccatgcaaattcctccttgtagctgacattttgatcgcatgatcctttacatgtgtacacaacaattgtttgccaatcaagagagtcttgctcatttttcacaccaaaagtataaagcagctgtggcattatctgcagtacaaataagtgtgatatgtaagcatgtctgtgtgaaaaaaggggtgggtgcctgtttgccccttactgtcgtacaccttaggaatggtaggtctcactgattaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcgaatggggccaagcaggattccatnntcaaggcccgcg

SEQ ID NO: 89607 - DNA, 1381 bp, Oryza sativa
  unsure (1)..(1381): unsure at all n locations
cgacgcgccttgaattgcgacccngcttcgnacccgccgnaacttgatgatccatcctcgcaggacctcgtttgccttcgagcgcccctagcttcggatcagtgcgacctacagcaccggtttctcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcgggaactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtaccagacggagagcaaagtcatcaatatcctcacctggcttgaaagccaggttctcccactccttgcggagtgcctgcagtgtggacttgcgggcgccttcgttgctgatgcgtgcccgcacgatggcgtcctaagcctccttgcagtccgttttgggaaaggagaacttgatttgggcgggactgcacgatgaggcattcagtggccgcgatcttgttgtaatcgacgtgccgtaccgacttgcttcacatgtgccgaacctgagcctcaccccatataccgcggccactttatgttgttggtttggtgagggtggccacccaccgccgggacaaaaatccttgccacgcgttgtacccgcggggaccctgcgcaagtcaaggaaagagaaccctctttcttgaagggccgntgcggtcctgtttcccttgtacccccccccccctttggttttcgtcggggggcgccgtgctcttaggcgccccgccctcccggaggaggtttatgtccaccatttgcccgtctcggtgcctctcttgtgcanttctcagaacctgttgtggagagttcacgccgtgtgactcttgtcttctcatcaaggtatacattcatctctggcacggggcgtatttatcgccctccctcgctcgggtgtgaacatccgcggcgagatgagcccttcttttctacgaggtgtggacggtttctctctctttttggtaaagatctatctctactcctcactctctgaggacct

SEQ ID NO: 89608 - DNA, 700 bp, Oryza sativa
aaatatgaatcgtagaaaggtttatagaagaaataatgcaaggcattagtacctctatgttttcaacgtcctccattggttgtctgaagttagtttggctagacaccaactcacaactaccctgtcgcctatttgaaaagccaggtgaaggcatcttcatgttaaatgcctcagggtcacggttaatgttttgctctgatcctgaatctttcattgctaatgatgatttgagtcgagcaatctggatagagatagaatatatgcataccttaaacaacaaatgcagtgagaaaatatgatacaaagcatagtagcagaaacaaacctgctccttaagttctttaacttctccagactctttgttcaaccgagcagcgccaagttcaacagtggatacacgctcggcaaacttcaatgtgcttatgctttctcctaaagcatcactttctgggcttatatgaacaaacatcaaggttttgccctgacctcctgtagacgcattgttaaaattcgaggaaatataaattatactcagcagtcagtgacagcacatttaagaaattgcaagaaggttaaatcttaccaagagaatcttgcagaagttgtgttaatttactattcctgtaaggtacatgcgcactcttttgggcaagtgaagcaatcacatcccctaaagccgacatggattgttatatgttgg

SEQ ID NO: 89609 - DNA, 742 bp, Oryza sativa
ccgtgaaatgaaatctgaatgtcgatgcccgcagttcgactctagaggatcccccaccctcatcgtcgattgctttaggcacactctcttgtggagcctgtgattttgacgcgcgccttttttttgcctttctgggcgcagggagggaagagcgccagggtggtgaactgcgtactggcattgaagtcgtacggtgactggaaacaatgtggtggcaccgggccatggaaatacggggggaatttgaagccgtcggcttccggcaagtcgttcgtgaggaagaactccgagccattccggaggtgccaatcgatgaacgagggcgaggtgccttacgaggaggctggattcagcggtgattatcatcttgattccggtgacatggttagctccgtgcttcaattttgaagctgctttgtatttgtcttgttttgctagacgatatgcggctaaacggttaatgcttcgtgcagtcgacgtcacgccctttgaaaatgttggttagtgcagttttgtccgacaagaggcccgacgaagttccacaggtaggccaatcaggttccccattttttagtaagctgtttactggttcaatgggatacatgcaagcagctttccctttcatgtgatgctttaccggttccttggagtttttatgctattgtttgcctgcagctcttggagtccatgctgagtaaactcgtcgaggaattcgagattcgattgactagccaacatgaat

SEQ ID NO: 89610 - DNA, 3738 bp, Oryza sativa
  unsure (1)..(3738): unsure at all n locations
gtctgtcttcactacatctgtgtctacgcgcccccttcgttgtgtttacgtgcgtttgttgttaaagcatcgtgtagcgtcataagcatctgtttttatctagtcacgccccttcttgtatttgtttgtgaggtgtccgaccctactcaccaaagagaggtgttcgccacttttttttagcccaccccgccatttgttccaatatgaggcatgacagatctcccattgtatttagtgagaatcatctctcttttaagggtggtacatctttttattttttcgtggggcgcccttttgtaaaaggttctcgtcgcatatgtcccctatcttgcccatatggtttttttgtttcttatcaccaaacttgtttcgtatagacgtatgtataaatccctctccaccggtttatacgtatcgttcaataaatggcctgatcgggtccccacaccctgtacgaggaatctcttgtatcaaaatcttgttctgcgatttatctttattaagcccgttcttattgtccgatcagagcccctatccgttccttttaaacccaatgtttgaggtttagcccatgttaatatttgcttataattgtactattgtctggttgctttatactccctccgtcccaaattataaggcctatatttttttacatgatcttcaatgatatactttgaccaataatttattccatgttatgttcccaatgaatatgaaattagcatcacatgaaaataatacaaaatatgaatctagtgatataacatgcataatacttagcatagatatggttaatatgattattagtcaaaagctattgagtttgatttcctaaaaaagagagcgtcctataatttgggacggagggagtactttgattgctttatactagggcaagtaagtgtccatcttaccatcaattattagtactttgattgctgtatactatgcactataggttctggtatacatggtaccgatcaggtcgattaatcgaggttgatcgacgattaatcatcctggtcggtcccttggcgatcaggatcgatcagcgatcagataacattgcttctcacatcatggttttatccaccttctctatatgcatttttgtaacactaaatgcatttcttagaagattaagttcaccttaaactttccaacagattgtggtaaatcaattttctcgtgtagctgcaaatgaccgctgtcaattctatgggaatgtaacactaggaagggatgtatctctatcagagcttcggaagacatatgatgttgtaagttttagactatagccaagtggctacctttttgtggcaaactgatatatatcttttaccatcatttctgactgtgttacactgatgtatttactgctggacaggttgttcttgcttatggtgcagaaagtgataggtcacttggtattcctggggaggtatacctaacttggattcccttggtctctatgtcaaatattgtttatgggcaactgtagtattttgttatttgtgaacaattgttcggaatttgtttatgtatctttatgagatggttgtgtctaggtatcgcttaataaagagagtgcatataacgtttacaaccatactaacacaaagtgaaagagacaagataagttgtgtaatcaccaaataattgcatgcagggaataaaacactgaagaaacaaaattcatgtatttatgctgaaacaggatgtcacaagccattgaaataacaacttttttatttcggatattggcaagattgtgtagtgctatcaatttatcttatgattttcgttttgttttttcatcatgcgtgtgagttgtttattctcagtgtcatctttgttataggatctgaggggaatacattcggctcgagagtttgtgtggtggtataatggacatccagacatgtgcaacttggcacctgacttgcaaagcacagattctgctgttgttctaggccaggtgtgttgattttatgattgccaacaatctaacatgctgccaagataattgtttcatatattctatttctattcaaagtacagtctgtctatggtttcatttgaattgaagaactcttctggttcattaaaattggcagatttatttgtagatatatcctgtagaagtattcccagaattttaatggagaaaatcttcctttcatatatgatttctggctccttccatttgaggtttatgttgtctgcactctgcagtgcttacacttcagcattatatagctgtgttagacacataagttcaagtgttcattatcctgaagaaaatttgttttgtttctgctaacttactgcaaaagaaaatatccttttatgggaaatgtgtcatgtgcccagttaaatattcttttttttggcccatcctttaataccagttttcttctgtgcttctgatgatatgcagggaaatgttgctcttgatgttgcccgtattcttcttcgttgtacatctgagttggctgctacagatattgctgattatgctttggatgctctccgtggcagcacaataaagtgtgtccaatcttttgaatttgaaacaacatgttccattttttcaatcccttccatcagttcagttttaatggatgataatatttgtattgcattttttttgtatgtaaaggaaggtatacttggttgggagaaggggcccagtacaggcagcatgcacagctaaagaactacgtgaaattttaggtagtttgttttactgtttcattagctgtagcttaatgttgtctgtattagttttctgtcattttaaataatgaatgtttgatgcatatatgcaggtttgaaaaacgtccatgtcttcatcaaggaggctgatcttgtgaccttgcctgcagatgaggtttgtacaatgacatgaggtgtttcatgttgctactggacctgtaactgttcttttcgatatttattctggactagagacctcatttcctaatatttaaattcataacgaaataaaacttactcatccatgttggtagctactacagtaccttgctgtcaacatgatgccaatttggttttcggaatgttccatccaccttctctcttaggttatcttgcttgtgattgtgatagagcaaagcaatctgattgcaggaggagattaggaatagtagaattaaaagaagggtgtacgagctactatctaaagctgcaattgcgcataaaggaaagaataataatggccaaaaggagcttcactttgtgttttttaggagacctaccagatttctcccatcagaagatggtgtgacagttggtgccgtgcaacttgaaaagacttgtttaaaaggtcagatgtcagaaacgaaataccatatctttgcagactttttttaaacattattctgttggttatatagatgatggtgtggctggaaagcaggtcgtagttggaactggtgagtttgaagatctaaaatgtgggtaagtgctttggttcatactttcctgagtttttttgaccaggcagctctatggggtttcctagattcatttaatgtattttgtgtcttctgggnctgttcttnnnnngtttgngttgggttggaccnacagnctaataaacatggggggggggggngggnggaatataaataaccaaaaaacagcaaacangtaggaaagatgaaggatagnaaaaaaatacatagcaaaaaacaagttagtaatgagtgaaga

SEQ ID NO: 89611 - DNA, 1311 bp, Oryza sativa
  unsure (1)..(1311): unsure at all n locations
ccgccccttgttgacttgcatagcangacgcccgaggtcgactctagaggatccccttgcacattgttgcaatacttcacttgttacagctttccattctagcttttccgggtactatgccaaagtcagttgaaactttattcctggtatctctataagagcagaattggctttaatgtaattctacaagacatgctagagaacaaaattgactgccctcactttcatccctagtttgaagccatcaggatttcattccaggttgttatcttctctctaggtttgttcttcagctcacctgccatcttttccttagaatcaatcttttcccagccatcaaaaggaacaaagcggatgttcttttgttctagaatctcaaggagtcccctcctgccttgcttttttgaatcagaaggtcccatgaacaaccccttcttgtcatcttcaaggatgctcgccacctgtatataacagtaagtacaatatgtagatagtctgttagtgaaataaaattatcagctaaccaagaactataactcctgaaaaagagtcatcatgattatttcacaagaacagccttcctctacaaagtagctattccattgcaaagacagtagtggatgagcaaatccacaataattgaggatttgaggtgtatatggacctaatgaacttccatgttggaactttcaaaacgaataaatcaagctactccaagatatatttgaaggcatttgttgagtaaaccaaaaaaactactataagatttaaggtaagcaactataaagttacactcaggcatcagggtgcccataaaccttctcaaacacaatgatagaacataagaaaacaaaaaggcccatactgtttcttcggcacaatggagatttgtggcaactatgccagttggccctttttttaaccatcccacccaaacaggccttggttcactggggggatttctcggaattttacatttatccttctaaaaaaaaaacacccttggggccgcctcttttttaaaaaaaatattttgtgggggggggggaacacacaaacaaacaaatctattttcttcccctccccctctcttgcctaataaaaagatgtgggccacttgtttccacaattttttagggttaagtgttaaaccaacccacaaagctctctgggaggtaaaaccaaaggtattatttggccctcctgttttttcaaggggaacctctccgggcggggttgttcctcatntttttnaanannnnnnnnnaatcatcnntttncgngggnnnnnnntnnaaccnttacacccca

SEQ ID NO: 89612 - DNA, 622 bp, Oryza sativa
cgtggggaagaagctagacacggtgcagtgcagcgacgaaagaaagtcatcttcgccgcccaccagctgcaggggcccgcatctctctggtgggaccacttccaggctacgcagccagaggggcagccgatcacttgggctcgcttcaccgccgctttccggagaacccatgtgcccgccggagtcgtggctctcaagaagagggaattccgagagttgaagcaaggcaaccgctccgtgatggagtatttgcacgagttcaacaacttggcccgttacgcccctgaggatgtgcgggaagatgaggagaagcaagagaagttcttggcaggaatggaccccgagctgtctgttcgtctagtctctggggactatccggattttcaacgactggtggacaagagcatccgcttggaggccaagcacaaggagctggaatcgcacaagcgccgcttggcgaacttccgcaatcagcagggtgctaaccagagggtccgctacaccaatccctatccagggggatcctcctcgcaacagcaacaacagcagcagcaacctcgcccagcgccccgaactcaattcgtggtgcgcgtcccacagccgcagcagcagaatcagcaag

SEQ ID NO: 89613 - DNA, 670 bp, Oryza sativa
agttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccggatactcgcaaggatttcatggtgtattgtgatgcttcgcgccaaggattggggtgcgtgctcatgcaggacggtcatgtggtagcctatgcttcacgtcagctacgacctcatgagggcaactaccctacgcatgacttggagttagcagcggtggttcatgctctaaaaatctggcggcactatctcattgggaaccgctgtgaaatatatactgatcacaagagcttgaaatacatattcacccagtcggatctgaatcttcggcaaaggagatggttagaactcatcaaggattatgacgtgggaatacactatcaccctggtaaggctaacgtggttgccgacgctctaagtcggaagagccattgcaatactctcaacgttcgaggcattccacccgagcttaatcaacagatg

SEQ ID NO: 89614 - DNA, 1930 bp, Oryza sativa
aagtagagcacatgcaagagtgcaaaactcccccttaatgtgacatgctccatttttgcaatgaagaaccaaatggcaataattccaaagcataagcgcgaatgagagcaaatatacacactgcaaaagaagcaaccatggtgcaccatctcaagccacattagagaaatctatgacatttaactcattcctcaacttgcaaaagcgggtttcatcaagaggcttggtagagatttcggctagttgatccttggttcttatgtggctaatgactatgtcacacttggaaacatggtctcttaggaagtgatggcgaatgtcaatatgcttggttcttgaatgttggaccgggttatgggctatctttatggcactatcattgtcacataggagtggggttttggtgaaggatatgccatagtccaacaaggtttgtttcccaaagcaattgggcacaacaactacccctcgaaacatattccacctcggcggtagagagggctacggagttttatttcttggatgaccatgacacaagggatctaccaagcatttgtcaactaccggatgtgctctttctatccaatttgcaaccggcataatccgaatcgaaatagccaacaagcttaaacttagcaccttttgggtaccacaagccaatagtagaggaatactttaaatatcttagaatccttttcacggccactaagtgacactccttaggagcggcttgaaaccgagcacacatgcaaacactaaacatgatatccggcctatatgcggtaaggtaaagcaagctacctatcgtggaatgataaagcattaagtctaccggtttacctccctcatcaaggtcgagatgcccgttggttgccataggtgtcttgatgggcttcgcatcatccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccctgcaaaatacctcattagtagaaccgaatatgatatcatcaacataaatttgacacataaagaaatcagcaccaataatttttgtgaaaagggtggtgtcaacttttccaattttgaaatcctttgacaaaagaaaatctctcaatatttcataccaagccctaggagcttgttttaaaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaagcatgatgcaaatttaagaaggatgcgaatagcctcaagtcttgccacgagggcaaaattttcaccgaagtccaaaccttcaacttgtgtgaaaccttgtgccaccaaccttgcctttttctcaccaccaacccgttctcatcttgtttgttcctatagacccactttgtccctatgacattgtggcctctaggtctttcaaccaaagtccacaccttgtttcttgcaaagttgttgagctcttcatgcatagcattcatccaatccggatcacaaagagcttcaactacatgttttggctcaagacaagaaacaaacaagtcatgttcacaaatcaaatcgacatgagatcgagtttgaacacccttagtaatgtcacccaacacttggtcaattgagtgactcttggaaagagcggtgtgtatacgtttatggcttctgcccaaaaggaatcggaaacaccatattcatcaagcatagtccttgccatctcaatcaatgtacgatttttcctctccactacaccatattgatgaggtgagtaggtag

SEQ ID NO: 89615 - DNA, 914 bp, Oryza sativa
tgtgtcttatgggtactgttgtgcacctctggccagagtaaaactattcgaatagccgtgcccgcagttatgggcgatcgaccagtttcaccgtgattagtcccactttattaataacctgacataatgaactggtgtagttaaggtggtttggttgggcctgttcaacatagtgtagcgttgttcagtggagatttaatcctgcctttcaacaataaaataatttaccaccgcctttatgcaaatagccacagacctctatttgttacccattgcacgcctgcatcattggtgtggcttgctgtgtacggtggttatactcagccctgctattatacccccttttcagatttgtagtgcttctgagttggtcctctcccttttcacttaaatggtccgcacgcgaaaatgagcatattttcgcgtacggacctattaagagagccgcacgcaaaaatacacaccctctcttttcctcctacccactttaaataattttgggaaaattggaaccatgccattataattttgcaaaattccgatattgacggcagggggcactgggcggtgactgatcaggctcttccgatgctttgagagcacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacga

SEQ ID NO: 89616 - DNA, 780 bp, Oryza sativa
tgatctgctccgttcggaagttatttgcttggccaaaagtcataggcaacgtaattttgcccaatggtttggacgatgactgaggagtgattccatggaaaggttgatcggtgggtgtcaactcgcttcgtgggatccccatcgcgtccaaagtgctagcgaagagaaggttgattgagctgccgccgtcgatcagaactcgcgcgaccttgatattccgaatagtgggttcgaccacgatcggatatcgccctgggatgacagcagtcttggggtggtcctcttctgagaattctatcttctgctcagaccactttatcttgggcgcagctccctgccatgttgaacagacttcacgttccactttcttgtattctcgctttgaggagtatgctgtggaacctccgaagatgtgcgagacatggagatcagagtctgggtatgctgagtccgattcctgagtagccgccttagcgtccttctcggccacacgtactcgcttgcctttttccaatgccatgtgttttgcgagcgactttttgaagatgaggcaatcttctagagagtgtctgtccgacttgtgtatagggcaccatgttttcttcgtgtcgctgctttgtgggtctgggcgcttgggagggtccgcgtattctgttgcgagaacttccgcttgagctttccttttcccactcttgcgatttttcttcttgcttgactcaggagcgtccttggctggtttcttctctcctccggtctttggtttgtcgttcttgcgtctca

SEQ ID NO: 89617 - DNA, 773 bp, Oryza sativa
tcacgctgaattcgatacagcatacaatgctatcattgggagaattgcacttgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacacgcccagcccacccaccacagttgagccacccaagaaagtgagcaaaacaaacaagacggcgaaaccggacggtgcaatcaaaatcgttccactctccagtgccaaccctgacaagaccgtcaagatcggggcatcactaggcgagaaataggaactcgcgatcatcaccttcctccgcgacaatgctgatgtgttcgcttggcagccgtccgacatgctgggggtatccagggaggtgattgagcacaaactcatggtgcgaccggacgccaagccagtaaagcaaaaactgcgtgagatttgcaccagatcgaaaacaagccatacgagaagaactcgacaagcttctcaaagctggttttatcagagaggtactccatccagagtggctagccaacccagtcatggtgcggaaggtcaacgggaaatggagaatgtgtgtctattttaccgacctcaacaaggcgtgtcccaagaatcacttccctcttcctcgaatagaccaactggtggactgaacagccggttgtgagttgctgagctttctcgacgcttactccggctaccaccaaatcagcatggcg

SEQ ID NO: 89618 - DNA, 599 bp, Oryza sativa
ataacacagccgagtacgaaggactactcgccgggataagagctgcagctgcacttggagtcaagcgactggttgtgaaaggggattccgaactagtcgcgaacaaggtgcataaagattacaaatgctctagccccgagttatccaagtatctcgcagaagtcaggaagctggaaaaaaggttcgatgggatcgaggtccgacatctataccgcaaggataacatcgagccggatgatctagcacggcgtgcgtccagacgagagccactcgaacctggtacctttctggacgtcctgacaagcccatcagtgaaagaggcaagcggcgaagatagcccggtcgccctcaacatcagctcgggggctacagaggtagagcgcgccattgccgatatcgagaccacagacgaccggcgcaccccactcattaaattcataggcagcgaagagttgcccgaggacgacgcagaagccaaaaaaataacccataaagcaaaaatcaactgtatgatcggcaacgatctatacaagaaggcaccaaacggggtactcctaaaatgcgtctcgtccgacgacagtagacatctcctcctcgac

SEQ ID NO: 89619 - DNA, 756 bp, Oryza sativa
actagacaaattactgagagatgcaggatatagcttggatcatttccagttaccgcagctaagccatcatgcttttccaccattggagtataggcttataatggatgaacttgcttatggaacaaacagtgtgactgaactgcttaatcaattaaatccttatcagaggcatgtttacactgccatagaatcctcagttttaaataattctaggcaaacattttttgtttatggatatggtggcacagggaagacatttctatggaataccctattgaacagcattagaaatagagggaaaatagccttgacagttgcatcttctggtatagcatcattgttacttccaggtgggcgtacacctcattcacgctttaggattcctctagacatccaggaggactctatgtgtgctattaagatgaacacccagctagctgaattgattcagcagacatctctcattatatgagatgaagcacctgtcaaccataggcattgttttgaagcattcgattgaacccttcgggatatcatgtcatcagtcaaccatgattctgtgaacatgcagtttggtggtataacagttgtcttgggtggtgattttagacaaactctaccagttattcctaatgcaaggaaacaacagatcttgaatgcctcaatcacccgttctcgcctttggcaaaactgtgtggtgcttgaattaactgaaaatatgaggctcagctgtccaggcctttctcttcaagataa

SEQ ID NO: 89620 - DNA, 585 bp, Oryza sativa
gaggatggtcgcttgagccattacagaattgactcatttcagaagaaatatagagccagcccatacaactctttggttcaggctgttagcaccggcatgacacaaggatcaacagcaggtcaaaagatcgttttgccagcttcatttaccgggagcccacgttattactatcagaactaccaagattgtgtggcactttgtcgtcggtttgggtgcccacatctattcatcacttttacatgcaatgctttatggctagaaatagtagaagctttagcacccatttcaggacagtattcctctgatcgacctgatattgttgatcgtgtttttcatatgaagctaagaatctttatggatgacatagtaaaaaaccagttttttggtccaatatctggaggtaatttccatagctccttaattttgcgcactatgttctattacataatgtatttcccgttgatatttcccatctacatccaaatttttcggctattttttttggcctgattttccccttcgatacttctcaattagttttccattcccttttttgtagttgtctacacaattgagttccaaaaa

SEQ ID NO: 89621 - DNA, 576 bp, Oryza sativa
cctgatccaagaccttctggagatcgagttcaagatgcgccaacctcacacacgcaaggacatggcatgccccggtatatatcccgttagatgtctcctctccgatcctggccgcgtgcttggaggggatcgcctccatcgccgtcgctagctccgcaagcgaagtcgtcagcgagaactcattgggattcgccgggatggtggacttgataccgcactccccggcgagctggtgcagaccagtgtaggtgacccgcaacgagccacggatttccgacaagttgttctcgagctctgacatgcgatgctcgagcccctgccattgtcgctcgttgccggccaccagttccctcatcttctggaggtcctcgcgtacctccgccagacacgcgtcagccggtcggcgcgctcattcgccgacgacgccgccaccgccctcgcctccgcgatctcgcagctaacaccgcgagcacaagcctcgaggaggcgccctatctcgacctggagctcctcccatgtgaggacggcagtcggcggaccccgacctgccgcgagatcgctggctgggccgctcgg

SEQ ID NO: 89622 - DNA, 1788 bp, Oryza sativa
cagggatgcttatggtacagcttcatcaagaagagccttcatggcatatgtgtctgaagggttaggcaacctacaagactggaatcaggtaatggcgtatcaaaggaagaatggatcgattttcaactcgccttctgcaactgctgctacaataatccatggccacaactatagcggcctcgcttacttggattttgttacaagcaagtttggtggcccaggtgtgccccccccctccccccgggtactatatgtattttgcccaagcaagtgaccaagaatgtcaactagaaatatgagatgtcaaatatactaactggaaatgggtgttttccagtcccggtgatgtatccgcaaaatgcttattcacaactttgcatggtggatactcttgaaaggatgggtatctctgagagttttgcttgtgaaataagtgatatattggacatgacatacaggtaacagcaactcataaaaaaatacctaattaaaaagatataggagaggctaatgatggcaatttgatgtgcctttgtacctactactttatttctattgtattatgtttgcaggttatggatgcataatgaggaggagctaatgttggacatgagaacatgtgcaatggcatttcgcctattacgtatgcatggttatgacatcacctcaggtactgcatggagcttcaggacacttaaatttgaatgtcctagcttttgctcggttttgcagtacaaaatttcaattggaaatattaataatcatttcggaactattgagcagatggaatggctcaatttgtggaacaatccagctttgatgattcaattcatggatatctaaatgatactaaggctttgcttgagttgtacaaaagttcacaacttcgttgcttggaagatgatttgattctagaagaaattggttcttggtcagcaagagtactactggaaaaaatatcttccaaaatgatacacatatcagaattaccggaggcaagtactaaataggcaaattttgctagactacacttaaagtttatgtaatttgctggagatcattgtaaaaatgtgtcacggttgaaggaaaccctaaaaaagctagtaatttgctagaggatattttcagaccaactaaagagagcaagagtaaagatataaaatactgcttgctagtattaatgtatttggggtgatggcaaatttagagtcacatttttctaaattttctctccaacatccatgttacaagtctgtgaccattggggcattctcgtttatttgaagaatttatctatccaattaggctaaaaatgtcctctgccaaattaccaattttttagagtgttttccaaccatgacatgtttttatgatgtttatatcaacaaattacaaatactttgggtgttctgtagaaaaatttgcctactaaataacatcttagcgaacaaatgttcttgcaaaaaaacatcgcagccatgcaaaagaaggcgaatctttctcataatgccattatcatactttcgctttcgcaggtggagtatgccttgaaatgcccagtctatgccatcttggaaaggctagagcagaagaggaacatagaacaattcaagaccaaggaacaactaaaaatcgagggcttcaagctgctgaaatcaggataccggtagatatcattgttacacatcacagccgtacaatttatttctttactgttgtagttgtctaaatcgtgaacctattataacatggatcagtggcgttattccaaatgatgaaattctggct

SEQ ID NO: 89623 - DNA, 1429 bp, Oryza sativa
actttcgctttcgcaggtggagtatgccttgaaatgcccagtctatgccatcttggaaaggctagagcagaagaggaacatagaacaattcaagaccaaggaacaactaaaaatcgagggcttcaagctgctgaaatcaggataccggtagatatcattgttacacatcacagccgtacaatttatttctttactgttgtagttgtctaaatcgtgaacctattataacatggatcagtggcgttattccaaatgatgaaattctggctttggctgttgacgaattccattcctctcaatctgtctaccaacaagaactccaagacctcaataggtgcgaaatctatctatatatgatcatatatacctatcctcgattcatccattccaataagatgtttttgatatcattcactaatattgagcatatgacagttgggtggcacataccagattggatgagctgaaatttgcaagattaatgccatcgataacctatttcagtgctgctgccgtcctgttgccttctgaatcagcccgcattgcatggacccagaactgcatcttgacgaccacagtcgatgacttctttgacggtgaaggatcaaaagaagaaatggagaacttggtcaaattaatagagaagtacaacacacctgtacactatgtcttttgtacaactaatatctatcagtcctgttgtgataatatatatcgtgctgtacaggtgggacgaccatggtgagattggcttctcctccgagtgtgtagagattctattctatgctgtttacaacacgagcaagcagattgcggaaaaggccatgccgctgcagaaacgcaatgccgtggatcatatcgccgaatcggtaaacctatctcttctacgtgtgtgagtttccacttttaaggcttctaggttttagttttccacgatataatatataatctatttgcagtggtggttcacggtgaggggcatgttgaccgaggccgaatggaggatggacaagtatgtgccaacaacagtggaggagtacatgtcagctgccgtggactcctttgctgtaggccccatcatcacctcggcggcattgttcgtcggaccagagctctcggaagaggttttcaggagcgaggagtacatccacctaatgaaccttgcgaacactatcggtcgccttctcaatgacatgcagacatacgagaaggaaatcaaaatggggaaggtcaatagcgtcatgttgcatgctctttcccacagcggcggaggccgcggctcaccggaggcatcgatggaggaggccaagagagagatgagagggtcctccagggctgtaggtttgagctcctaaggctggtgactagggatgcgggtgttgttcctccgccgtgcaggaagctcttctggctcatgagcaaggtttta

SEQ ID NO: 89624 - DNA, 698 bp, Oryza sativa
taactcataaaaattggtcttgacatttttagttttaaatattaatgatgtgacggcatgaggtgtgcatttccttttgcacacagctttctaacaaaaaaaagggtaaaaaacaaagttgtattaaaccagtgatttgactttactaaaatattacttgttttccatcttagatctgagttctgaaagtaaattgccataatagagtgtaatcattcctaacactcactatggaggcttccagagaaactcatgatgagtttggtgttaaggcgtctaaaacttggctattgctcctttcatcattgttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttttggcttataggatgctaaagagggaacaacaactggggtatctgcaaaggatagggcaaagacagtatgactcttgcatcccctgactctaagcctgaagacttcaatcggcctggtcatattttccctctgaaatacagagagggtggtgttctgaaacgagctggacatactg

SEQ ID NO: 89625 - DNA, 703 bp, Oryza sativa
atccccaattccagataggtactatatctcacaaagggaaaaaaaaagagagactaggctaagcttccacgaacagcatcttgtgtgtctaccatttatggatatttcgcaccttaacacccttactcttcacgtcaaagagctccaagtatggagagcatctaccttagactttcccatcaaacactccctgaacactcggtcaccgtctccctctttaattcccaaaagttcatgcagccaccaacctcctcacctcctcatagcctatccaagaactccattaaatttagcagttggccaaggattcaggaatggtgtgtgtgtgctctggtttactgttttagcaacaagaagaatggttaattagttaagtgtcctggtgagtggcttatcgtcagagggatgacgcgaatggccaggcgcagctgaccgatcgctgtcttttggtgtgcagacccgctgtcgctggtgagggaccaccgggtgaaggcgctgctgacggccgagggcatcgccgtgcagtcgttcaacgccgacctgctgtacgagccatgggaggtggtcgacgacgacggctgcccgttcaccatgttcgcgccgttctgggacaggtgcctgtgcatgcccgacccggcggcgccgctgctgccgcccaagaggatcgcgcccggcgagctgccggcgaggaggtgcccctccg

SEQ ID NO: 89626 - DNA, 2313 bp, Oryza sativa
tcccctgttttagcaacaagaagaatggttaattagttaagtgtcctggtgagtggcttatcgtcagagggatgacgcgaatggccaggcgcagctgaccgatcgctgtcttttggtgtgcagacccgctgtcgctggtgagggaccaccgggtgaaggcgctgctgacggccgagggcatcgccgtgcagtcgttcaacgccgacctgctgtacgagccatgggaggtggtcgacgacgacggctgcccgttcaccatgttcgcgccgttctgggacaggtgcctgtgcatgcccgacccggcggcgccgctgctgccgcccaagaggatcgcgcccggcgagctgccggcgaggaggtgcccctccgacgagctggtgttcgaggacgagtccgagcgggggagcaacgcgctgctggcgagggcgtggtcgcccgggtggcagaacgccgacaaggcgctggccgcgttcctcaacgggccactcatggactactcggtgaaccggaagaaggccgacagcgccagcacgtcactgctgtcgccgtacctgcacttcggcgagctcagcgtacgcaaggtgttccaccaggtgaggatgaagcagctcatgtggagcaacgaggggaaccacgccggcgacgagagctgcgtcctcttcctccggtccatcggcctcagggagtactcgaggtacctcacgttcaaccacccgtgcagcctggagaagccactcctggcgcacctcaggttcttcccctgggtggtcgacgaggtgtacttcaaggtgtggaggcaggggaggacagggtaccctctcgtcgacgccgggatgcgcgagctctgggccaccggctggctgcacgaccggatacgcgtcgtcgtctccagcttcttcgtcaaggtgctccagcttccatggcgctgggggatgaagtacttctgggacaccctgctcgacgccgacctcgagagcgacgcgctcggctggcagtacatctccggctctctccccgatggccgtgagctcgaccgcatcgacaaccctcaggtacccaacttctgttctcctccatgagatgggaccatctttgttgccattaccatattgatctgatgcattggtgttgtgtttcgcagcttgaaggatacaagtttgatccgcacggggagtatgtccggcgatggctgccggagctggcaaggctgccgacggagtggatacaccacccatgggacgcaccggagtcggtgctccaggctgcagggattgagctaggctccaactatcctctccccatcgtggagctggacgcggcgaagaccaggctgcaggatgcactgtcagagatgtgggagctcgaggccgcgtcacgcgcagcgatggagaacggaatggaggagggcctcggcgactcctccgacgtgccgccgatcgccttcccaccggagctgcagatggaagttgaccgagcaccggcccagcctactgttcacggaccgacaacggctggccgcgacgagaggatcagatggttcccagcatgacctcctcgctggtcagagctgaaacagaactttcagcggattttgacaacagcatggacagtaggccggaggtgccgtcgcaggtgctcttccagcctcggatggaaagggaagaaacagtggacggcggcggtggcggcggaatggtcggcaggagcaacggcggcggccaccaaggccaacaccagcagcaacagcacaactttcagactacaattcaccgggcacggggcgttgcgccgtctacgtcagaggcatcaagcaactggactgggagagaaggcggcgtggtgcccgtctggtcgcctccggcagcgtcaggcccctcagatcactacgctgccgatgaagctgacattaccagtagaagttatttggacaggcatccacagtcgcatacgttgatgaactggagtcagctctcgcagtcattgtgagttcacacgcacggtaactcattgttcccagcaaactgcgtcagtattacattgaaaaatcacagcttacagagtaattgtctcagctggttattaaaagggttgaaatttaatttcaagtgcagtatctgaaatgaagcattctatacgcttactaatgctcccatttattttatgcatctgaatgtaggacaacaggctgggaagtggaaaattaatgctgattgtcagaattaatcattaggaaggtcgacattgagaagaattcatatgtaaattatcaccttttgtttgtctatagccttggtgtgcatgaatcaagtgatg

SEQ ID NO: 89627 - DNA, 2533 bp, Oryza sativa
aaaccaagtgagtggccccccttttcattttttttttacctccgcccttggttgtaggcctgtgggcctattttctaagtaagtaggtggaaagtccaataccgtatgcctagtccaattgctttcactggtctaatttcacaattttttcaacctccaaccattcatagatttttagcatacacctcctactctatcatccatggtgaaatatttaagggggtgcagggtgctctataggtctggagaaggtaggcacccacattgaatcggctcctacacctatctaaacctaaatatttcgtctaggaccaaagaactagtacttgataaacaccactgaatcaaaatctcctagtggaattgctcgctctttccttgtggtcgctgttatacctcacaatctggtccgactataaaatgtgtcaccctgcaatgatagtgccacgagaaagccaataggcacatacccaaaatcgtaagaaccatttaaaaagagtatggattgccgatgtaggcaatctcataatacgaaatcaagatgacaccccgtctactattcaatatggaaggcccctaatcagaaatgatgaagacgtcttcacggccacagagtgtcagcggtcagaccgctggggagaggacacatatgcttcgatgtcactgtcagaattaagccgattaacacagatatattggacacacatacggtccgagccaccttgtaagcttctggccctttagcgcagcttccgcgaaaaaagcacccgcgaatccaacgcaccaacagcccagttctatgattgcaagcgatccgccacaaaccggttcgtccaccgccgaccgcgctcctcgtccatcacatgcacgatgcacacccagccgctagtcacactagtcgtatcactagtcgtatttgcttgagccgatgtgtgcacacatcgatcactagttgtatttgcttgagccgatgtgcgcacacatcgatcgctttctcggcaggtttctaggcggtacgtggcgtggcgtgcgcacgtgccgcctccacctatatcgcacggcacgtcgatatgggcatgtcgagctccatcggtcgatcgatcgcctgtccacctacgatgtacggatacacgatactggtacggcgatacggatacgttgatacggcaatacgggattttttttaaaaacatcaatatgtcgatacggcgagtatatataaaaatatttttaaaaataaaatatagggaactacaaaagggtaaagcaataagattatcttaaaaaatattctatgtattgttgcctgttacagaaaatatagtaaatatagcattgtattacaaatagatcaagtatattaaagttataaatatatcataagtatagcattgggtctttaatgggctattgaacaaggaggttacactgctaggtattggagaagtatctgataagtatcgtgtgagtattagtatttattttttcttttttttcattgtttaatgactgatactcctccgataccgtatcgacagaggtaccggacgtatcgccgtatcgggtacgtatcggataccgatacggcaagaaagtgaagtataggtgcaacatagccgtccgccgtccgcccgcccgcgcgcggcgtccgcgctgaaactcatgacgctgtctctcgcgatcgacgactacggtgatgcgcgtgccccgccgtcgtcggccgcgagggcgaggctctacaggaaaaataatatgctcacgtcgtcgtggcagctagctagagctcggaggcttattaacgaggttgatcacgagcctgggaacaggcgccggataaacatccgcacacgacggccggtgtacgtaaacgtagacgtcgtcccagacacgcccagttttccctgcccaaaactcgccatggttttacctcgcttgatcggtttttgctgcaaatgaaagaccgaaacccgattagtacgtatgagtagtaagtagtacacgccagatcaatttggctgtctcacactctgattaagtatgcctctcgggtcacatggataataataagcccaccactaaaaactgtcagatatggacctgttggatgtatattagtacttgactacttgtgcaagttaattacatcgtgcttattactttctttaatcagtttgggtgtgtttattacgagtactttctttaatcagctttggtctatcatgtttgcggcttgcttggtacaggaatgatgcaaccatgaaaccggccatctcgttttaaaagtccaaatggctgacgtggatgcaactgcctcgcttcgtttcgcttttcgctgacgacttcggcgacctgttcattattcagagcccatgtttgcagttatctgagaaacaaccacgactcaaaagttattcagtgggcattagatcaagttccttaaacagttaatctgtactaaaatccaacaacaatccatccaagcaagcaaaatcgcaaggggaaaaaagaggcccaccggccatttctaaacgcg

SEQ ID NO: 89628 - DNA, 1578 bp, Oryza sativa
taacgagcgagctgttgagcgaactacataatacagttgaaatccggtcgtaagaacctttgaggaatgactgtaaaatatactagttttactcattcctttttaatgagaatatataggggtacttaaaataagagtttatatatattaattgctgaatctgattgattctactcacttctgtttgtgtaaatgcagggtgcagttcgtgaaaggcggtgcagtctccaaggaagcaaagggatcaatttccttctcacccgttgcgaattcaaataatgccaatgtgaaatttacgggcttgagggtagcagcatcattgaaaagggatggtgcttttccaggcgacggttactcagggaatgataacacggtgttaccaaagagcacttctgttcgtggccaggactatccaactgctgactctgtactcccaacggaatccatcatcgtgccagaaatcagtaatgctggtttgaaatgtgttgcggacatgttctcagatgaggacaaagacactgaacaagatttggatagcccaactgagggcttctcgtctatttccgaggccatcaaagatattcaacaaggaaaagtcagtatatgctaaccttttactcatttcatatcttgtccgtttctgctctatggaattctcctgacaccaggttgctcttgtagcttgtgattgttgttgacgatgaatcaagagaaaatgagggagatcttataatggctgcttctttggttaccccagaggccatggcgtttgttgtaagatatggcacaggaatagtgtgtgttagcatgaaagaagaggatcttgaaagattgaaccttcctttgatggttgcaacaaaggaaaatgaggagaagctctgtactgcattcactgttacagtggtatgctgccattcttattctctttcttttgccagcactagaatagtatgttatgaatttctatggatatcaaattttgcttaactgtcaaatgcatgcatacgtatgcttattcactttaccattggtttcctctgcaaaaggccaaaatgtaactcataaaaattgttcttcacatttttagttttaaatattaatgatgtgacggcatgaggtgtgcatttccttttgcacacagctttctaacaaaaaaaagggtaaaaaacaaagttgtattaaaccagtgatttgactttactaaaatattacttgttttccatcttagatctgagttctgaaagtaaattgccataatagagtgtaatcattcctaacactcactatggaggcttccagagaaactcatgatgagtttggtgttaaggcgtctaaaacttggctattgctcctttcatcattgttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttt

SEQ ID NO: 89629 - DNA, 1474 bp, Oryza sativa
ccaacacccgcgggttcttgcccccccaaaccctagcaaaggcggcgcggcgtcgtcatgggcgtcgccgccgccaacgtcgccgccttcgttttgctggccatcgcgcccgtggccgccgcgccgtcgtcgccgcctcgatctggcggcgactccctgagtttctccgacgtgatcagcatctccttcttcatggccgtcttcttccccgtgttcatcgtcctcctcgcgttcgcgtgcctccgcctgttccggccgctcgacgacgacgacggcgagcccgcgctggcggacacgtcgtcgtcggagtggtcccgccgggggggagggggcggcaacagggcggggctcgacgccgcggagatcgcggcgctgccgctggtgtcgtaccgcgacgccaggcggcaccggatcggggacgcgcggggcgacccgctggagtgcgcggtgtgcctcctcgagttcgaagacgacgacgccctccgcctcctcccggcgtgcccgcacgcgttccatcccgagtgcatcggcctctggctcgagaagcacgtcacctgcccgctctgccgcgccaacgtcctcgacgcgccgccgccgccgccccctcccccgccttcgctggagcaggacacggcgtcgccgccgccggctcacgagacggtggtggtgatcggcgacgccggcgccagcgaggaggcggaagcggaagagaggatcaggatccagtgcctcgcgggggtccgtcgcgcggcggggcggcaggctctcccgcggtcgaactcgacggggcacgagcgcggcggcggcgggatggagcggttcgcgctgcggctgccggagcacgtccgcctcgagatcctcatgtcgcacaggctgaggcacgtgacgagcgcggtggcgtccgtgcgcgtcagggaggggagcgcccacgacgccggcgccgtgcggaacgccgtggcgaggctcctgtcgctgttcgtgcccggagccgggtggaagggagacgacgagggcaagtccagcaaggcggcggaagggtcgtctcgccggcggcgcgacgagtcggcgaggggaggagtcggagaagagaagaggagcgagtaattaatggcgtattttgagtatgtaattcgatgatcggaaatgtaattttgcagagagttttttcttttccctttcccctcattctttttgtgagaacattattattgaataattcaacagccaacccgtaatcacagaacttcattgcaattttgagcttaatttcctccaaaaatggttttccacaaaagaaaaataaccaaaaaaaccattcaatgtattttgtaaatataatattccattcaatgtattttgtaattataatatttttattagcactcctcaatattaccgtagaataagttcacctgacgcccctataactttaggtcgagtttgtctaaggttcacaatccgtaatactagaaat

SEQ ID NO: 89630 - DNA, 1620 bp, Oryza sativa
ccgcagcgagggaggtgccacgtgtattgggtgtacgtcgatgctgggtgaaggaacaccgggatgcaaccgacgagaatgaggtcaaatgttgacttgcgggtgtaggagtcgccacgttgctggatacagaactctgcggactcgagcagctccatgaaccatgatccgccctggcaagttgtactgccatggcgagctaccgaagtgggtgcaggatggcgacacggtgaactactcaatgatccgggcgcgcacggtcttggtgctcctgagccgcggcgaaccggtgaatgcccaaagccagcggcggtcgcgtcgccgcatccggtcctgccaccggagcacatgggcgttggaggtcgggtgcaagtgggatgggaaaggcacgctgaagttgatgcccttccacgggttggcctcgacggcgagcaccgtcgtgttgcggatcgctgggtaggtgagcagtgcgttgccccacccgtcgtctccgcgcggggcagaagtccttgacggggcgggctgccaccatgaagtgcttcacccgccgccgctcgtcctctaccgccgccggcctccccgtctcgcttaagaagagaagagaagagaatagaggagtagaaagaaaacataagagaaaagagaagaagaaaagagagaaaaaaaaaagatgtggtcatgtggatcccacattttttccttcttacttacatgtgggcttcataatttttttaatttctttttgctgactaggatgtcacatcagcgtaaccaatgatccatactgttaggacttaaattgcatagttttatatagtttagtggtgaagatttctggtatttgggacgagggatgtcatacagactcaacttgaagctgaggcaggctagtgaacttattcttattactgtttcactaactagttttgggccttttttggacttcgagtcggctctacgggctgaattagggtccggctgacccaccattggtccagcatggctaggtcgagctaggatcaggctagcccatgaatttgtccaacaggatatatataaaagttcgttagtgaacaaaaagaaacagagtatataattgttcaaaaccgagaagaaagctaaacgggtaaaaacctctttctgttcactagatttcctttcctcgttaaaatggtacacttccattgccacgcacacgggggctcctagctagcgcgtacgcgctgctagcgagcacctcccctaaggtttaggaaaaagtacgaattacctcccgaactatcacggccgtccgaattaccccctaaaccacaaaaccggacattcttcacccccaactatgcaaaccggacgaattacccccctcaacccaatccgcggtggttttggtctacgtggcgtacacgtggcagtccagtcagcaatttatttattagaaaataggtgggccccacctgtcatacacttttcctttctcttctcttctctcactcttcctctctctcttctctcactctctcacgattcacagcggcaggcggggcgcggcgagcggcggcgggggatgaggcggcgagcggcagcggcgacaagggatgaggccgcggcgggggatgaggc

SEQ ID NO: 89631 - DNA, 877 bp, Oryza sativa
tcttcaattcggtcgctggcgcccgcggtctacgcagctgttcccgctcggttccggaacagacgaacggtagctgaggctttgcaagacaagaggtggattcgagacatctgttcggcattggggattcaggcaatcctggaatatctcaagctttgggacattctgcgattggtttagctaggtgaggaaccggacacgatctcttggcgttgggaaagctcggggtcttactccgctcgcttggcgtatcgtcttttcttcgcaggaagaaccagcctcgagcacaagccaatttggaagtctctagcgcccccgcgctgttggtactttttgtggctggtcgcactgaatcgttgttggacagcggatcgtcttcggagtcgagggccgtcacacccggcttgttgccctctttgtgatcaatgcgatgagatgattgatcacttattggttgcttgctcggagtctcatcagctatggtggattgctctttcagctattggtcattctgagtgtctgcctctcaatgagcactcttttcactcctggttgtgtgacagtcgcaaaagaatggccaaggaacatcgtcgagggttcgacaccattgcaactttggtggcgtggacggtttgaaaagaaagaaacaatcgggtcttcaaccaaaagagcaggacatgagcggaaattgctagggccatgacggacgaagcagacttttggcggttggctagagccgcgatcccggccatggcgacccctatgtcgggtggaaggttgccacatttggttagaaaataaggttttttttcttcttcctccttcttgtatctggtccccttcgtgttttttgattttttcggtccgctctgtaaat

SEQ ID NO: 89632 - DNA, 3023 bp, Oryza sativa
tttgggaatgaaattttgggagagtggcatttgggcactggcattttgagagagtggcaaatagtaaattctcccacaaatatgaacaagaaataatcaggattgacagaatacttgcaataattttttttaagggaagtttcgatttttcagcatctaaccccacaaccctaccattggaccagctagcagttttgaccacatgactacagtttgtgtcctagttacataaacaatatatatagttataatacaattataatgtattacactataattacactgtatatacatttgaactgtttttcattaaatatctgttggaagctgtataacttaccggtaaaacttttatatttatatgacgtgtgatttgaaagccaaggctagattattctatttttgctagaacaaaagaaatcctggaaagttcggttcccaaccatttgatttcttcctcttttgaaccaactattcttttttttagaacattgaaccaactattcggataattttattcaattacggtgggaactgtagtggtcctctttgggctctctttgcgcgcaaatataggccgtaacgtggttgatcgaatttgatggttcatagggtctctttaggtctcctgtaaattttttcaccatgtcacatagaatatatttgaacacatacataaagtaataaatataaataaaaaaagattgtgtataaatcacgagacgaatcttttaagcctgattgatccatgatttaacaatgtggtgctacagtaaacatttactaatgacagattaattaggcttaataaatttgtctcgcagtttactggcagaatctgtaatttgttttgttattagtctacatttaatactttaaatgtatatacatgtattcgaggtgacatgccaaacttttataaccaacgatctaaaacgcccccatactagtacatactcctagctgccggatacgagatcaactgggcgtccacatgtgaaggtgcagccgccgatgtccaccggccaatcggccatctcgagatcccaactggcgctgctgctgcgtgaacctctctcatgatgttgccgctatgggttatcacgatccactcattaggcggcccaactaatttcttccagcaagcgcgttcgtgacaatccccgttgtggcccatgtcactgtctcgcggactggagtactggacgtcacgtcacgtcccggcctaaattactggtttgggccgacacgtcttctgttcattcagggattcggcggtagccaacatagattaagttcgctcttgagatcccttaacttatcaactaatacgatattcatccttcaaccgatattcgtccttcaaccagaattccaaacaatgagacactgctagagattgggagggtggtggaggtagagggccaaatcctttcagcaagaagcccaattgggtcatcgtcgacttcgctcgcgactggctcccgcccatcgcaaatgagcaccaggttccatgcgccttcttctccgtcttctccacgaagatgctcgtgttcgtcggcccaaaggcagcacgcacggaaaggagaagggcggtgcctgtcggccagcgagaaaaagggcagggagcggcagccattggacggggaggtcggcaagcgtgcatggagagggaggaggcgaggaggtcgacgagcacgcgtggagagggagaaggcggggagaccggcgagcatgcacagagagggagggagcggggaggccctcagcccgttgatccccatgtcccattggcgtcgactccccgcgtcttcgttcgccacaccgtcagtagtccccatcccgacaacagcgacgtcgtcgacgtctgtcctgccggtcaacttcctgttgctgctcgaatcgattcttccgggtgcacctaccatggtgtggccgcaatgccgcgttacgtcgccgtggaaagcaccagagaaaaagtcatggatgcatctctggggaaggtaaggcttgtgcctcaaggaggcggccacgtcaaaattgacaaattccacgtcgcgtcgccgccgccaatgagtacgtctcactaaagagcagctcagtaacatcccccccccagcacgctcgcgttggtaaggtgggaacggaggtccctagacctccccagtggtcgagctcggtgacgtcgccgccgttgcctagctcccgccgaacaccggccgccacccagctgtagacctagacagagatggggaatagggggagagggtgagagaggaggaagatgacgttgtatcactgacatgtgggccccacatgggtcccacctttatttaattattttttgttttacctgacatgtgggcctcataatttttatttttttatcaaactgtcacgcaaacgccatgtcaccaccacgtaggacgaaaaccttgttaaatcagccatgtaggtgccacgtaaatcaaaatcacttagggacctcgtctgtattggttttgatagtttagtgatccgttgtatctggtaatggtattgcggtacaaggacgaaaatctaccacggtgtaaagttaaatgacctgaaatgaacttatgcgtagccaacatttatgcaatggaatcgtgttggtgattctctggagcccactgccgggcacggagcagtggcacgcggcgaccggatggatattttgccggttggtgcggccgcgaggacttcgctcattcgctggtggaggcgcgtggagttggccagcggggtgggtgcaaatcaccaaacaagtccgaacgcgcgagtttggagttgctgatcatgctgcgcgccatggccatgcaggagcacccggcggcggccgcatcggaatttttcacccactcgatccaccgccgcctgacgcttgtatgctcttccccgacaagaagaccagaattcgtttggatcaattcaaccaatccctcttatcaatttagtttcacctcatccggttgatctgatcgatcacgtcgtttaactcaaga

SEQ ID NO: 89633 - DNA, 796 bp, Oryza sativa
aggcttgctctcgctggttctgtgcgcgcagaaactagcgaggggaatgcagtagtgcaacgacaaaagtagagggtggagtattgtacaattgtgtctctttgatacattcaggagctaggcccttctttggttatatgtgtgcagaggtaaatgagaggatgatgaaaccgaaacacaattacttccgttgatgagcatcagttactggtaattagccaaattaacaccatcaatcaacagtaacagtcaagatttgtattgctctctaattgagtcatcaatcctctatgttaactaagttgataccccgcgcgttgatgtgggtataaaagagtaattcccagtgtgcaatattagcgtaaataatagagaatttatcttatagtaattatatatcatcacatgataggtggtggtataaaaacatattctgctactggccaaaaaaattcacaaatataaagataaagtctaaaaaaagttatgtttgcttatcaaaattctgaatgagagaaacaaaatcatataaaatactgctggaggtatagatggccataaggcccaaggcccgatggcctggcacaagcacatcacggcccgattggggtcgtgcctaggccggcctgacccgacagctgggtcgtgcctgggccgatgccttggcacggtgggccattccggcacggctcgatccaatgaggagggaagaaaaatagtttagggactaaaattagacttaatgcagccatacaattcatggcccaagagagaaggaaaccaaaaggaaaaagta

SEQ ID NO: 89634 - DNA, 3049 bp, Oryza sativa
atagttatatccgagctaggtgtgtccttatcatcctccccttcttgattagaaaccgtcctcagtttacctttgtcatggagagtattgcactaatctttggctatcacaatatcatgtgctgaacattttcttgatgtccatatgattggatcctaaaattctttgtagtcgaaaaactacaacactcccttttttgcaaaccaacctgtaactcatttaaataactagaggaactagatagttaattacttatatgcatgcggtcctctagacaagacatttcatcatgaaaaggaagtatagttaaattcgaacaaatatataattgatgcacattatattctcctttactatcataattgccaataatatgaaaaatcacatcagaagggcatggcaattcaaatctagcaaataatttcttctctaaatagttgagtggacaaaaatcatcaaattgaatagaaccccaagtatttaaagaatatagcaatttaagctattcattctcgctagcaatgtgaataacatgtttaaactcaacactgggtggctctactatagaactaacatgttcattcactagttgtgccatggatataagtgtagcatcacacaactcttctttatcacaagagacatcaagcaatttgttttgtgacaaaggtatttcaacaattgtttccactatgggttgctctaacttagcacaagtagtggacatagttggcacattataactatgcataccttgagcacttgtagcaccattatctttaccttttttctcatcttcagaaattgtaggcacttggtcaattaaacattcctcaagcatgcgtggagctatgtataggtttttttcctcttcgtctttcttctcttcctcattacctttgttgttctcagatgcctgcaaaatattagtatccaaagcaatatgcacaataatacgttcgttttgtaataactcagacttagttgaaggcatcacaatagtatctttcctggtatctctgaaagtctcattgattctattcttcaacctttcaagatcatctttgaaaatttcagaaaagcttattggttccaatttcatttttcgaccattatgtctaaatgtgtatgtattagcaacaaaattatgcaaaccattattatcatatacccatagtttaccaaacaacaaagaacatgcttgcatagggacaagatcaaaatttgcaatatcatggtaacttccaatcgaaaattttattctcacaattctatttaccttgaacttaccacaagagttgaaccatttgatgtaatatggatgaggatgcggttgtgtaagcaactcaagtttctcaaccaaatctgaactcacaaagttattgcaactctcactatcgattatagtacgacatgctcaatccttaaccgcaaactttatttcaaataattcgtggtactgccattgctccgctttctccatttgagaacatagcacttgttgcaccaaagtactgtcatcatgtgcaccttgttggtatcgctgattttgagcgccactcatacctgtcattgcaaacacaaaaacaacagcaaacaataaaggttatccctaataatctgctacgcggtgtagtggtgcccctcaacaacttagccaaatggagcaccttaccaagctcttacaagtatcttaccagcaatgctaaggacggtacaatcggtggttggttcgtgacaccatgaaggacatgatgtggcgattgcaaggatcaaagcggtgctgaccagaagtatatatgtgtagcttggaaggcacaatatatagtagcaaaggaacgcaaatgtgctaatcagaaaatgcaaagttgaataatagttcaaagtactagtcaatgtgttggcctagtctagactcaactcttgctcaagcaagcacccgacaacactaaggactagatatgaatcaatgcacaactctgcactctgaaaacatactcaaaggatgaatggttttttttctttcttggtgcggcttttctttaagcacgtttctgcaattttttttcttttctttttaggtgcggctttttttttctttctttttctttgcacctttctgccttttctttcttttttatttttttactttttttttcaacaagaactgaaccactaacctcgaacaaggactcaaatgtaaatatgaatattacagggactcaaatgcaaagaacaaaactaatattggatcacctcaaaaaaggattgctcatatcatgtaggttcagtttttataaaaacatctcaaatccgatacaacaaatatatgatatagggaaaacactcgatactcggtccggaggtggagagatcggtacggaggagggggaggtggagagatcggtacggtggagggtgggaacggcctcggtcaagtggaagagagaggtggactgtgtagtggctggtcaaggtggagatggactcttctatgggccttgatgtgaaacgtacggtggcccaagaaaaaaaacaaaccgttcttttcttatgcaaacatatatatatgcataaccggccgggataattcagaattaatagaatttcttttcaaaaagaaaaggatcaaacgggtttaatataaagacctggtaggagggtgggatggaatgatcggtgcttacctttgatggacggtggattagagcgggagtacaaacacctgggtgtacagattcattttcatatatatatatatatatatatatatatacatatatatacatatatatatatatatatatacatatatatacatatatatctatatatgcaaataggatatatactgaaattttcggaggaagctcgtcgcccccgcgcaggtgacacggggggcgaaacactagccgccaccgccgccttccttctccccctctacctcaccttgccgccggcaaaactggctgacgagctatgacggttgcggtgggaccttctcgcggtgacgcctctcctttgcgcgcgggcgggggggggggggggg

SEQ ID NO: 89635 - DNA, 932 bp, Oryza sativa
gtgttcgtcgggctcgggaagggcgactgccgcgcggaggacgtcgtggagaagcgcggcgatctgtgggggaggttcggcggccacctgtggaaggtctacgacggcggcgagcgggactggagggaggcggttggcgcgctgtcccgtgctgatccggccgtggaggtggacgccgcgagccagaggcaccgcctgatcgatctcctcgagatcgtcgggtcgaggcttgggcggcgcgcggtgacggacgccgtccggtcatggcgcgcggcggcggcggtgcacccggagcttcccttcgcccgcaacgagcgcttcgtcgggagggagagcgagctgctcgatctcgaggccgtcctgttcgggaagaggccgatgcatctggtcgaggtcgaggtgttctgcggcgagccggcgttcatggacggcgtcgtgtgcatctccggcgcgtcgggcgccgggaagacggagcttgtgctggagtacgcgcaccgccacgccatggagtacaagaaggtgctgtgggtgcgcggcgaggcgaggtacctacgcatgggctacctcaagctcgccgaccagctcggcctcgccgtcggcgacgacctgtccctcatcgccgccggagaccggcgtagcagcggcagcaagaaggccgagaaggagtggatctttcgtggcttggagagcgacgccattgccaagatccgaaaggagctcacgcgcgagatcccctacctcctcgtcatcgacaatctcgagagcgagacggactggtgggacagccgcgacgtgcaggacctcctgcccggcgccgtcgccggcgccggcgtgcgcagccatgtcatcatcacgacgacgcggctgcgccggctgcagagggtcaggacgttctcgctggcgccgagcatggagtcgccggaggccatgct

SEQ ID NO: 89636 - DNA, 1124 bp, Oryza sativa
catattttgacccccagcccgatgcagtagtcgtagaaatcggcgcagatgaactgggagccgttgtcggttatgatgcggtgcggtagtccgtatctgcaaaatatccctttgatgaatttgatggcgttgtcggccttgatttcccccgtgggtactgcttcgatccatttggtgaacttgtcaattgccacgaataggaacctgtagccgccctgtcctcgtgggaacagcccaagtatatctagcccccaacacgagaacggccaagtcagagggatagtctagagcgcttgcgcgggtagctttgtgtgtttactgtggaattgatagacttcacatcgctggaccatgtcgcatgcatctttaagggcggttggccagaaaaaaccttgtcgaaaaactttcccgaccaatgtccgaccggcggcgtgtgacccacatatgccttcatgtatatcgaggacgaggtgtctgccgtcgtgggacgagacgcatttgagaagtaccccgtttggcgctttcttgtatagatcgttgccgaccatacagtagatctttgctttacgggttattttctcggcttctgtatcgtcctcgggcaactcctcgctgttgatgaatttgattagtgggatgcgccagtcgtctgtggtctcgatatcggcaacggcgcgttctgccttggtgacctccgagctaatgtcgggggtgtccgggctaacttcgccgctgacctctttcactgatggcttcgtcaggatgtcgagaaaagtgccgggctcgagcggttctcgtctggacgcacgtcgtgctaggtcgtctggctcaatgctgtccttgcggtagacgtgtcggacctcgatcccatcaaaccttttctccagcttcctgacttctgcgagatacttggataactcggggttagagcatttataatctttgtgcacctggttcgcgactagctcggagtcccctttgacgattagtcgcttgaccccaaatgcagctgcagctcttatcccaacgagtagtccttcgtattctgctgtgttattggttgccctgaagttgaggtggattgcgtgcttgaattgatctccggagggagacgtcaagataaa

SEQ ID NO: 89637 - DNA, 921 bp, Oryza sativa
ggttgcatgatactcccccagcatgagaaaaagaagatgacgaagaaaagataagcatgagaaaaaaaaagataaagtaaaagagaaaaaagaggaagaactaaggtgtcgataaaaatgcaaccgcgtctgcgaggaagagaaaagatgaagcatgagaaaaagaagatgaagcaaaagagaagaaagcggaagaagcatcgtcattacgaatcagacgaaccggggacttgctcccaaagttctccaggaagcattgcctgcaggtcgactctgattcttccccatttggcgtttgcttccttgaaagacatttgcttgatcttgaggctgtctttacacatgacttctcttcgggacacccaagaagatcgaaaagaaggatgcgacagcacaaggtcgtggtcgtcgaggcggcgctgctaccgcatatccacggggaagtcgccattgctgtgcttggtccgcagcggcttcttgatcccctccttcccggagggctacttgatggcctcctcgtcatgggccttggtggaggttgacgcagaggcgccacctccccaccacgagctgagccgccgccgccgccggtgaagcagatcgcgtctgtgggtggcgtggggttccccatcaacggatcgaggtgcagacgcagctgctcatggcgaacggcgcggcggcgccgggttcgcggccgacgccttttcgtccggggacgagatcgacgaggatgccgtggtggagctcggcgaggcggatcccgtcagcaggaagcggcgcaaggagaaggagaagaagaagcggcgcaaggagaagaggaagcaacggaagtgggcgccgcccgacaaggacgaggtacgcgtgggcctttctacttatcactcgggctctacttatctctttatttagttcaccttccca

SEQ ID NO: 89638 - DNA, 1060 bp, Oryza sativa
gcaatataaacttgaatagaaatttttctttgtgcataatcttcaattggaaagtatatttctttttggaaaaagtacgaattaccccctgaactatcacggtcgtccaaattccccccctaaacccgaaaaccatacattattcaccctaaactttcaataccggacgaattacccccctcgactcaatccagagcagttttgtcctatgtggcgtatgcgtggcaacccagtcagcattttctttttttaaatatggtgggcccacctgtcattctctcccatctcctccttttcctcttcccctcttcctctctctctctctcgacgttaggcgcggtcggcacgcgagggccgcgatgggcggcagcggtttgtcaggcgtggccgcacgggcggtcggcacgcgagggcaacggtgggcggcagcgcgtcgtcaggcgtggccgtgcgggcgatcagcgcgcacggcggcacgcgagggcgggcggtgggccgagaagatcgatcccgatcccctccagcggccccatctttttcgttcttggtcatcaggagagatcgatctccttggttttgtcgctgtcaagcagcagcaacagcaccttgcttgctaggtcatcgtcgacggaatctgctccgccccctgtgcatcgcccatcttcgccgcgaccgcggtcgaccttggggcctccagccccgacctcctcttctcctgtcgtcgcgttctcctggaccacgccgtcaaccggctctccctcgctggcgttcgttggtccgccaccgccgtcgaccggcctgagccacagtgtcctttgcgatgagccggcaccggcgcctggctagggtgctcatcgctgccgtcaggacttggccgcttcctccatcggctctgcctcttggattttcaaccagagccgcccgccgcgctcgcgtcgtgtacctagtcgcgctcgctgtctggagcccattgccgcgcatgcctgttgattttgcaaattggccgggggagacaatgagattccgaatgtctcgccatctcgatcacgcccatgttaca

SEQ ID NO: 89639 - DNA, 6632 bp, Oryza sativa
tgttatagtgcacaacccggcacaccaaccgtgggccacacaggtcacattgggcctactccaccaccagcccaatcggagccataactttaggtcctgagcctatacaacccaaaagactagtctgatgggtgaggaccgcccccaccttttatgtcgtgttcccccatcatcgatcaattaccgatgtgggactaaacccaacaattaccctatcacacatcgggcccaacaatctcccccatcatatcaactcatattaccccgaagacgtgttacctgggcctcaggcctaacaatctctcccatcacatcaacccatctgaccccgaatgtcacatcaacccatattaccccgaagacttgttacctgggcctttggcctaacaatctcccccgtcacatcaacccatgtgaccccgaagtcttgttacctgacctccccaccacgtgacccacattgaaattccatcacatcaacccatgtgaccccgaaagtcacatcaacccatattaccccgaagacttgttacctgggccttgggcctaacaatctcccccgtcacatcaacccatgtgaccccgaagtcttgttacctgacatccccaccacgtgacccatggaaattgttctaggttccaaaccttgggctctgataccacttgttaaagtgcgcagcccggtccaccaaccgtgggccacccaggtcacattgggcctgctccacactagcccaaccggagccacaactttaggtccagcgcctacacaacccaaaagactagtctgataggggtgaggaccgccgccatcttttaagtcgtgctccccatcatcaattaccgatgtgggactaaacccaacaatgggcgcgagggcagtggcggcctcccctccgccggaaccgggaggggaggcagccgggcggcggctcgatccggagcgagccggccgggctgcagccggcgacgactctaggttgattcggctgtggagttgatttgtatattttttttctgtgaattgatttgtaatgaatgatttgtcaatttttttttgtcgatttgaagatgattttgtgattgatttgtggattttcgatgggcatgtattgtggatgattgtgtatgtagatgatgtttgtatatgatttgtgtatgtggatgattttgtatgatttgtggggatatttgtgtgtgactgagattgtggttgagtgcaaacagaataaaaacaatggaaataaaaagaaaaaaaatgttctttagtcccggttggggtaaagatcttcagtcccggattgataatcccggtttgttatccgggataaaagggggttacaaatagggactaaaacccctttctagcagtgggtcaaacgttcgatgtgacacccaaaaagttctttttacgaactaaacagggcctaactattctgttcgatcttggagttcatatctaccacctctctgccaatgcagtcgtagtgattgttagtaaggggagcaaatgcgtatactgattgatatcggtttatgtaaaatgtctaagactttatttattgaaagtgtctttcgattctgtagacttcaagtgaaaataatgttttatgttgcttcctcttagaaagtatacgcgtattgaatgagtatttgtgaatgtattaatggtatggaaaccttgcatatagagaactgattgtatgtttgtgagtgagcaatgtattggatgtttctttgttgggaatgaattactaacgttaatatgtttcagagttactaatgtgcggatttgttatttccgtctcaagttgctaggacccaggaggcgcaaactggcacagcagaatcagtgctcactgaagatgggcctgatgtccctttatctgacagtattgttttacggaagcttcttttaagtactaagtgaatttccttgtatatgcacatgtggcacaagacaatactccctctatcccaaaacagaagacataaccactcataatacaaagaccaagaaaacatttattcactttcttgattggatcaccttaatgcatgcaagcaatgtgattgggaggtttgatgatagaagatttaaaacaaatcaatcttataggaccaagaaatgctaattaatgtatctattcatgcataccttatattatgatatatgagaaaaaagctgttgagtcttatattttgggatggagggagtaaacttatgttgcttttcctcatgatctagcgcataccaagatactttgatcctggtgaaactttattggaaacatgctttaattgtggtgaggagggtcatgtagctgtgaactgtccaatggaaaagcggaagaggccttgttttgtttgtgggttgtttggacacaattcaaagcggaagaggccttgttttgtttgtgggtagctccaaggcattattgcttggtgacttgggtatgcatgctcatgcccttgacaagatcatcttatttagttctccattaattacatgatgttgctgcatttgttatttcaactcataagttaacatgcttgccttgtttagataggttctagaattccagttcattaatcacacatatttacttcacaaattttgacaatttgaccctttgcaaaaaactattttttacaaatgaaccgccgccaaaacttatttcaaaactgacccttttgcttaacaccaaatcgtgtggcgctgaacatagacatctcactgccaaatagcatagcactgaatgtacgttggcatgctgacttagcctcccatccgccgtggcacgacattcagcgccagctgaagtggagctgaggtgtttaaattcagcgccacatgatttggcgttgaaaaaaaaggttatttttgaaataagttttgggggcggttcatttgtaaaattagtttttttcaaagggtcaaattgtcaaaatttgtgtatttacttgcccctgccaatttcaggaatcaaacatttgttaatcatttttgtagggtcaagactgtttcatctgcaaaaaaggaggtcatattgcgaaagactgccctgaaaagcacaataggaatgctatcaacagtctacattttatgtacgatgtggagaatcagggtcctgatatgtttggatatgccaatgattatccacgcgatgatgttaaggtcagtattgttttctcatggagggatacttgcctaaggaaaaaaaaatctaactcaacatatctttaaaaccatctctcacttttaatatgcagtggttacaatctaaatcctactgctaatgcaaactgtgctgcttcagaatatacctatgaatgaattgtggttttgtcattttcgttgatccagctttatgttctattcacaagcttggttagattttgtgagctaaggttaattttacattaagcccttccttatacttctgtgttagtcgaatccctgaatccacatgttttgtccacttaattaacatgcaatataacgcaaatcattctcttatgtaacacaaaagtcctgtagcagcgagattgcattaattgaagtcatagtattatccaaacttattttccccctcaacatctactttgttggtctgtgcaggaagaaaattgctatgcgtccgactgatatgtacaacttacatccgacaagggcggagctagagtatttgggggagggggggaggacggctaggaacccgttcaagaaaaaattgtacctatacctgaatataaatttaggcactggtattagcttaaacttgatataaagcagagtaaattaaataagtggcacccccctccatctcgctctagcttcgccccattcccactagtgtatatataggcatagatgctgcttgtttgggtccacatgataagaaacaagctcagtgattagtagatatgacatagtcagacacgagtcggatggctcggtcatacgtatagcaggtttcgtgcaggaaataaaatgctatgtgtgtacgtaatcagaaaggtcatctttgttgcgccgacttctctgatatctgtccaaaagaagttgttataattctgcccaacctggccatactggtttggtaagtttagtggttattaacttattatggcttccttgtttctatatgttacttctcacagcagctgatcaatgtcttctgatacagggatgtgccaagcaacgtacgtagggaagctagtaccgcggcaactccaactttgtgttacaaatgtggcgaggaaggctacttcgcacgtggatgcacaaagaacaccaaggttgttagaagcatcttattaatatattgtctactgatagtgataagagctgcttgggttatttatcctgtgcacatcctggttcctttttaatttgcagtctgatcgtatgaacggtgaatcatccgcacataggcagtgtttagttccaaagtttttttccaaacttccaactttctatcacatcaaatctttcatacacacacaacttttcagtcacatcgtctccaatttcaactaaatttcaaactttaggccaatctaaacacagccatagtcggaaaaaaggcaaaggcaagaaagattttggcactagggctgtgtttagctcatgtcaaaattggaagtttggttgaaattgaaacgatgtgatggaaaagttagaagtttgaagaaaaactttggatctaaacagtcagctccttatgatgctcacaagacaagtaaaaggaaaatccccttatttgaggaaagaaggaactcatctcattttaaatccaaagctaggggtggttggattgcagacgatgcagatgaccaaccataaagaagtacaaacccaatgtgtgggcttctccatctacccctaaaaagcaatacagtaaccatcagttttcctatggcggtgactactctactcctcagtcatcaagtaagcggaaacgtcgagcgcaacttaagatgaagataaagatcaagtgtttcacgcaaaacgaggtgacatatgattaattatgttttaattattataaatttaaaaaatcgattaatctgatattttagagcaactttcatatagaaagttttcgcacgaaacgtaccgtttagcaatttgaaaaacgtgtcatgagtatccaaaatttcattttttgttggagaaacgaacgcagccactcaccaaacgcaaggaagcatagcttttcgtcgtcgagatttgccagcaacactcgtgtccggtttggaagaagctagctggatgctagtttttgatttttttttttgttgccgttctgtttacaaacacaattgatcatctcttgtgcctgcaagggctgtttctgtatcttagattacacatgttgtgttactcctgctcagttccaacttcctttacttccccctttccagctccgagcacgctttcccggtgaaatctcgtggctgtggcgagcagatttatgaacctgtctatttgttataattgtgcagccactgtactgcacatttttagtcccaccttgcttaccgatgacgatgaggcccgtggggcgcagccttcaaattcgtcctgccgctaccacgatgccaccgacggcagaaccgttgcattttgaaatcgttgtttgaattttctaatcgcttcaacgatttgccccatcgttctttctcccgaaaagctactgcgcgcgtgcgcgctggcaactcgcctttcaggagcagttaaatctaaccgactaaattagttttagataatggcgctaactaagataagatttttcctttttttagatttcttttaatagactgaaaactttcaagttaggtttaaaaaacttaagatttaaactttgaagtcaaatagtgaaatctttctactcaaactttgaaaattttcaactcgaaatttaaatttgcaagagaaattttgaaaactttcaactcagatttgaaaaatttttaactcagatttgaaaactgttaacttgagatttgaaaactttcaactcagatttaaaaatattcaactcgagatttaaaaactttctactcatatttgaaaactttcaagtctagatttaaaaaaattttaagttaagattttaaaatttaagatttaaaaactttcaatacaaaacatttaaaaacacgtgtgctacatattaaaaaaaataaaaaatagaaaagaaaaaagaaataaaaaaattgtgaaaaaaacgaaaattaaaatcgcctcgtggggggaggggttgccagctggcacgtgccagcaacgttgctactgcgcgcgcgcaaattaaccgcccccttctttctctgtcgatcaaaacccttctcttgtttcttcctcagcgagtgggaaccagttcatcgaggctgcatacggtgatggggtgggcgtgcggtttgggtgcggggtagaggtttgtggtggggagattcctgatagtgaagtcgtggcgataggagttcacggtcggcggccagataaggtgtgcagtttaagcgcgaggacacatgcattgtgtgaagtggcgtacgccgtcgtagggagttgccctgcggtgaactagatcgccagctccatcctttgttatattgaaggaaaaaag

SEQ ID NO: 89640 - DNA, 2706 bp, Oryza sativa
ccactgttttgccggtgaggacgcgtctccagtggtttccccgcgaaacgaagggctgactgggggagaggaggcggctgcgacgtcgacggaggagatggcgacgtcggtcggcgtaccggcgatgaacagcagccggccgaagacggaacagtggcggcaacgccactgttgccggcggggatgcacttccggaggcctccgcgggcaacagagggcaggccggcgcagaggaggcggctgcgacgctggaggaggcgccggcacggccgaccggcgctcgggcaaggcggtaggggcggctggagggtggccggcaccgaggaaagagaaggaggaggcggggagaggtggtgcagccacggggagggcgcgggagggggctaaaacgagagaacggagcgagggggttccgttttatagcggagggaagcgagccgagcacgggaggagcggggaacgacggcggaaaaggcgcccggcggccatggaagacggccatgaatggcgcagccgttccggtcaaaatagtgcacgattaaaggggagattatggggaaaagggagaggaaggaaaggggattaattctccccaattaattttggaatccaacgcttaaatcgcgcggattcgagggaggaacgaactagggttttcacgggagagagaggaggccgtgcgggaggaggaagacgaccggcgcgtgggccccacgcggtcagcgcgcgcagtcagcgcacgcgcggcgcgcgtgcacgcggctggctcggctcgacctggcttgggccgggctgctgggccgaggcaggccgggaggaaggaggaggagggagtgggctgccgggaggaaagagagaaaaccaaagggaggggagagggacttggactgcgggccgagggggagagagggagactttgggccagacttggcccaaagggaggagggggattatttttagctttttctttttaataaactttgttaattgttgttgttgtttaataaatattttcggtgctctgaaaattcaagtaaaatttgagggctccttttagaccaaggagaatttaacaaaaattctccggaccacattcgaatctttctggcacgtattttagtgtttgtcaatttctttttgaattttaactaattctattattccttttaggggatgatttttatttcgggatgaatttatcaggacgtgacagcccaccagccattgggctggacgcccccgattagggcgcggtcaaggtccgttgtgccgttgggccgtacgggtgggagatctatctaacagaaacctctacttgatttttctgtggtgcatggtcaataagtctgaagatatgaggttataaatgctttgcctgcattatgcttctgaaatttcactgttagaaggccatatttcgttgattcaaaactcctttttatgtgcaggcctgcatctatttttcgaagcacagatttcattgttagaaggccatattccgttgattcaaaactttttttatgtgcaggcctgcatttatttttggaagcataaacgaaaggatcacatatgtaagtctgtttgctaattaataccttttcctgcaaatacacatacaccacttggatgtagatacccattctgctttgctttacatgttaattaacttgattgggtaaatgtttactgcattgatcggccggtatctcaaagtacaatcagtaagtgactgaaggtaattcattagtcttttatgtctaatatgatcataaaaatgtcagtagggtgcatcagacaagcaaaaaagtatatagcaagtgatggcacatttcttagggaagggatttatgagttcaatgtcaaaatcctctctatcagtcgcctcgcatttttaacttacctaggttgctttcctatttttagctacataagaactatatgtatgtcaccacatcagagttatttatattcccttgaagtattctaaatccatatattgttaagatgtgttctttaattgatctcttcatctctatgcaaagtatcctatcataacgttaacaatgttagatcatacttttagtgggtgttgcatgcagttattattatcaaagctatcgaaggtattttacattgttacatctccttcaccctttataggtttctatattacagatgctcctgttattgttttaattctttttcgaccagtacaacctgattagctattcttactaattctttttatacaaaaaattatttagacatggatatttacaccatcaagtgtaaaatgttacttacactgcttgcatatgtaagggaaaaatattgccagctccgttcaagttccccagagccatatagactatattgctattttgcttgatctttaatcttatgataatgattctatgattaaggttaattatgtatatcgtcgtcatgcatcttgcatttcatctgctgaataatacacaaattgttgtataacaacataactacataattgagcttaatttttgtaaagaccatccagtacaacttctgagttacattggtaacataacaaccggcgttattatactgctctcatatgctctgatgaaatttcttccatatatacattgtactttgatagccttcgtgtctctactatttgatctcaccaattcgtttttaaagcttgagtattctatagtgtca

SEQ ID NO: 89641 - DNA, 537 bp, Oryza sativa
tctgcacgttcatggctgatgcatcttcctccatactcaatctcttcgtgggcagacctgtggcaacagttcgtcgccaatttccaagaaacatacaagcaccacgcgatcgaagacgacctacatgcgttgacacagaactctggtgaatcattgagggaatatgttcggcgcttcaacgagtgcagaaatacaatccccgaaatcatcgacgcttctgtaattcgcgccttcaaatccggtgtcagagatcgctacactacctaggagttggcgacaagacgcatcacaaccactcggagattgttcgagattgttgagcgatgcgcccacgcagatgatgcgctaagacgcaagaacgataagccgaagaccgggggagagaagaaaccagccacggacgcatctgagtcaagcaagaagaaaaatcgcaaaaatgggaaaaggaaagctcaagcagaagtcctcgcagcagaatacgcgaaccctcccaagcgcccatacccacaaagtagcgacacaaagaaagtatggtgc

SEQ ID NO: 89642 - DNA, 1745 bp, Oryza sativa
cagatgaaaaagtacggccaaaagatttttctatgtaatgttaataataaataaagaagtatttattggtaaaacttgttaatattgttataaaaatgtattgaagttggttgttgcgcaatttcatatgttaagtgagataatattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaaacatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcatcccatgaagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcaagaacgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttagcatcgatcaccgcataggcagagaggacgctggcaccaaggtggtagtaggtatacacaagaatcgctacgccagtttggatcctcaacaccccggcgtctagccattgacgaaagctggtcggatttgtaatgaagcaagtggggaagagagtactgaatgtgactgagttctgaaagattgtgaggcctcactcgttaaggcgacttatatagacgcaaaaaatcgagtgatacccttgacatgtgaacgtggtggggtatggtgggtacgcctgattggcgccgaaagatacatgcatgatcggcgccgaaagttacattggtcgtatgtgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaaaagaagactgctctactggccctgccccgcgccgcgaccacgcttggtcctccgggcctgtgctcgcacgtggtcctgggagtaggtga

SEQ ID NO: 89643 - DNA, 710 bp, Oryza sativa
  unsure (1)..(710): unsure at all n locations
catgggnnggtgatgtgctnctactgcaagtcgttcatcacaactggttttcaacgaggtggttagtatagggatggcacataggatgttagggtggattgcttagacgatgtcggtgttaagcgcatcgactaaccgcgccgttaagttaggctggcgggcgcgacagtgtggaatgcagatggagaattctgtgcaaattaaaaccttgataactttgccttctggtcatggaatcgagctaggttttttttgacggcttcagaaccacgggcctgacagaagagagactggatttggagagttggacccccagagatttttctagaaattacttaccataggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcaactaaccgcgccgttaagttaagctggcgggcgcgacactgtggaatgtagaactcatcaaggattatgatgtgggaattcactatcatccttgtaaggccaacgtggtcgccgacgctctaagtcgaaagagccattgcaacactcttaacgtncgtggctttcacccgaactaaccaacagatggaagccctgaatctaagcatagtgggtcgtggattcttgg

SEQ ID NO: 89644 - DNA, 744 bp, Oryza sativa
atgtagtaccgctctactgcaagtagttcatcagataaatattatgaaaattgtttaaaaaatatgatataacatttgtagcccccgactcactagtcaacagcgaaccagttgatatagtgaggcaaaggaaaaggtaaaatatcatataaagaataaaacaaatgatgacttagctttgtcgtattccctcggtgacagcagaagtagccgatgtgggaatgaagcagtctatcagtggtgacaaaaacaccagtcggtgccagtggaaccaagccagtggtgtagataatgaagcccattaacggcggcgaagtccgccaaccgtataggcgaaaacaccagtcagtggcggcagaggcaggccggcggtgaagtcgtagacgcccaacagcggcggcataatagaccagccgtgcaggcggaaacaccagtcggcggcggtgaaggccagccggtcggtgaagacgtagacgcccatgtatggtggtgtgaccaaccaaccgtataggcgaggacaccagtcgacggacgcccaacaacggtagcatataataggccagccgtgcagacggaaacaccagtcggcagcggacgaggcagccggtcggtgaaaacatggacgcccatgaatggtggtctatgtgccatccctatactaaccacctcgttaaaaaaccaggtgtggaccctcagatattcgacgtttcgccgaaacaaccggtgcatggtgcctatggtaag

SEQ ID NO: 89645 - DNA, 8118 bp, Oryza sativa
tcaagttgtttgggaatattggacccaggcatattaatgccatgaaagaaaaaaaaaacccgaacatgcattttcgtgttgaggctcaccatgagaagtcaagaattggggaaggagtgcatagttgtgtatttgcccgtgcgtcatgatattcgggcagttagtggaggcattcaagcacttgaggtcggtgttagcaattgatgggaccttcttgaccggtaaatttaggggtgtattgctcacaaaaatagggacattgtctgatcagccataatagagaagtgtgtataatatctgataagcacccaggcatattgaactccatcaacaacgagatactagggcatcaacccattcaccatagatggtgcacgaggcacctatgcactaacttctatatcactagagctacccaggatcagatgaatgacctcgagcgcatatgtcaaataaacaagaaagttgtgttcctatgtgcggtgaagtgccccatgggtttggttggaaagtgatcaaagaagtggctagaggacaatatgccacttaaggttaaatgggccagatcatttgataccgatggacgtctatacaacttcatggctagcaatatggtcgagagtttctacaatgtcttgagaggcattcaaaaattctttttatgtcaaaaggagaatgtgtaataacttttttataccaagagcacgatatgagaggagagatgagttgcacaagaaacgggggcgggtggggtaggaaagaaaattcttgacattgaaaatagaggaggagcgagggaggggggaatgagtgaagagtctagtggagacaacaaatgttgataaatgtgggtgtaattctttttacatcaagatgaggggctgtgaggcgcactattaagtagcgcactgtttagcgcatattagtttgttttttttactttacgcatgcatgacctatttagttttatatttacatcagattttctttcatatgaccgatgaaaggtctgagagttttataaaaaattaacagcaccatacatttaaaagcaagaagtaattttttttattagataaggatattttttacctggcctatacatccaaccgtgtgtatatatatatatatatatgtgtatatacatatgtatatgtatatatatatatatgtatatgtatatacatatatatgtatatgtatatatatgcagctatttaaattgggaacttagccatacgaacaaccaaatctaaaattcactcctatggagatatatttgaaggatcttatggtgctaggaataattaaatgtgcaaccactatatcttccattcactcaagtacattcttgtcacatcacatcttattctcacgttaagctcgcgctcttagtatgatttcacgtgtttctcgcaggcgtggttatttgtcacatcaagttccagatctcattcaaatgcatttcgctactaggtaattaagttaataattacatttgttagaagtgtatatcacaataataaaatgcaaacgcatttccaatattgctgattaaataacacttattctaaaagaaagtaatataagaaagaacatctccaaacgattctaatgaggattgagctggatagcggggataacaggtactccctccgtcctataatataagggattttgagtttttgtttataacgtttgaccacttgtcttattcaaaatttttttaaaattattatttattttatttgtgacttactttattatctaccgtactttaagcataacttttcgttttttatatttgcaaaaaataataaataaaacgagtggtcaaacgttgcaatcaaaaactcaaaatcccttatattgtgggacagagggagtaaaaatgaagggagctaggagagcgatggatatatgccttcctagctagttcccacacccctcttagctacggaactaaaaataacaacaacaacataataacagaacacataaaaaaatggattagtatgattttttaaagtaattttcctatagacttttttagaaaaaaaatattgtttaatagtttgtgaagcgtgtgcgtgaaaaacaagttagaaaaggttgggacattcacataaaaactcagcctaattaagctggtgtttatgtcacttttaggtccgtatgttttgatacaccatgaacagtagtgctccccctctcacatcgtaaaaagcagtgctccctcgtaataattcagtgaaatgcaaatcagtactatgttgtgttcttaaataatgtagaataaaaataaaaatatactaccgttgttccaaaatataccattataagatggatacatgtattaagaaaatgaaagtgattaaaaacatgttgtgattgattgagaagaaaaaaagaaaaaattaaagggaacatagttgtaatttgttgaaaaaatatattaaaaaattagctttattttggtacaagttaagtacatatctgggttagaagcagtgagaaagaagtgagaggattcattcgatcattcgtcgccagctacgaaaaatctacaaggacaggaacaaacagatggatgtttcgtcgccatcgcatgcggagcgcgcggtgagccctgcctgccgaatccacgagatatcatatcaaccctgcagcactagctgccactccgtttggtgcagcgtccataaccaaatctagaaataattgccatttccaattaaataattgcacgtgcactgcatgtctggttaataattaaataatcttcgaaagttttgacaaacttgacccggtccattgtcgagataagctctttaaattaagggtcaatttttcaaattttcgcggaagtaatccctagctaactagctagctgaccaattaccattgtttctttaatatatgacttatttggtttttcaaatttatttgactattcgctgaaatattcatgcaaagaaatcacaaacacggtagacatgcttaaagtacttttgattattagtattttttaaatttacttaacaaagtaactaataaataggaaaaaattctatatgtcccaaaaacattggatagaagttcattgaacaccctaaactttaaaattaaacatccaaccaccgaacattgtcataccattcatatattacagacattggttttttatattttaaagtttaaacgaggggttttgacaaaaataatataacatatgcttacataaaatccatcatccgttattagtttgtacagtaatgttatattaagttcgcactcatcccttctttctataaagctaatgcccactaaacacctagagctcaacatgtaagtgttgtatttattagtactcctaaaacctagatgcaagcatgccacatcaacccattaagcacacaaatctcaatatgcaagcatatagtaattatatctacaatttatttcattctaaaactaaacatacacatgctaaaccatcattctcaaattattttcatattatttcaatccaaattatttcattaattctccaatatctaatatatatcccgtggcaaagcgtgggatatcttttagtttatataggagtacaagtgaaagaaataagggggtaaagaagagaatcaagtgaagatttaacatatacatccaagacatatgtcacatattcaaactcatccattgtatatacaaattatatagtaatcatttttttaaaccatcatatgggctgcatagatggtattataaactacataggattaaacgtctggttttaaagtttagggtgttagatggactatcatctaaagtttacggggtatatggaatttcttccccaataaatattattcaaagtttaaggaaaaaaatctacatcatatattagaaatggagaggtatatacgtgggtttagactgatggtgtgatattatctttcacgttatattttaataaacacggatgacctataacatgtttattttttttcctccgaggaatggccctcgtaaccatgttgtctattcagatctgcacaatatttttataattaatgatttctaatatagtatacatgacaggctatcatcttactataatagagcgtatggccccatcatttggcttattacggaataagccaaacgacatatttgcaaatgaaaaataatttgtaaataaaacttttttatatgtgtttttagtgatctaaaagcaaaggctaaaaagaaaacttcggtgaaaatccctaaaatcatgataagtataagcataagcgaaaaatgaggcttgtttctcccttgttttctcatgatttcacatcatcatagcatactccctcatactataaaattgttcatgcgcaagctactccctcacctagtcgattaattatattggccgcgtggtcactagcatgcatcatttcgttaattaattaattgctcttacgtacccttccattttcggtgtataaataggcaacctccagtggacatggcctcttcagagatacatataccatcaactcacgtaatggatgtcctcgtactactcatctcactgatcctcctggtgagtgtgaatttgctgttaatttagtttagaaattaacctctgaagatacattctgcgtgacagttaattgattatatatatgtttatatgcggcaatcaatcgtatctctcctgtcagtaatttttaccaacgtaacttaatttatcaaggtatatataccttacaaagtgtaaaccctgcttactactcttacttattagtatctctgctatcacttaatttttttttcatttactcggaattgattgctttacattgtttgtcaattatgttaggctttgttcggcaacaatatacagtgttttcttttaaaaaatattttgtgtttctaaatgaagagttagctagctagttttggaatatgtaataacatgggaagaataactgtaaactagcatgcactacccagtacctacatagagtgcttatattatggtatatatacacattatttagttttcatttgatttattgtctagattagttttttctgtacttcatatgttggtgagtatacatgtcagttgtaacttaggtgatgtcacaaattatattataagttgcaacaattttggaatgcacgataatcataaatataaggcaaaatttgctacacgacacgtaaaaattgtgtaattagctgagggacaccgcaaaaacgtgacactgccccaacacactacaaaaactgtgaaatttgctgtaggacaccgtgcacattattttatcattttctagctgaaagtggtgagaatatttttgaaatgcccagattgcccccgcacgtcaccacacacagacaaaaaaaacaattctccattaggatggccgaaggggcgcagctagctgcggccggaggggcggcgcgagcggcggggcacggcctggtggcggcagcgccggtgcgacgggggcgcagccgagcggaggaagagttcgaccctggcgttggcactgggcacggcagaccgaggatggcacgacgatgccagcggctgggcggaggtagcgcggcgttcacggcgtggacccgaaggcgacgacatcgacattgagggcatggtgctgctacagcctgcttctggggcgcgcggtggctgccgtcggaggaggaggaggaggccagctggcgcgacgagccgctgatggtcgcgccggacaggctggacgcgctcgggccgtacatgacgggcggcaccgctggcaacgacgccccgcggatcgaccctcccgccaaggacgtgtcgttgcttccacgctgcagtgcgctggttgccgtcgccgagaaggaagtactgagtgaacgcggccgctagtactgagtgaacgcggcgcccttggttgaacaaaaagcaacgagaaagagagagaatgggagagagagaaaagataaggaagaataaagaaaaaagaaaaaaaatgaaggatagaatcgtacttacacaggtgtttctctctccaattcctccggatataataaaattatccgacgggtgtccaacagcaaattaccggttttttgtggtgttctttagcaaatttacgttcttgcgatgtccacaggctaattatacatttttttggatgtcctgtagtaaattttgcctaaatataatgcagatcggaggaagcagcggtgcaaacatggcggttgctgtgaccaaaccgtccccaacagcgatggagtattggcagaaaaaattccctgagacacccatgcccccagccatactagacctgctgacaccactgcctacaggtctctatctttctgctgatagttattaaaccaagaaatatttaaatttatatggttaaaatttaagtacttgttgagacaaatatattgctagatataatttactgtacattaaatacaaacatttaagaagatattaatacacagttttgaaagtgtaatataacaccactttttcaaaaagactagcctttttttcccaagcctcctattacactgctagtaaaaatcgattttcgcaggtgatctaaataaagaggggacgagtgtgttgtcaaaaatggtttttttaactactatgagatcatatagttctttttcctgataacatggaaaaaagacggacacacaaacactatcatgcacatacaatatatatatgagtgtgccctcctaaaacatttaggaagtgaggaagattgggaatcagatcgatatacatatatataatgatgtttacactttattctgttagcagttaacatgccaatcaatttcctatatcaagcagaatacaagaacaataatgctattgagttatattacattgattttatcgtctgcccattagcagtttggaacattgtttgcaaggaacgaatggtactgaagttggatcctatatattattgattcatctaagaaaactaaatatttacctttcatatcggctacacgggctacaaagaaactaaaggaaagatgtatgttgtaatacgctggatatcttatatatatatcaactgaaaacaaaaagaattgggccacattagctgcagaaggactcaaggaagtttctgtgtcatatggaagtgaaggtaaagaggagcctaagaaagcattccccatgggacgatatatgttagacaaggaacgagaaatgacttcatgtatagataaaggttagaacgtttgaatttggtatattgtatttttgtatatgtcattgaaatatataaagaactaaataaattgtttctatatgggccttgaactagagacaaactcaaagaagtccaggtattagagaacattagcgtattgtatatttgtaaaagttgttaacataaaaagaaaaaatataaaaatattttctgtattgcctatgaattgtagaggacctcagagaagtctcagtgtcatatgactcaaacgtgaaactaagcaatttgttcccaacaggtatgcacatcagaaatatatactaacaagcggaggttacattagaacttgtggatgttcatgttacatgtagtgtatatatgttgcatacatgtatatttggaattataaaatgggggcatatgagttgcagcgggactaaaggaagtctccatgacatatggaagtgatggtgaagaggagccaaggaaaacattctctcaagtagggtatatgttagataaggaacgcaagaagtcttcagatgtagatgaaggtacaatatttgagagtgcattatgtgttctgtgttttctctatgttgttgacatatttggaaaaactacataaattatttctacatggaccatgaactgtaggggaactcggaatagtctgggtgtcatatggcccaaaagtgaaactacacaattagttccccacagaacataagaaataaatatacataaacgaagatgatattatttggaactaaaggagattagtgtaatgtattgcatgtctcatataaatgtctattgaaaataaaaacaaatgagccttacgagctgcagatggactaaaggaagtctcggt

SEQ ID NO: 89646 - DNA, 667 bp, Oryza sativa
  unsure (1)..(667): unsure at all n locations
atccgtagtcaatgtttgcggaatactgaatcaatggataatatgcttcaaaataaagtcaattacctccgtatgagtcatgttcttgagcggcacggctttggcccacttggtgaagtaatccgtagcaactagcacgaacctatgcccctttgatgacgaaggataaatttgaccaatgaaatccaaaacccaacctcggaacggacatggtttgatgataggattcaacacggcggcgagcgccaactgaacattgccgaaccattgacaagcttcgcatcccctatagtattagaaacaatcttcaatcatcctcgaccaatagaaccccgctctcctaagcaaccaattcatcttgtgggccgattgatgagttccacaaattccttcatgcacttctcccatagccactttagattgatcttcatctaaacacttcaataagacttcatcaagcaatgtgtatttgaacgcctctgggcgaattttccgattaaccttacgtgtaggatcggtcatatatctaatcaaaagaattctccaatcttnctcttgttcctgggcataaatgtccgaatttacaattaattcggcctttgaatcaattacagcgtgcccccagcgctctgtccaagaccagtcagaccggccgtgcaaggcttgt

SEQ ID NO: 89647 - DNA, 979 bp, Oryza sativa
tcattgcaaagctcagcccctactaattgtatcttttgtgtgatttttctaatatctagatagtgataatgtatactgcctcccccttcttttcttagggaaattctaaccttttcagcaaataaaggaggtaaaccagaaatatatttttctttccaaaagtcttgattaggttctggtagggtatatagttttgacaagaaagtatctttataccatctaaaatctgacattgttttacattttaaatttatcaattgttctctatttttttcatagatatcatgatagtttccagcaaagtgataaattatgttatagattagagtggctaaggcatcagaaatgttaccggttggattcccattaccatctctatcaggtaatggccttccttgatcatccctcttaactgcgcaaagaatctcctgtctttgagtttcatttaaataattattccaccatccttttaattgaccagaaaacccaatgacaatcatattggcagcttctctttctttgtttccattagctatgcaggcattagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgactatatcatatttctcattatcagaaatctcattgatgtttttatttacttttaaattatttagttttaaggctagctcattgactagttcttcagagattgcgggtccaaaagccttttgttttccaaatttgatgttaggatcaattgttgggacaaacataggactaacagactaaaaactagaagactgagaattagaaggaatatttatttttacctcaggtc

SEQ ID NO: 89648 - DNA, 595 bp, Oryza sativa
cggatggaagtcaagtgacataacagatgctgaatgacccgtgaaagtacggagtgaataacttgtctgcacataatcaaatgattagtcactacatggttttaggttatggaacatcttgcaatcactatcgcaatagttttttttgaattgatatcacaataagctattagcaccctaataggataactttgcaataaaatataggaaaatgtccattttacaaaattgaactcaagaaaaaagtcttgaaatgatcacctcaaactacaacactagacattttctagctcaaacatccaaacagtttgctttacagttgtccggttgggtttgtagttgatggttgattcccaaacttaaaagttcaatgttgtaaagtggagcttttttttttcttaaaaatatatatggtgaaaaggagtatacattgtcagcatcccaaacccgcacggttttgtcaaaggaagatgtagcaagccgtgacatgcttggactaaatcgaacatccgtaatcaatgccgaatgttcttctaatgaagatgtaggctttagagcaggctctgtacaccataaaagaacctgcgcagagtaa

SEQ ID NO: 89649 - DNA, 1479 bp, Oryza sativa
ttagcatacataatcatttgatgacataaagtaaagatttgatattcagtaaagccatctaggttccattctacaatttctttgccattgtaataagtcatattttgaatctgaggcatttcctcaaactgtaggtctgcataagttggtcgagggtaataattcctagttgtggaagtaagagtagaaggtttaaaaatcttgttgactatatcatatttctcattatcagaaatctcattgatgtttttatttacttttaaattatttagttttaaggctagctcattgactagttcttcagagattgcgggtccaaaagccttttgttttccaaatttgatgttaggatcaattgttgggacaaacataggactaacagactgagaactagaagactgagaattagaaggaatatttatttttacctcaggtcttcctgttttgtagccttccataaggattgtctctattcgatctgtttgttgaccaagagaacgtagagatatatttgcataattttgttgttctaccaaatgtcctatgtgttcaacctttgctgtttctccatatgtatttttagaaatactttttagtggacaagcttttcctccattatgagataattgaatggattcaaatggaggatgaacagagtctaccttgtttccactggctgtctcccattctgtagaaaccttcttgataacagttaaatcttctgcttcggatttttgctctttttttatcatgttttttcttttgaagaattcttcgaagtgtataatctggctattctcgtaccagtcaaagaagaaaatatttctcctttgttctctcatttcgttatgccaaacttctcttatcttcattctgaatgattcgtcaacttcttcaaggtatcttttagtcttagctctatttttggggagccttatttctctcctaagcaattctttgtcaatttcaaattcttcttcttctaaagcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctagtgtttcaatcaaggattcgacttccgactgatccatagacttaggttcaacagcttgagataaaacccatttctcaggcagggtgatctcatcccatttcagggttttggggatagtatgtctgttattaggattggtttgaaggagagtggttaggccttttggtgtataatgtttggcacaaggtgctaaagttgtcatggctttgtagtaaactctgtgtgtgtgtgtgtgtgtgtgtgtgtgtgtatatatatatatatatatatatatatatatatatatatatata

SEQ ID NO: 89650 - DNA, 2938 bp, Oryza sativa
  unsure (1)..(2938): unsure at all n locations
tttgttgttctcgtgcaggtactagttccaacttatatttacaaagtttagtgttcatatagaattcatatactgagttagttttatttaacaataggtactcgtggtcatgataaaagagaagaccaaatttcaaattacggtcagtgttttagtaggccagaaacacgatgtatgtgccgagcatgcatgaagataagtcttagggatgatggattgtattgcatatatgaattcttgcacgagcataaccacattcttgctactggaagtcaggccctttacttaagatctcaaaggaaaataactgaagcacagatggcaagtgctgaaaatgcaaaatcagtaggcatttctaataaggctactattgatttaatggcaaaagaagcgggtggatatgagaatcttggatttactcgtgaagacatgaagaatagattatattcaaagaggtcattgaaggtaaacgaaggtgacacagagggagtcttggaatatatggagaaaaaatcatcggaagatgttaattttttctattccattctggttgatgaggatgacttgataacaaatattttctggactgattctaaaatgattgctgattatgaagtttttggtgatgttctttgttttgacacaacatatagaaaactaaatgatggtcgtccatttggtttgcttgttggtgtggataatcataagaaaagcgttgtttttggtgctgcacttttgtatgatgaaactgctgatagttttgtttggcttttcaagacatttttaaaagccatgtctggaaagaagccacagactatattgactgatgaagacgcagcaatggccaaagcaatcaagttagtcatgccaaaaagtcatcatagaatttgtgtttggcatatgaaccagaatgcctgcaaacaccttgctggagttgtgaaggagtacaagaaattcaatgcagattttcagaattgtatttatgacaaagaggaggaagatgaatttataaatgcatggaatagaatgcttgaaaagtatgatctgcaagagaacaaatggcttgagaggctatnttacaaaaaagagcaatgggcattagtgtatgggagaaacacattttctgctgatatgagtggaacacagagaagtgagagcatgaacaatgaattgaagggctatttcagtgtgaaatatgacatacttaccttcttggaacactttgacaggttgttgtcagacaaaagatatgaggaagtcaaaaatgactttaagacaacccaaagtacaccatggccgaaagcagatttgacaatattaaggcacaacaagaatttatactccagcaatatttaaagtgtttcaggaacaagtgttgcaaacattgaactgtgacctatactggtgtacaaattaaaagttcgcggtaagcaccattagcatgttgtaaaattttctccaacagaaggtaaagtcaggtgcagctgcaagaagtttgaatttctcggaatcctatgttgccatgcattgaagatacttgatgttaacaatataaaagaaattcctaagcaatacatactacaaaggtggaccattgatgcaaaatctctacatataaagagcaactgcagtactcatgaagatcctaaaataaagttatcaacgcgcaggagagacttgtgcagaatgtttgttaaaatagcatctcgagctgcagaatctgatgaaacatacttaatggctgccaacaatgcacaaaagttagcagaagatgtggagaaatacttgagtataaggcctgatccagatttggataaatctggtttgtatcctactctgagttgaatagtacttatgctagtgactactatgttataatctaaatcagctatctcaaaaatattttatcataggcacagaggaaaatgttgacccgagtaaagcaagaggcataaaggttaaagagaaagccattcgtgggtcgaggagaccaattggtggttttgacaaggcaacacaacggagtaaaaagaaaaagagtgattcaaacacatcaaagtgtccagtacaagcagaggtggtaacaccatcactgccatacaccatgatgcaggtcagtagattcaagatatacacacacttggcaaaagagactcttattagtgctactgattattatttgccttatacagattcagggtcgttcagagattcccactaactacaatcacatgcaaatgccagactactatcatgttgaaggtgcttcattacttcagtcatctggttatttcagaacttctgaaaaaagtcaagggatgcagcatgaagagactgcacagacatttgatacatatccctatagcatgtttgcccatttaaattaaaatccccaccttttttcatattaattagcacctttaccaatttccaatcacattacaacttataaggttggatcttaatctgaattcccatatcgattcaagctgtcaaatcatactagtactttctcttgtattagcatcaaatatatggttcccaccaaacatgttgtttggctcatataaaaaaaatcctaataatttagaagcatcaaaatacaagaggtgtttgcaaaaatgaacttaccaaataaaactaccttaatgcagctgtatggtgaaaaaagtttcgatcttcaattcttcacttcttcaccatagcaaacagtagttgccagcagcaagggagttccacatttggtactgaccattaaactacaccaagccgacgagtatgcggagtgcagaccacgccaagccggcgagcccggccgccgacaacgcaagagcaaccatggttgcgtgcggccaagaggaagatgaggagagcagcagatgagcagaacttcagatgaactctctgatttggggacaagagataaggatgcagtggt

SEQ ID NO: 89651 - DNA, 11313 bp, Oryza sativa
  unsure (1)..(11313): unsure at all n locations
tggagccagcgccgcattcaccttctcaaaacctggtggcacctgcgggaagcctaaacctccctgcgccgcatctgcctccccctccacagcgatgaccccgagatagatcgacgagccgacgctttccggcctcaccggcgccggcgtagatcacaggcgcgaagtacctgcccctaccgccgttcccctattcttcttcccgccatccctagccactgtggacggggtatagcccggcgggagcagcacaaggccactacggagctcaatctgcgtgaacttggggcggtcgtccatggtttcgggcggatcagaggagcggcggagtgggaggatgagacgacgaccgacgggagtgaagcgcggcgagaggcgggcgaggcggacagactagagagaggggatggaatggtcgaatggttacagtcggtggcgagggaagggcaacggcgtgtgtggcggagtgggaggaggcggtagcgagaggagggaaggaggcatggcgacaggtggtcgagggctcgaggcggagagacgagaggaatggccgaatggataggatcggcatcgtccagccagggtaggtggggaaaaatttttgggggcggcccatgacctcgcgctagcataggcatgcccattgtgggcttcgtaccctttaccagtgcctccattgaattaagctacacaactagaggtgcttgcactgtgggataagtgtctatggaccaactttttgggctaggggtacgggccccatagcttgcactgtgagaggccttattctactatggccaggccactgtacattgggctaagacatgcctctacatggtgagaatgcattgctctacatggggtttgaggcttatgccctgggatgtcgcaacctgagtccgccatgctcgtgtgtttgatttccgaacatgcactattttagcctcatcgattggcttattttgattatcaatgataaaaaaaaattattggtaaaacttttacatatgtgtttttagagatttaaaagtcacggtaaaatataaactacaacgagaaaacctttaaagcaactttaaaattaagcaaactttgctacaggagtgtaacttcgtgattttagctatagaacatcgcacaaaataacttttgaatcgtgaaaattagctcttggataccacacttattagaatattcaattttgattcaataggagagagaaaccgtgtgaaagttttaaaatacccctgggcccatatgtaaggtctcccatctctctctcatgcacacaaggcatgcatataaagccttaaagttctgaaatgtcgtcgcacaccctagccttcgcatctttgacgacaccagccttctctagctgccctgtcacgccagcagctccacatcacttccgtgtgggtttgccctcaactttcccatccattactttgccatggatggccaccctttctcctagattccacctctgctccacatctgtcaccaaagttccaggaaaaaacctcctcatctggcaacacgttttgacgcgctcagtcggtcacgttcaccactggagcttgccactgacgtctctctctcctctgggaccatgtgtttattgttcgtgttcctgaatctttaatcctcctcattgctggttgccgccacctacggaagagtcacagcataggatgtgctcgcctggtcacattcaccactagggctttccaccggcgtttctctctactctgggaccgtgtgtttgttgttcacattactatatcttaaatcctcctcgttgctagctgccaccacctagggaagagtcatggcatgggacgcgctcagccaccgccatcacgttcattccctcgcggaagtcctaatgccctcacacattctccattgcttgttctgtaattgacatgagaaagaagatgaaaagtgccaagtgtactgtttagactgaactagtgaaatagtaaccaaaccataatgatgggtaggggtggagatatttagaccgaaccgaagaaccgaaccgaagaacctaaccgaaaagaccgagaccgagaaattcggttatcttttcggtcctagccctcaaaagaccgaatttatttcggtcatttcggttattgggctcggttaaccggggtaaccgaaattttagcccaatagacctaggaagcccaataaaaccactaaaacaaaccctatcaccactgccgcatagtgcactgccacaagccacagcgctgactcctnctncagccncaccgcgccgccgnncgcacttgcggctnncgcaccactgcgccgtcacctactccagcctccccctgcgccgtggcccggcttcggccttcaccgcgccacagacaacgcctccgtcctccaccggcggcgcctctatcaaattttttcgttccaaacattctcctcaaaaatttcagtcagaacaagaccgagaccgaaaagactaagaccgaatttgccggtcctgagttttttttatgaaatttggttctgagtttacaaagaccgaactgaccgaaaaactgaagaccgagaccgaatttttcggtctgaccgaacgcccacccctaatgatgggagataggacaagtgatcttagaggtatttttgaagtttcacgtgatttctctctcctgattaactagaaacgaatattgtaactgacgtgatgtatatgacgtgatgtatatgaactaatttccacgtttatatagtgtattctccgtaagtcattgcatggtgtcgcataactaaaaccgcaaagtcacgtttgccatgtaccaaaatttatgttaaaatggtcaatgagcttttttttttccacatgaaacatgaccaacgagcttgagccgtccgatctgcgcagccagctcccatcggacgttccccacccgccctcgacaacggtgaaacgtcgtctccacgcctcacgcatgcacccacccatacagataccgaattgatgtgcacacgaggcaggcaagacaggggagaggcagcccgtgggccgtggcggaggcgaggtggccattggacgcagtcacatgaccaaagtggaatgcaacccacacacgcacggaaacaaatgcaatccaccaccatcgtcgtcttctctctccttaccaaccaaacgcagtggcagtactagtagcgtccaagatccccatcaaccagagcagcagcagcggagcggcagaggatcggaggcaggcagggagctcacccacctccaccgccaaaagctttcccttcctccatccatcaggattcaggcatcagcccccaccacctcaaaaaacaacctcagattcgtttgttcacttcactcacccagttaactttgcgaggagagagagagaggcagtttgagtgcaacgcaagccaagccggtgtcaggctcagaccccgcccaggaggagcagcagctgacacagctttcttcttccttcctgcttcctcctccagtctccagagcagtggtgtcgtggtgggagcgcacccgcacccgcacccgcatcacaaggcggcaaacgcaagcgaccaacaaattaaggagaatgcagcagcagaccacgggtggggtcgccaccaggaggcggctgtcggtgccgaggggtgccggtgcggcggcggcggcggcatcggcggcgtcggtgtgggagacgaggatgaagatggacgaggtgaagggaggggtcaaggtgttcagcgccggcggggacgacgccgacgaggaagggctcagggtctaccgccgcctcaggcgcaaccagagcgacggcggcggtggcgcgtcggggtcgacgaatgcggcggccgcggctaagaagaggcggaactggaaggcgtccgagcccgtcaccgccatcggggacctgcgcaagtcgcgctccgacgtcgccgttgccgccgcggcgccggcggtcgggatcgtcaccaccgccaagcgctccgtcaccagggtcaccacgccggagaagaaagtggccgcctccgccgctgccgccgaggtcaaggaggtggttgtggtggaagtgccggaaaccaacaatttggatgaggaaacagaggaggaggaggacgaggaggaattggaagaagagctcgaagcagaggatgaggaggaggaggaggagaagaaggtgctcgaccaagatcacatggccattgacgacgacgaagctgcaaaatcaacagctccgcatcaaggcaagtatcaactcctccagtgttgccatcaccaggatttcttgatgaatttggtattgattctttttttcccccacaatttctcagtggatgaccaagatcttgagccaccgacaaaaagtgagacgccaattcagccaaatttgcaaattccattctcattttctgtttgttttttgcatggcgctctaattgtgcgatcatttgggtgaaaattaaattaggaggggttaagattgtcccaacttcagtggaggatgagagagcggcaaatccggagccagtcaagcctccaggtagaactcggcctagttcttggccactttaattttacctttatttgtcttttttttttcttttgtttcatcgtgccaagaattttccggtgatccagtaaagaagcttgccgcaacaattgatctccgggcggtgaacccagagccagtgaccattccaccaggtgaattcctcctccgtggatgcaaaacctgtaccaattttaggtgaatttcgttctgtttcaccattcatctcgaatatttccaaaatgcagtggagaagaaggctatgccagtgataattcaccggatgacgaacgcagagccagctaaaccttctccaggtaaccttgacgaaatcatttgtcttcttttggagaacttttggggggaaagaagagatcaactcgaaagcaatcttgtcatctcctgcgtcatgtgactccaatttttgtggtttctcggtttcttcagagaaaaaagcgtcgccactgaacggccgccggattcccaagcaagatccaatcagtgctcctcctggttagtgccatttgtttctgctattccttgaattgctttctcctaccgttttggtatattctgaatatggaagttgatttcttcccctgaagtcgaagaagagtacgaggagattcagggcaggccatcagtacccagcagaagcaatggaagaatgcagaatattggtcagttatttttccttttgtaggaaagatgcttctagttaatgaaattggaattgatggttttctttcttcttcttgtttcgcgttgtttttttagtggatttggtcatgtggagagatgtctccaagtctacacttgtctttggattagggacttttttactgatctcctcctcctatgccaaagacctaaactataagtaagccactgttcagtatttattactgcactgtcactttgttaagtctgaattctcaaagctgtttaactgtcaaaatttgttgacctttcccttcaaatttataaatcttgcagcacaatcacagcagcttcatatcttggcctagtctaccttggtctaaggttccttagcaagtccatacttaacaggtagtaatgattgttatccagattatctgaataataatcacataattaaccagcttgttgaaagtgagctaatcttttatttgatcatcaattcaggggagagaatgtggactgtgatgatgctgagaggagtggtgaaaggtacctggtgggggaggaggaggccatctggctgctcaggcttgttctgccttacatcaatgaggtgctcctgaatctaaggtccctcttctctggtgagcctgcaacaaccatgaaggtaaaaaaggggccattgtctgcttctgtaaatgctacagagtttggcaaaatcactggagtagtagatgcatgcatatggacacatctctagctagatttgtactgacagagggactctacatgtgctctgcagctggcactcctgctgtttgcaatggcccggtgtggcaactttgtcaccctctggacactggcaaaactgggtaagtaccaatggaacaatgcacacatgcaaagtgttttatgtctgtagcctgtacatatcctcctgtctctacagcctcatctctttcttcgtttcaacaacctcatggtgctttaaatcacagccaaactaatgttcatatgaacaattttgaggaaataggtgtgatgaaatagtatcttctgcacaatcttagcttaaaaaaccttgtatgatgctaggaccacaggcatcaagaagtgctgttgcttgtacagataaaggttaaagatctatagcaatactggtcacactgacatttttgtacctttgatctggccttgtttgcagtgttctttggggtcttcatcattccgaaggtgtgctcatcttactccacccagcttgcaagatatggtaagtccaagcgctctcttgttttaaccgcaatttctttgtattcttctgcatcaccaaagtaccatgcacagaaagacaacatacaagaataacctaactcagtcaccgacaaagcggccccactgaattctaccattagtggggccctattgccagtgactcatcactttcacaccttctgttcactttcaacatgcaagaataccattttttattttttatttttagagttgaggttgttggatctggtaacattggtcactgcttttactggtcccccgaggcacttgggcatgtgcacgggtaggactagctagagagactgtaaattactgagctaggtaaattatggagaagggtagaagaattttgttgagctaaggacaatggtatttgggagagtacattgagacatatatgtactataagtagcagtactccactgtaccagtacatcagggttgtgaatcaacccttctctgaagattagtccttttctgcatcttctgggttatgatctgcaatagagccaaataagattgttccaaaactagtccatcaggctgtcaccatgcttgattaactgtttctcacatgccatctaaattcatgttgattggaaacaaactgcaaatacttgaattgacctttacttgctctttaccacttccaaggagaaccaagactaatttgtattactactatttaacctacatttaggtaatagtaaactaagaaatcactcggggggcgaaaactaagaatgggaatgtggttagtcctagggctttgttactgatggtaaaaaggtaaaccggtgacttctgttttggaacaaagtattagtactaataatacattagctaataaacaaagctacaattggacctaggttttgtgactgatggtagaaagtgagagtaagccggtaacttgtagctttgaaggaaaggtaaattaggcagaggtgacttttgcattggagggagagcatgcacggttattcctcctaccttttgcacgtgcgagctgtcgcgtggtcaacatgggcttgattgtcattgagatgctttggctgtcaaaggatatttacaacactgattgatgctgtctcaagtgaaccacgcctcctttgttccctttttcttttcaagggcaaagttaagaagaatctttaccaacggctaaggattgtcttacaatgctatcatgaggtaatagttcattgttaaaattttcactagtactaacaatacattagcaaacataaagcttatttcgaaatatctaatatgttgcattttacctttatttcattatctatatgatcaccatagcgtgcctttaatatatctgaaaagataaagaaattccaaaaatattgtctggggagaaaggcatattagcatgaaaagcaaaagcaagtgattgtggattagtgggccactattctggccaccaactctgtcatagtagctgatgttatagagttttactgtttcgttagtgtcctaaaattatactacggagtagaacgtatgcactgtcaccttgtgatatatgacaaggtgatatatgcactgtcaccttgtgaacgtatgcactgtcaccttgtgaacgtatgcactgtcaccttgtgatatatgacaacaaaattaatttgaaccagagctccagctttaactactcttgacctttctgcttggaccatagatttgtctctttgttgaccaaattaaacataaactgatggtagtacgtgctagagtagacatcaagcctagcttgcccactgtcaagtgcctttaatcaccatttaattagtcacattttttttctagtagtcacatcactagggtagctggttaagagtatcaatttctccattacagccagaaaatgacaggtatagtcctgtgaggacctctactcttcttttactcatggaacttataaaatggttacatagctcagtaccttcaaatatactcattttaattttccccttccatatgatacttgagaaccttgtagttaaccatgagaaccatcctagcagaggacgcttcatggtcatcatgtgtaccagtaaccctggcaggatgaaattgcactgttacacaaaaaaatgttggtgtctgcttgcattgggattctttgatctaggcatgtacccgtcagtactgaagcttcctagctttgctcttttgcatgtgaagtgttgggcatttggtcactccccctccacaagcaccacatacatgactgttttgtggggtcctaatatttgtttgtttaccaacccaccaccaacccatgccagatgcagctctgaaaattaatcagggacgctctaaacaaaatgatgatgttctgctgccatatctgacacttgtttaatttgattagaacttgaggtgattttctggtacctgtaccaattaaaaaccataatgaggtgggggaacaacatttcatgatgttgattgtgatcaaaaggtgcaccacatataataaatttactatatataccaaatccatgaatttctcacgactgtatagtgactagtgaagccggtagatagcttgtcactctccaaaggttaatgtccacgtctttttttcccatttctaaaggttcctcatttcatttgatagcacaaaatttcctgttgataacggaaatcagacatatatgacaaaatggaagaaatacatctctctcataggttaggctacggagtatggagcaacagcggcaccaatccattttgctttccaaaggaaaagaaagctcaaaaggagggataaaaagcatggctatctttatcctcggttatatctccatcttttgtttttcaggacattgattaggtcacttaattaaacccaactttacttacccttaatcataatgtctagtccgttctgatgaataaagcgatactcaaaaaaaggtaagatgtcaggaatccgacaaacagggcagtaagcaaactgcaattagttgaacatgatactaccccctaggctgaaggactggattaccataatgcaaaaagaacttgagcttaactaatatttcttttctcttttttgtgtgtgattttcttattgtacaaattgaaatgtgtttattggaacgaaattaaagtgtcttttcctgtccatggcagggaggttttggctggagaggttcagggatggatgggagtcctgctcccacaagaaggcggtcgtggcagccgtcttcacccttgtctggaacgtctcatccacggttgctcgtgtctgggctggtaactaccttctccctgtaaaagcatccacgatccatcctgcactcacaacagtttccacagtctcagtgctccacctcacctagtatgaatagaattaaatgagtttgtttccagattcgtagtaacctaaaatcatttatactttaggacggatttgagtaagagagagtgatgtgacaaatgagttcacaaagagttgcagatagtatctcccgtaagacactaataattgagaaatctaatagaaatgtgagagtgagaaataatggtcttacaatttgtactagaaactataagatagttgattgttggcaccaatctgtaactcccaaactctagaaaaaactttctacactgtgtggtattttggagtgctgatcaccatcaacctctgctgtgtatgtgcagtgttcatgctggtggtggccatgaagtgctaccagcagcggatgatggagtacggctggagcagcacggtggaggactcacaggaggccaccgccgccgccaccggcgacgatgagtcaccgcaagaagaaactcctgctagatcaagcccggccaaggcgcacgaccacgagccggcacagggatttggggcggcggcgccggcgcggcatcgccggacgccagtctccggcgagtttgcaagggagaggctgagagtgaggggtggcatccagcctaggtgacaggacaaatctgtggatgccgtatgttttttttttctttcattttttttacattgtggtaggtttgggttgtgaggacgtaatgtcacgaaatggttcacggaaataatgagtatgatccacacataggagttccatataatagaatggctatagaaattaatatatttctccacacatctcacttcctccatttcagaaattttaatttctgctacaaatctacagcctacactagccatgcataacacaaaacgtacatgcaaaaattgatgttttttttttcaaacagctaatcagattgactggtgttatattaatggggcaatttcgtttccacccctactttgatgtctaatattgattttatctctactttttagggttttcgtttttatcctcatttttttaaccaaacgcttgttttgcctgtactttggatggtaaagttaacggcgttaagtaattgataaaatgacatttataccctctcatgtatgttcattaattgtgtttttgcccccattttatacatatagctttggaactttatttttgggagtatatttaaaactagatgacgcacattgactagtataacaatttggccaaattctgaatttgatggaattttgacaaaatttcagcattttgatagaacttaaacaaaattttgacaacattttgtaaaatgtaattatctcttccctttagatattagtcaatgtgttttatttaattttaaatatactcacaaaataaagtgctaaagctacatgtataaaataggggcaaagatataattaatgaacaggtatatatgagagggc

SEQ ID NO: 89652 - DNA, 1866 bp, Oryza sativa
tttttggacctgcactaaagtttagcagatcttccaggcctcgtgttttcacattaacatgcttttggcactcccggtgggaccattagaagtcagatatgtcaggagacaagcaagcttcgaagtcaacagatcctcaacacaagcctccgaatccaattgggtctgaagttcatgaaggaaatattgttccagtcacactagataaattgtcggctgaacataggcaagagcttgagcagatgatgagtagcgttaaggacaagttcatgaattcgttccaacaaacccgtaaagggacaattgtgcagaaatacaagctgaaagtggttgctgccgatgaagttggtccaagctcagctcaaggcgataaaggcatcgctggtgaaccaggcgacaaaggtggtagttttcaggagggcatggttgaagatcttggtccagatggcagtggatacaaacaacagttttacaactttccaagatcggattgactatgttgtgcaacatgctttgatcaatcagttaggagtcttagtcaatactttaaccaacatggtgaaaacagtggttgatggcacaatagctgagcatcaagctacacgaccagtgtgtttgccaggtggcgtttttccaaattataggcctttggttacaggcaatcaacagggttcttccaacccaccatcaactcagccgatggcacaggctatagcttctgctccaactgcaccggctgtaacatcatcgggacaaaggcaaatgataaatcctcgactgctaacctgggagcagccgcagcatagtgggcaaaatatcaatcggttgattcaggaacaggtggccgctatgttcttgccaaatccaccagttgtcgatccagcattgccgagccagcaaactccaccaaggcagcagattactcagccgattcaacagcaaagtttgctaaatacatcgtctaggttgaggacacctgataatcagcaaaggcatcatgttgcaactcaagttgtccccgagcatttggttcataatgtgcaaccagatcagtcggttataccccaaattattcctgaacatttggtgcgcaacatccagccgaatactcagaattatcatgggggccacttgaattatcattactagcctccttcacctcatgtccaccaaggggggtctcctcaacctcaatttgctccttagttcaatcactttgagctgatacagcagcagacgcatggggcacctcagcagagacagtgggccgacatgatcacagatgtgatgagggagcaatttgggctgaagccaaaggatactgggaacttatatcggcatccataccctgagtggtttgagagggttccattgcctgcccggtacaaagttccagacttctcaaaattttcagggcaagacaatgtttcgacttatgagcatgtcagccgattcctggctcagtgtggtgaagcatcggttgttgacgccctgagagttatgctatttcctttgtccttgtccgaatcggcttttacttggttttattctctaccatacaattatgtcaatggttgggccgatttggagaaacaatttcatagctattttacagtggaattcatgagatgaaactttctgacttgacagcaattcggcaaaggcatgatgaatctgtgcaagattacattcagagatttagagagacaaggaataggtgctacagcttggctctaacagattctcagctagccgatttggcttttcaaagtttgatagctccgattaaagagaaattctcatcccaagagtttgaaagcttatctcaccttgcacagaaggtgactctgcatgagcaaaggtttg

SEQ ID NO: 89653 - DNA, 1492 bp, Oryza sativa
gacttggaaacttgacttctgcagcggggcaactccattccacaggcaatccttgacagcaacgacgaaaccaacttcgacaagacagctcccactaggaagatcttcagctctggtgtgggggaaagagagcaagactgagtactacccactatactcagcaagtcataccggaagaggaggtatgatgcaggatatatccaaaggaggctaaaggctcatttgcataaagctagcatttaaaaccagtagttgaaagcagtaaaatagctgtagtgatttatcaatattaaccaaccactgtccaacgctacaccacgttgcaacaggcccaaaccacctcctgaactaaccagttccattagctaactaggggtgagactaatcacggtgaatctggtcgaccgcccataaccgcgggcacggctattcaaatagttttactctgatcagaggtgtacaactgtacccacaggacacagccccacgacacgttcctgtgcgccgacatgccaccatgacataccggaaagaggccgtgacagaacccttcgcataaccccctctaactaatcgcaccacaccttagggttcgcccccgtccccagcaggcaacgggcagccccccttttgtgccgtggtgaatccggaagccgaacaaccggacaccccggccgacccaactccatcacgcccaccctcgcctgggtacgtcggctagaggaaagctacactacaagcccagccgttgcccatgctggcttgtggtaagtacggtaagttcttccagggcatcccgcgaaccggtccttaatcgccatgggaacgactagcaaaaccatgtacccacagcccaccatgtagtgtattttaattaaccaacaccattgcggtggcactaatccaaagctatgccaataatcaaagtctatgctttaatgtaatccccctttgtgcactagttgaactaagcatagctaagcaatccctaatccaacatctaatcatcttaagacccaagttatcaatggcataaggtaaacaagatatggctgagtagtaggacccatcccacatgatattgtaaaacaatgcaatatttaataaaaatgcgggacatttgtaaattgggtacaatatgatcaatcgtaatgcatgacttacctttctctcgcactgatggaaccacagcaacgtcttcgagaaaccgcggatcgacgaaacggccgaaatctacgcaataaacaaagcacacaagcaaaacaggctataagactactgaaacaggaaacaaaaccatttttaatggattctatgtatttttatgaatttagtgagacttgaatggacttaatcagagctcggatgaattagatatgatttttagaagattatctgtgtttttactaataaagaaaaggccttaaataattactgcgcaataaatccccagggctgacgtcatcaagggagggggcgctgacatgcgggc

SEQ ID NO: 89654 - DNA, 2110 bp, Oryza sativa
agaagattatctgtgtttttactaataaagaaaaggccttaaataattactgcgcaataaatccccagggctgacgtcatcaagggagggggcgctgacatgcgggcctcactcggcagcggctcaaggggccggtccaccgtggaccgggaccacgcgggtggtccaccgccggtccacgggaccgacggcccggatcggcccggggccgatcggacggtgcgggcggcggcctggcacggctcggctcagcacaaagccggccgaccggccatgggggtgcggcggcggcgcacgcgaccaccggcgacggcaagcggcggcgcgagcggcggcggcggatggcgcacaggccgacggcggcggccgaaggtgatggcgagcgcgcggagagcggcggcgcgcggtgaaaagtgagaaggagggaggagaggggctcctcaccggagggcggcgaccagagcggggataaaggtggcggcgacgacccggcgacgaggagggcggacgggcggcggcggcacctaaggagggagtggagaggggttaggggtttggaggaaacccgcggcgacaaaaatggccggccggagttgaagggaatggaggggctcaccgacgtgcgaggaaaccggagctcccgaggggttcgggcgatgtgaggcggtgaccgaggtgctccaagcggcggtgaagctaacggcggcggcggcttggcgcggtggcggctctagcggcggcggcgcgcagttggaggcggcggcgagctgcggcgcgggcggcgagcggcgcgagctcggtaggagtcacgggagggagcggcgagagcggaaaggggaagaggagggcacggggaacgttttataggcggaggagaaggcgaacgtggccggaaggacctccgatttcgccggcgacgcggggaggagagagaggaaatggggggattcaaaatgtgaatcccgcccctttcgagcgcacgtgcgggccgggacacgcggggagagggcggcgacgtggggaggacgcgtgggcgacgcggcgtgggcgcgggaggagcggcggaggtgggcgcggcggttgccgacgtggggcgggcggccggaggaaggggacgaccccgacaggtgggacccacctgtcggcgtcccgaggagagagggagggagggaggactttggggaggggaggagaagcgggccggcgcggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaattctgttagcatattttgacatgtagaacccaagaaaaattccacatgtccgttccgattattatttgcatttattaattaaggattcaactctaggttaattcaacaatttctttaggcgatttatttaacaaattttaaagctaaaaaggggaacttcagggcgtgacaaagattggctagcttttgcttttcatgatctaattcggcattgcattcttcaagttgagctataagatcaatcttgtgggcttcaagccgatctatgttcgactgaatcgccccaacagagagttgatcaagcttggctttctcctcatgcacaagttgccgattggcttggatagtggcttcaatatcttttcgcacctgctgatcggcaatccgttgcttagccttctccagcttgaattgatgttgctcgagtgacacagctggagtaatggtatttgccagatcatccgggattaaggcttggatttcagcaaaccgtgcccggatggaaccgcagtcggccaccaagttgtctaatgatgactctagccgaagggatatatcttcgagtgttttcttgacattttcatccagaggggctagagccttgcttgtggattcttcttctacttctttatcaaagtaatctttgatgtcaaaggagaatagatcggctaaggtctggaaaagagaaatttaaagatagttaaatatcaaacagtgtcagccgatctaagatttatgtaatgaaagacttt

SEQ ID NO: 89655 - DNA, 623 bp, Oryza sativa
  unsure (1)..(623): unsure at all n locations
aatttaaattgaaaaatttaaaagtcttcttttggctttgggccgaaagccggcccaaaaccctctctctctctctctttccctcggcccagccggcccagtctgccgagccgccgctctcctctctctttttccgccgctgacaggggggccccgcttgtcagggtcttcgtcctccttcggccgccggcgcccgcaaaccctaacgcgccgccgccgccttttccttccaaatacgctcgattctttccttctccggggaaatctttagaggggaaatgatcttctcgatctcctcttccttttctcttttggaatctctggtcaattcgggttggaaactcgatggaatcgagatcgaatcggattcctctctctcccaaaccctaaagttttcttctcgccgccggtcgccgtgggcctccgtcgccgctcgctagcccctttataaggacccccaagctcttctctacccgtcgcctccttccctttcgccgccgtcgtgtgtagcgccctagcctcgggagcttttgcgccgccgtcgccgccgttcgtacagacgtgcgccgncgtcgctacagtcgtcgtcgtcactcgggaaggccaccgtcgggatcggcaag

SEQ ID NO: 89656 - DNA, 2911 bp, Oryza sativa
ttaagcactgtaggaaggttgtatacatgggtcatcgccgattccttgcagcaaaccacccggtacggaagaatggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatatctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcacccaatcggggtacctgaatcacgccatgaagggagactacggggaaaggaaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacatttcagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatcttt

SEQ ID NO: 89657 - DNA, 681 bp, Oryza sativa
aggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtcttaacatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcattcggacatgcgtgaatcttatgaacttccagtcctaacgggcggactatcttcttagcctcgtacgttgtctcgggcaat

SEQ ID NO: 89658 - DNA, 579 bp, Oryza sativa
ggcggcaacgagtacgggatgacctgcaggtacctcgagtccaatggcggctaccggttcatcgaggggtggggcaagttcgtcgagaccaacggcatggccatctccgacagccagagatggacacgggacgtcgtcgtcaagctgctggcgttccggtcgcggaggctggccaaaagcgccgagcagtccgaccaccccgacggccccatcggcttcatcgtgctgcaccacgagaacgggagccggggccgcggcgacaacgacaacgacaacgaggaggaggaggaggaagaataccaaggcaaagcgccgccggccaacccgaagaaggagaagagcaacggcaaggaggagcatgtagtaagggcgtcgacgtcgtcgtcctcgtcgtcggcggaggcgcccgtgggcgtggtggcgccaatgcacgaggtgtcggcggcgccgcggaatatgttagaagaggatgcgtgcctggggatggtgaagctatggagcgacacaggctcgtcgtcgtcctcgtcgaaatataatgggcccgaatcatcagaagaaaaaagaaaaaaagactgacgg

SEQ ID NO: 89659 - DNA, 1042 bp, Oryza sativa
ctccccctcctcgcaagagtaacagtggaagggacatagaatatgctctaggacttttaccaaatggaggtggattagctcctccggtcctcgtgtatcatgcccccaggacctcaagtctgcttcaagagcagacgatagagccagccgatgtcggcaggaagagaaagaccaaggcaccggcagttgatccatcagctctggttcacaaaaagaaagcccagaagcataaacccaagctagccgacgacttgcctgccttagatccatccatcgagcaagctctggatgaagaagaaattgaggaagacgtcgatcaagcggcagccgaactgagcgatgaagaagaaaaaacaccattagcttcacccaagcaaactcctccaactcctgctgccccgactcacttctcaagggtaaaccactcaccttgactccctcttataatcattttattcatagccgatcactcataaatctcgttttggcagaaaaagaagactgctgtgaggaagaaatcgacagcaacaacacttaaaccagctccaccagtaagattttcttatacaaattctttctctaatctgatcatagctgatatttacttcacacttgtctttttgttgcctcctcctccttcaccacctgtgcagcaaatgtcaattgaccgtaccccatcggctacaggaagtcatcatgttgaagaagaggaacaaccagccgctcctgccatcctagaaagtctttcattgacataagatcttagatcggctgacactgtttgatatttaactatctttaaatttctcttttccagaccttagccgatctattctcctttgacatcaaagattactttgataaagaagtagaagaagaatccacaagcaaggctctagcccctctggatgaaaatgtcaagaaaacactcgaagatatatcccttcggctagagtcatcattagacaacttggtggccgactgcggttccatccgggcacggtttgctgaaatccaagccttaatcccggatgatctggca

SEQ ID NO: 89660 - DNA, 1121 bp, Oryza sativa
  unsure (1)..(1121): unsure at all n locations
tgttctggatatgtgagatcattgcaaatgtgaatctcttccagcggagcttgctcttccggcactcgtaaacatttctttagctgagacacatggaagactgggtgcacatccgcgatattttctggtaactgtaactgatatgcaacttctcctcgcttggcgatgatctgaaatggtcccacatatcttggtgccagttttcctttgaccttaaacctttttgttcccctcatcggagaaacctttagataaacgtaatctccctccttaaattccaggtttcttcttcgggtgtcggcgtaactcttttgtcgtgattgtgctacttttagacggtcacggatcaagcaaaccttttcttcggcttcttgaataatgtcaggtccaaataccgctcgttctccagtctcggaccacattagcggggtatgacatcgtcgaccaaacaatgcctcattgggtgacatttttaggcttgcttgaaagctgttgttgtaggagaattcagcgtagggcaaacatctctcccagtccttgctaaaatccagagcacaagccctcagcatgtcctccaggacctggttggttctctccgtctggccatctgtctggggatgataagctgtgctaaatgcgaggtaacttcctagggcttcatggactttctcccaaaaatgtgaggtaaactgtgtgccccgatcagatataattttcttaggtacaccatgaagacatactatcctggtcatgtataactcggctagcttagcactgctataatttgtcttaacgggaatgaatctcgccgtcnnnnnnnnnnnnnnnnnnnnnnnnnaaatggaatcatatcctgttgcgggtttgggcaatccaacaataaaatccatacctatctcatcccatttccattcgggaatcctaaggggttgcagcaagcctgccggtcgctgatgctcagccttcactttttggcacacgtcacagagtgctacgtattccgccacatctctcttcatgttgggccaccagtatccttccttcagatcttggtacatcttcgtacttccggggtgcaatgaatatgccgattcgtgagcttcctttaaaattaatcccct

SEQ ID NO: 89661 - DNA, 2607 bp, Oryza sativa
  unsure (1)..(2607): unsure at all n locations
cagcgagggtgcggggcgggcccgcccgtcagcggcgcgcgcgcgggganaggccgtatggcccgcgggaaagaggagagaggggaaggaagatgggccggaccggcccaaggaaggaaagaaggactttttagggtttttctttttataaaacctttttaactttgtttatttcttaacaattattatttgtgctctgaaaattccactaaaatttatttacgtattttaggcttttaggaaatacacaaaaatcctccaagccttatttgacttttaactttgcacattttaattgttggaggctttcacacggattttaattattctaggcataatttaaaggatatattttagggtcgttttgggatgtgacacggcgggtagcggcgggcttgggggtcaatttataggggtttagaggtggcggcgaaggcccacggcgaccggcgacgcgaaggaaagtctagggttcggaggagagagatcgatccgaatcaaactcgaatccacggatttccaaacaattttagccgacgattccaaaagagaaaaggtagaggagatcccgatgatcatttcccctctattgatttcaccggaaaaattaaaggggcgggcgaatttggaaggagacggcggcagcgcggcgctagggctcgggcggcgggcggccggaggtagacgacgacctgacaggcgggccccacctgtcagcgtccgagggcgcgcgcacgtggctgctgcgggcggactgggccggcttgggccggggagagagagaaggttttgggccgactttcggcccaaagccaaaagaggattttaaaaaccttttttaatttaaattattcattaaatgtaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatatttgggatttttagggtgtgacaaaacccttaccatacccaccgccgggagttcgcactccttgaatgcggaaacgctccccctttggagtggatggtgtagcggtgggtgtggtgtacttgtggagcacctcatcccctgccttggtgaagagggtgcccacgtagcgctcggcgggaggcggcgcggccttcccgtcatcttggaaaaggcattgagcctttaacaagccgaactctcccgtagtcggctgttgcgcagggaaatccccccggatttttgttcttgtaacatggcgaggggagagatatcgcgctgccgaacggggggccgaacgggccgagagtgtgcaaaggtgagggaaaggatgaagaagaagtgttatgctgtgatccgaacgttctacctacaaacgcacgtctaaacggactcaggacgagcgggggagactgccattcaaaattggtgccgatcgggcaccgtgatggttcggccgaaccctggtgggtccggcaggccaccagatttttcctaggcccacaaagtcctaaactaagcacaaaaatgacaactatacagggttttaagcatgcaatagatgagatcatcatggttcatctaaagttttatttggctcaaggaaaatctttaaacgttgaccgtttaccttaaatatgttacctgattcgtcgtggagtgtgattgccccatgtgaagaggtgtcgatgacatcgaacggtccttcccatttactgcgcagttttccatggccgaaaagcttaaccctggagttgaatatcagtactttgtctcctggcttgaatttcttgatttttatccttttgtcatgccagcactttgtcctttctttgtatatctttgcgttgtggtaagccttttctcttcattccttaagttcagcgatctacatttttctccattctcctgctccctcaaaatccatgttccaatttctgatggcccagtatgctctgtgctcaagttctacagggagtcgacatggctttccgtaaactatctgatatggggacattccaatgggtgtcttgtatgctgtccagtatgcccatagtgtgtccggcaatctatccatccatcttgttcccattttgttgaccgtcttttgcagaatattcttgatttgtttgtttgatgtttctgcttgaccactggtctgtggatggtaaggagtggccacattgtgtttggctcccatttctcgtaggaggtctcggaaggttttgtcaatgaaatgagaacctgcgtcacttatgaccaatctggggtaccaaatcttgggaagatgatttctgtgaacatcttcttggcatgcctcgcatccgcggcgctgcacggcataacctcaacccacttggagacatagtctactgccaccagaatgtactcgcagctacgagacctagggaaaggtcccatgaagtctataccccaaacatcgaatatctcgacttgcaaattgtatgtgaagggcattgcatcgcgagcagtgatttctccttgcctct

SEQ ID NO: 89662 - DNA, 4089 bp, Oryza sativa
agtagacccgatataggtatggctcatcccatatgtgacagcgactttcatacttcaattttcattgattttaccctcgtggtatgtacttggataccatgtagttcactatgttggcataccacgggttggagtcgtgaaccgtcatcagcatgtcatctcttaaaaaatcattgatcggttgttcctgcatgttagtgatctgcagcctggacaaatgatctgctacggaattttctactccctttttatctttaatttctaagtcaaattcttggagtagcaaaatccatcttaagagacgaggtttagcatctttcttagtgagcaggtatttcaaagcagcgtgatcagtataaattatcaccttggctcctactaagtaagatctaaacttatcgatagcaaaaacaaccgcgagcagcccttttcagtagttgcataattcaactgggctccggttagagttttgctagcgtaacagattgcatgatgctttttatctttggtttggcccaagaccgcaccaacagcgaaatcgcttgcatcacacataatatcgaagggcagagtccaatcaggatgttgaatgattggagcagaaacgagtgcctttttgagaatttcaaaagattttaggcacgcgtcatcgaagtcaaagggcgtatccttggctagcagattggtcaggggtctagcgattgtagagaagtccttgatgaaccttctataaaagccggcgtgtcccaagaaactatggattccttttatgttcatgggaggaggaagttgatctatcacatcaattttagctcgatcaacttcgattcctcgttcggacactcgatgcccaagaactatcccttcacggaccatgaaatggaacttttcccagttaagcaccaggtccttttcttggcatcgttgtaagattttgtctagattctgcagacaatgaccaaaagtatttccataaactgagaaatcatccatgaagacttccatgatatcttcaatcatgtccgagaaaatagacatcatacacctttggaaagattcaggagcattgcacagtctaaaggagatcctacgatacgcatagatgccatatggacatgtgaacgtagtcttactctggtcctccggatggatgggaatttgatgatatccagaatacccatcaaggaaatagaagaaggaatgatttgccagccgttccaacatttcatcaatgaagggtagcgggaaatgatccttttttgtagccttgttgagcttcctgtaatcaatacacatcctccatccggttacggttcgttgcggaattagttcattctgagcatttgcaacaaccgtcattcctcccttcttcggcacaacctggattgggctaacccactcactgtatggtacgggatagataatcccaacatgcagaagtttcaagacctctttctttacaacctctctcattgcattattgagtcgtcgttgaggttccctagagggagtactctcggggtcaataggaatacgatgggtgcaaagtgtgggattaatccccctaaggtcctgaagcgagtagccaagaacagaacgatgcttctctaacacggtgagaagatgttgagtcttgtcttcagagagcttgtcactgattataacaggggcttctctgtcattgtgtaggaaggcatatcgtaggcctggaggtagaggtttaagctcaagcggaggtcgaggtggcggttccatgattggcaggtcgagagtctcaccaggatctgcttcttccttgatgaagtcggggacctcatcttccagaagggccccgggagactcatgaggagaaactgcggtaacctcttccgctgactcaatttctgggagagggtcggtcaaggtgatccttgcccacgagaatggaattgagaattcattctctcctagagttattttgaggctacctaatcggggtgtgttgatgactagttgctcaatgggcagcccgattaggatatcaaagtcttggatttcaaagacatggaaatccaagatcgcctccctgtcttcaaagcagacaggcacatcttgcacaatcccaaatccttcgatgatatttccgttcggatgcttgaagaattgtttgtcggggtcactgccttattgcttaaataagcgaatgcaaaagactcagagacgaggttgaccccgacagttggactgtagagaataccgacatcgttcccttccagatggcaaggaatgattcagggagcggtatttatctgaattacttcggatgaaagctctgcctcctttagccattcgtcgctcattatggatgtcaactcccggacagtttctcgcaggaacccaacttctataggatcggaaggtgacaaaggaacgggtggtttcctcttgctaaagtagttcagggtattgccgtagtcttcgtcaaaaccatccctgaacattattgcggcacaatccggagtctgaatttcttcattcttgacggacggctgctcaggaaccttctcatcaatcgagctagcagaaatggatggttcagcaagtggctcaataattagaggttcctctatcctagacacggatgcctccggctggggttcattggactgcgtcatgaaggaagtgttttctaggatgcgatccaaaatcgtttttccttctgacggcgtcttgtgcatgaacgatcctccagcggttatgtccagatagaatgcagactcctaatccaaacccgtatgaaaatgctggagaagcacatactcgggtaaggaccgggttggtccggactgcactaaattagtgaatctagaccaagctgcaccgattgattcgttttcgatctgcttgaaactgagaatttttactcgaagggcggtaatacgggtgactgggaagaaggcaagacataatctgtctcgcagctttttccagctaccgtttacacatccaacggtagaggtgtaccattggtttgctctctcttgaagaggtccaccgcacagtttcttgtctcatgccacgaatcttaaggcatgagtagacttgttcaaagtctcgcagatgatagtagggattttctagatcaaagccagaaaaaggattttcccttaccatactaattagctcgagacgaatttcatagccagttgtataaatgggctccgattaaggaggtggctcatagaattcgccccgaggagcagacggctcaaccagaggttgctccatgatcgagaagagttgacaggaatacttctctaggatagcaggggtgaaggtagaataaaaaaatgaaaaaggatacgaggatgaactgggtttgaaaatgatcagcaaccgttccccggcaacggcgccagaaatgcttgttggtatttgatacggttacagataaaatccgcaagcgcacggatataccgatgtagcacttcccctacggagtattccaagggtatcgaatccaagggaacgtgtgtgatcagagcttcttccagttcacccaaggataccaagtaaatgataggccaggatagagaggatttactagtgagaaacagtgtctagggaaagcttaattttaatcctaacgtaatacttcaggaactggcaacccgttgttcctagatgtcgctctactacgtacccggacagggaggacttaagtgctctcgaggactgtcaccacctctacacccacctcaacgtattgtgggatacgcagcaattactgaataataattacctaaacatcacgtctatgcaattaatatctactttagtatttataactcaccaaagcaatcactatatttaagttgattatagcgaacaataatcccgtatgctaattaggaactaaccaagaggtaattctcacaagataaatctaaattactcaagaagaatattatattgaattcagggtaataaacagaataaaagaaataggagaagattaccgacaactccggaattcttccaactccttctactctactctcttcctattttagtatacaatatagtacaatagagcctgttataattcag

SEQ ID NO: 89663 - DNA, 742 bp, Oryza sativa
tatggcggattttctcttccacccccaagattcttccgggggattttgggtttcaataggattagtttgcatcacctaaacccgaactccatagttcacatcgccaacttcatacatgcctgcgaagcttttttgggcgtcaggccgcattttgccctattccgccgcatcttcttcctcaagccccaaccgaacaagagtaaaccatgtgttgttgggggggctggtttccaacttaggggaactttgagccaaaaatattttttcatgcccttcaaaacctcaaacaaaggctggcatgcaaactgttctatgtacaaaaccccgagcctgcactccccgagtactcctgtcttcctccagtttatcaggacacctggaactcacttccaatgggagaatcaggcgcttgccctaatggaccgtatgctgaaactgaaggagcaaggcctgcaaggagaacagatcacccggcattttatcaagagccggctagctccaattaaagagagatcccgtacggcctttgagtttgatggcaagcatgacccgaaccgtgaagatccagactctcttgattttaaggtcatgaaggagagaatgtacaaaatcttctcaaacgctatcatggtcagctattcgcatttgctaccagtggtgccatacaacgccttcaaccctcttccaccggtatgtattcaaacatttcagccttcctcaaaagtatgcttttatcttctgt

SEQ ID NO: 89664 - DNA, 5950 bp, Oryza sativa
cggcggctgtcgggctaccccctggccgacgcaggctcccccaatgcccttgatttcgtgctccgtggcatgggtcagggtggcggcggtggcagcgccgagcggtttttccgcgtcctcatcgacgagctctggtttgctagtgatttctactactctcccatctcgttgagctccttcagcggatggtgtgccgtgctcaaccacctcttctccgccctgatcgtcgtcggcgctgtcaccgtgggatggatctatcgcacgaagcaagtggtgattttcgacggctcgcaagcgttctactacatcgtcactgtcgtcctcctgctgtccgtcgtgttcatcgagatatgggagatcgtcgccgacgtgtgctccaactggaccaagatggccctgctcgcccactacatcaggcacgactcgccgtggcgccgattccgcttcgtccactcggcgctcgacgcggtgctgcggtggttcaggccggcgaggcggtggcgcgacaagatcgggcagaactcggtcctggagccacgccgtttccgcaagcgaaacgggtttctcgccgagaaattctacggccgcgccggcctcatggagtctgtcggggtctctttgatagtcatagaagcgatgtacaggtccttccggaacatttacggcctgcggacgaatgaactagcaagcagacgcaacagcgaatcggccagtcggcggcaacgccgacagggtgaggtattcttccctgagacggttccagttcgagttcgacaccgtcaccgacaagatcctcgcttggcacgttgcaactaggctcttcgagataactcacgcgcgtacttcaccggacaacaagatcgtcgcctgccatctgtcgtactactgcgcgtacctggtggcggccgtgccggagctgcttccggactgccctgcgtggacccaaaaacggtacaagaaggtggcgaccgacgtgcgcgcggtgctgggcagtcacggcatcgccggcggtagtacggcgtcggcgagcgacgcgcagctttcgcagctgggcgaccgcgacaaggtgctgcgggatggagtggcgatcgttgggcgcctggtggaggagttcgccgagggcgagggcgtggacgaggagttggcgtggcagttccttgcgaatttctggtcggagatggtgatctacgtggcgccgtcggagaacgtcaaggggcacgttgaggccatgggccgcggcggcgagttcgtcacgctcgtgtgggcgctgctcctgcacgccggcatcaccacaaggcctccggcgcaagcagtattataccgtagggaaactgtgtgaagagtctcttttcagttatacttacacaaattaaaacgagtatgtgtgagtgtgagcaaataatcgatctactagatctagatcgacttgtggttgagattattaattatgcatggggcatggagtgtgcgcgtacgtagtggttgccattgagtctagctagtattatggattgtgggatcgatggcacgatccaaattagttgtctccatacttttaagcatccattagtattgtaattttgttgagattctcaggaagaaaactcaggaaattgcggcccaattcttgtgttatctctctgttatcgaaaattgctatacgtacgacattttgagtacgatcttcgtacgatcaaatgggcggctaacgtggacttatggagcatgtcagtcttgtactcgttctgatgcatgtcatcgtcatcgccagcgccacgtagggcaagaggttggcggtgatggtggttgtgatgtgttcgatgccggcgccggaagtccaaaagtacaacaccagcacgatcgcggaagtccaaaagttcaaaggttaattagacccataccactgcaactttacgaaattgaaaaaataccactactattcgtcatatcggctatatgccgctggaaatttttaaaattggaaccattccacttccgtccctttttccgtgctctctctcacaccgtctccattcggtcctcatccccctccctcgacgtctcggacctcgcccacgcgctgtcacgcccagccatcgcggcgcccaaggatgtccaagccgtagccgcacttgccgccgcggcggacttcccgagtcggacaacgccaactcgatccaggtccgcctcgctgccgctgctgtggagatcgaggaggtccgggtgagccggatcgacggcggcgagggcagcgtcgacggcgagtggacatagcaggttggacttgacgacgagggagtcgcagaagctacacctacaataaaatggctacttagctcagtggctttgcacgctcgactacgtctcactctgcttccagagaacaggttctcaattatctcgcacccccccaccccacttcacccacccaacaaagaaaaagaaaataaataaatgaaaatgaattagagtgcttacttttcaggtcatcgaccaagtcttctgtctgtccatgcctatctgtcgatgaacacgcccaaatagtttccgggacacttattggggcattttacacttattggggctttgtttttctttattttgagatacataaacgtactcattggcttttcagttgtcttttaattcattgctagctgtatttaatatttataagattttgcgtgaaaattaggtgtaattattccaaataaaaagatttctaggattcagatttattttataccacaatatataagcattactactctgattctcttagcttctatcatatcaatgtttttagagccaatcaaatgcttcagaaggacatctaagaaatttaataatcaaatattgataactgaagtgactaatggaaaatttttggcccgagtagtacttactaaagagtaaactgtgatcacggtacataaacttgcacgatggatacaaataggaacaacaacttataaatcgtttctatacaattactagtccatgcgaacttgagccaaaacaatatacgcaagcaaaattgatttaacacggtgcgccttgataacatctttgcatgctagcggtttttttttcacaaaataaaatgtttgttttaaatacaatcagtactctagtagtgtaaagcaacctacaagatattgcaatgaaattattattgctgactgctatattctgcaaaactgaaattgatctagtgtgtgtatgtctgcacattgttctggtactacacatttgattaattttacacgtgtggattgttttagactaggttcgtacaggctagacaagttattgcatctgaatgggcatttgtcaagtttataccccctgagtgcaatttggtctttactaaacacataaaaatccctatattttgagaaagagggagtaggagccaataatgattggctaagataaataaatatgcggataaattgaataacagatgttgtgagattggctgagatgaggaggtaggtacaggagtggctatattttgagataaaaattaattatcaaaggtaccagctatatttgagaagaaaggagtataatacatagtacaagctatatttgaaataaatgatattctatgattatatacacactttttagcggatctattccgttctaatatttccaaattctaacctcttgccacataatttacaaggatatattttaatatatgtttttttttaaaaaaactttataacaaattccttcgtgagagagtacacaacatgtgtggtgctgcactaattgatgggtccatctgttgcttggccgtgtttcctgacatcaacctaaccatgtgtcggccgtccggcttgactccttccgagaagcttcactgtaataccaggcactccgccgcgtctagactcttgagaaggatgaaaagaagataacagaatgaaacaccacatttgcagcgatgagcgcgtatattcctctgctgctcctagatatttgttcaccacctgtgctaatagaccccgttcgtttctattaggaggtgttttagggctgttcactttcatgccattttcaaccttaccaaattttagtaaaattgtcaaaaaagtggctacatttagtttgctgccaaattttggtaactatataagaaatcatgccaaaagttaccaaaattttagcaactatgacattagatcggggtgtcacatcgggtattatatagggtgtcgtatggggtgtttgcgtactgataaaaaaactaattacagtatccgttagtaaaccgaaagataaatttattaagcctaattaatccgtcattagcacaggcttaaaagattcgtctcgcaaagtagtcgcaatatgtgcaattagtcattttttaagcctatatttaatactttatgcaggtgttcaaacgttcgatatgacatggcgtaaaattttaaggtgggatctaaaccggcacccttaggctgggttcattacttagaggttgggaacccatctccccgcatggaaaacagagcagtccattagcacgtgattaattaagtattagctattttttttcaaaaatggattaatttgatttttttaggcaactttcgtatataaacttttttttttttggaaaaaacgcaccgtttaccagtttgaaaagcgtgcgtgcggaaaacgagggaaatgggtggggaactagaaattccgaacacacccttagagcaagtataatagtaggctataagccggctaaatgctgatgtgaaggagggaagagaggagagagaggagaagcatgctgtaaacttacagccggcttggatacaagaaccaaaaaactctgtgagagagacaagtgggccatgtattaattgtaaagagctaactattatatgggtaggctcaaagaagactacaaataacgttatagccaacaagtcagctgtattattagccttgctcttagagcaagtttaatagtatagcccactactagctccaattcatctatagccaatctaatagccaattcatagaatagttgcttattatactattaatgtatggtcccacctgttatacacacattgtctcttggagtccgtgctgcagctgacaacagatctgtagtccgctgctcttctcttttgtcttttatctcattaaaatatatttgtagctagctaatagtctcctattgtacttgctcttagtacacttcctcgttatgggtgagcaactcactcgttttccattattacacttcctaacttgataaatcatatgttttgtgcaattattttttatataaaagtttcttaaaaatgaagttatgtttttactttattgtaattaactaatactccttccatcccagaatataagcgtttttggacttcaacgtagtctttgagatactactttgaccaacaatatttataaaaataagatatttaaataaaaatgggtgcatattatgatagttttttcaatgataaatctagcaacatcaattttacattattgatattttttattttttatattaatagtcaaagttcaaaatgtttgacttgacacttgttgacgaaaaatatgcgctcggccgatggtgctaggtctgtgttggcgcgaactaaattgacgaacacaacggccgaggagatctgcttagctccagtgcaggtctaaaggttgatgagatgcgggcgtgccagtcagtttgatcctgtaactgaaagatatactaatagcagatcaatgagccgatcggctgacaagccgatgaagtaattccagccgatgccgataccagctgatagcgatattggccaatcgactatatatggttgatgtagaatatgacacttgatataaataaactaataaagacaatcgactgatgataatataacaaaacaacaaatacaatccagtagaaacc

SEQ ID NO: 89665 - DNA, 1567 bp, Oryza sativa
cggcgcggagggtccggccgccatcaatggcgccggcgagatttgcgggggcaaatccgcccgtttgaacgcgagagagagagggaaaatggggggaaagggagagggaatcacggggaatgattccccccactttattgcacgcggggacggcgggatgcggcggaatccgcggcggcggcggcgctagggcgcgggggaggcggcgggagcggcgggaggaaggggatgacgggtgggccccacccgtcagcgagggtggcgggcgggcccgcccgtcagcggcgcgcgcgcggggagaggccggatgggccgcggggaagaggagagagggggagggagatgggccggaccggcccaagggagggaaggaggactttttagggtttttctttttataaaacctttttaactttgtttatttcttaacaattattatttgtgctctgaaaattccactaaaatttatttacgcattttaggcttttaggaaatatacaaaaatcctccaagccttatttgacttttaactttgcacattttaattgttggaggctttcacacggattttaattattctaggcttaatttcggggatgtattttagagtcgttttgggacgcgacaagaactgatggagcgcatgataaagctgaaagagcaaggcttgcaaggagaacaaatcactcggcacttcataaaaagtcggttagctccaatcaaagaaagatcccgcatagcttttgaatttgacggcaaacacgatccaaattgtgaagatccggactctcttaactttagggtcatgaagaaaaggatgtacatgatattctcaaatgctatcgtcgccagctattcgcacttgctgccagtcgtgccattcaatgcctttaatcctcctccaccggtaagtaatcaaacacttcaacttttcacaaaatacggtcttatctgtttgttgaatcagttaacaataaaagatatcacgcccaggaatttgctttgatgaagtcggatcccccaatcgctcaacaccaatcacctcaccgccaaactggtcagggaagcggaggaccaagaattcggtctgaaacccaaccaagtgcttctgatccagttggccagtcagattctcgcaagaggaagctggttttaagtgacgacgaaggcgataataccggaaaggagcgaccggaagacctccgaagccaactaatacgaagaagaaaaacaccagtcgtcctgtaccaaaaatcagaaagtcttccaggtacaaatcaaataacaaccttccttgtattaatattctcccatcatgaagataacaccgatggcaaaacttgtaggaaaccatccgacatagatccttctgagaaagactctgacccgactaacatggaagcagactcctcaaaagaaaccgggccgactgcaaaagataccccgagtaataatccgctggccagcgacaatgtaaaacccagcaacgaacacacgaccgcaagccagtcggccgaagctagagtcggagttaaccaggagcccccgactggaaaccagtcggatg

SEQ ID NO: 89666 - DNA, 2303 bp, Oryza sativa
tgaaaaaggcgctcagccaagccacccgcattataaatgtaagctctttggcgcctgatctcaaccatctcgtttgccatttagtccaggcgctaattaaactgtcttgcagaggattcatcttaggaacgaagctaaaacggcaaccttagagaggttagtccctcatctcgggaccctcgaagccaccaggaatcagctgcacgagacaaaagagcttgccaggaagaatgaacatgatctgagggatcggattgctgagctccaggaatccaattttgaactgagcccaactaacttatgttgttatctttgtaatcttgattaaccagagtcaatgtagtgcaagctgccaagatatctcaactagagaagcaaattcaaactctggaaaatgataaggcagaactagcaaaacagagggactcatctttaaaggaggttgaaggtaccaaataatcagtacctcaaaagccattatcttctatatgctgattcgttaatgtgaatctattgatgcagaccgcaagatcaagtcccaggcacagtttgatgtcttagtcgacaagatcaataggcttgaaggggccagggacaaagtcgctaatgccgctactccactcatccaagccatgttcttcaataacgccggtccgagtacacttgatgttgccgaaatcttcgacaagctgagagtcgctccggatacttacttcaagaacatcaaagaagttggaagtatgggagcaagtctggcattggcgatgaccaaatccctttatccaagagttgacattgatgccattgatggctttgcagatgggatgagcgaagaagctgctcttgacctcatcaatgatgcgcaaaaagccgctgacaagattgctgctgacgtggttgagagattccaagatgtcgaccttcggccgactgggtctgataattctgatgatgaaaaaactgatactgattgatataacaatgattttgatgattaatgatgatggaggctcaatttgtacaatactgatgaatttatgccatgcttggtgttccatacttagcttttgatttcttaaaagcctttgtcaagccttattgagcctaaaacccgcaaaagctattaaaaaccttcagtcctcattgactaagtcgaaagaccaaacagggcaatgataaatcaagtaagcaaattgaattgataaaaatcacactccattattatcatagtagccccccgactgaaaacttcaaggaaaaacttgaagttagcagtcaaagaggaaagatacaaacgaaatgcctaagcataaaatcgacgaagatgttcaatattccaagaattattgatgagagtaccatcttcgcgcttgaggcgataagaacctggccgagtgacttcagcaattatgaacggtccttcccataagggagataatttatgccgatcctgtgtggtttgaattttcctcagaaccaggtcgccgactaaaaaggctcgcgatcgaacattccgattatgataacggtccaacccttgcaaataccgagtcgactaaattaaagctgcttcacgggcttcttctagtcgattgatgtcgtctactcggccctcttcataacactcctcgttgaagttccgaaatcgtagtgattcaaattccacttcacttggcaacattgcttctgcaccataaaccaaaaagaacggcgactggccggtagcccgactgggagtagtgcgtaaagaccaaagtacggatggcagctgatctacccacttgccagcatagggacgtagtcggtcgaaaactcgtgcttttatcccttgaagtaccatgccattggcgcgctcaacttgtccattactcatggggtgtgccacagaggcataacaaattttaatgccaaagtcttcacagaagtctttaaatgctccgccagtgaattgagtgccattatcagtgatgatccgattaggaaccccaaaccgatgcacaatgttgatgaaaaaatctctagctttatctgctgtgatcgtgatgaccggtctagcctcaatccacttggagaatttgtcgatagccacaaagagatgcgtgtaaccgcctactgcccttttaaacgggccgaccatgtcaagcccccagaccgcaaacggccaggacaacgggatagtttgcaactcttgggttggcagatgaatttgtctggcaaaaaattgacaaccttcgcatgtccacacaatcttgtcagcatcagacacagctgtaggccagaaaaaaccttgccggtaagctttg

SEQ ID NO: 89667 - DNA, 683 bp, Oryza sativa
agtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtagctggggagtccatgcctctggtttttgagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgtttaaaaactcttaactctttgctaaatgctgcttttgcaaatgagcctatattatgccatcctttggaatgggtaccgagctcgaattcgccctatag

SEQ ID NO: 89668 - DNA, 3287 bp, Oryza sativa
tgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaacatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggtcccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggctgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacatacgccacgcaatcgacgtgatgcacctcactaagaacctttgcgtaaaccttcttggcttcctaggtgtatacggaaagtcgaaagatacactggaagcacgtaatgatctggagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctactagttgtaataaggggtatccttccagacaatgtccgggcaacaataacaaagctatgtgcattcatgaacgcaatttcgcagaaggtcttcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattaatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgacaatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtttttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcccccccctttcacggtgacgattgaccataacatcctcctatcaaatgaagacaccccttactcacgcagcgatcacaagggggat

SEQ ID NO: 89669 - DNA, 713 bp, Oryza sativa
aagttggttagcggaattgtatatggcaagaattgtgtgtttgcatggcgttcctaagaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcatataacaacagttatcaagctagtcttccgatggctccttacgaagcactatatggtcggaagtgccgcactccgcttttgagggatcaaacgggagaacgtcaggttttcgggacggatatcctaagggaagcagaagaaaaggtaaaggtcattcaagaaagattgcgagtggttcagtctcgacataagagttatgccgacaatcgccgcagagatttgagttttgaagaaggagattatgtgtatcttcgtgtcacgcctcttcgaggagttcatcgttttcataccaaaggaaaattggcaccgcgttttgtgggaccttataagattgtcagtagaagaggagaggttgcttatcaattggaattacctcaatctttggcaggagtccataatgtgttccatgtttcccaattgaaaaagtgtttaggggtac

SEQ ID NO: 89670 - DNA, 3807 bp, Oryza sativa
tatgttgcacggcgctagaactcttccggcgactagaggcaaaagcgagaaaggcgccgggtagaggagacaccggggaaccttttaaaggggctcggaggcgaccgcgaaggcccccggtggctggcgacgagaaggaaggtttagggttcggaggaaagagacgaatccgattcgaactcgaatcaaacgatttccaaaaagaattagccgatgattccaaaagagaaaaggtagatgagatcccggagattgtttcccctctatcaattcggccggataaggaaaggatcgaccgaatttggaaaggaacggcggcggcgcgaaactagggtttcgggcggcggcagccggaggtagacgacgaccctgacaggtgggccccacctgtcagcgggcggacgcgcgcgcgcgcggcggcggactgggccgacttgggccgaggagagagagagcggttttgggccgactttcggcccaaagccaaaagaagacttttaaaacctttttcaatttaaattattttttaaatgcaattccatttattaaaaaggttttaaaagtcttcttttggcttttgcaattccatttattaaaaatacttccttagctcaaataaatcccagaaaaatctaggaattatagaattaagcaaagtatttaatgaaattttatctggcccctttttatattgaaatttattaattataattagatcttctcttctaggcttttaaaataaattctaaaaattccatttaaacaacaatttatatattttgaattttcagggtgtgacacaaccctaagaggagaagggggcgaaacacagactagactgtaacgacgctgggagatcacctcctgccgatcagtcttctgatgatttcgccaaaagcgagccatatcctccaaacattttgtatgaacaagatcgtagtcttctaaggttcgcccggggtccgcctgtagccagccggcaaccttaaaaaccttatagctgtggccgtttatcaccatttcgcgataaacaggccgaaacgggcatcgcacctttggcagaattttaacgccaaaaatttctcgtttttgcttcgccaatccctagaggggggccgaaggcacaatattcggcaaacaccctgttaaatagtgcagaaagggcaaaagatgaattgtatagtaagaatgggcaaaacaagatcaaatattacataatacgaaaatgacgtaatcatatacgccaaaggcatcgaccataaaaagtggcaaagatagagtcatacattccaaatatccaaaggtcctttttcggctacaataaggagagtaaggggccgaatatacattgttcgcctttcccggcaaacgcaaaaagaagaaaattttcaaaaatctaaggaaaggacggagggcctcacacctctgggtgatcctaggcatcgcctccaacccctccggccgctgcatcctcttcttcgcaccggtctgccgcctctgcctctgccagttgctccaaaaggcgtgtcttggcggtggatccgccgtccttctgccagaactgttttcgccacgcacgaagcgcgggcgaaacgtcctgcgcactaacctcccagtcccttttcgcatagttagggaactcggcgacgtgctcacagccgaactgctgcagaaggcccatagtgaaggctgccgatacatgcgcacagcaatcaccgtacgcagtggcgcagtccgaaacggcaccactagcctgctggtctactccgagaagtcgaaggctgaggcgtcttcggcagggactcctcgcacctttacacccatgtccgaaagggcaaggcggagcgtttggcatactgttcttgcgaatcggggctttcccatctcccgcgaaactgttgcgactccttcgcagcgctcgcctcggccttgctgacctccaggcgaagagcctccatcttcggctcagtaaggttgtaataatcggtcagcgcagcagaatgggctttttctttcttcaattcggccttgaggcgatcaacctcagctcgggcctctttccccttctccaattcggccttgaggcaatcgacctcggccctagcctcttttcccttctccaattcggtttggagccgcttgttctcggccttcgcctccttgagggtgttggcgagggcctccatctccaagctcttgcggcctatttcgtcatctttggcctgaagacggttcctaaatccgtcaagacgagcccgcacggttcgctctgtcgaacaataggccgcaagaatctgaatgcaagataagagcggacgaagagaacaaatgttaattatgggacctgtaaaaaagaaggggaggaaaataaaaaagagagcgaaaaagcatacccgaaccaacaagcttttaatagtggaacacccttcatcgaactcattcaactcggtgaataggctcagggtgctggcaggtaagacaagattgcttactccctcgacgaagggaataagatccgcacgggtctcgaaatcgccaggggcgaagtggggcgccgcgagagagtactccgaggcagatgtttcgatggccgccaccttacccttgccttgacaagcggcgaaacaaccggctgacgtagagggcttccgaaaaccctcgccgcagccgtcacgatccgatcggcggacgctgaggccccggcggcggcagtaccacccgctccaccagcattgagcggaataatgggggcggtcgaaaggtctaagttgcggccagcgagcgaagtcggggcttcgtcagaagactcgtcgtcgctgaaaatgcgagcaacatcgaccatcgacgagtcctttcttttttgagatctttttaaccggacctccattcgccgccttacctgctgaaaacgcaaccaacaccttcgcccgctccaaatcctttcgatgaaggggggagctgttcgattccaccccagtctcgttgtgccctagacttggagtaggagtgtagccagggtctcgacgcggttttcgaccgcctcgtccctgcccttttcggccgcgacctccgccgtcatgctcttcgacgtcgtccttgtcgtcagtgtcagaatcagaggaagcagggacccttcgcttcctaggggccagcttcacttgtccgtgcgtccgctttcgcgaaggccctacatcgtcgtcggccttgtgggggtccgcccggggaagcaattcgccgttgtaaacccggttcgcctgggcggcagcctgtcatgtaagaagctggctatactcgacaaccaacacgttgccaatcatcttacgagcttcggcgtcagcctagtcgagagtcaacactgcgaaaataaagggtgtagccatattaagcatcgaacaatgaaaaataacgaagcgcaggagtgcatagtgaaagtgcagtcttaccgttcgtcccctaaggaagaaccaacttcggcaaaccattgacctcttcgccttggtcaaatgcgacttgacatgactgggagaggggaaagatgcgaagcatgcagaactcctccaccaagtcgcgacaactaagtcgggagcaaaccttacgcagcagggcgaaccgcgcctccatagcgccgtccacggcaatcttgggtttccggttcggtgcaattgacctacgctagcaccggagggccttcgccgactcggaactagccttaaaggggatggtgtggtaaaaccacctcgccatccaatggcggtcccactttgacatggcggcattcaccggccagagatcggagcgctcggggcg

SEQ ID NO: 89671 - DNA, 1890 bp, Oryza sativa
ttttgaaagtgtctctacgctataaaactcctgatcttagaggcaatttgccgaattctctacaaaagtgtctttatataatgtttttgttgtagtggcaataatgacgatagacaataatttattccgtaaagcccatttcacggttctgcaacaatcttcattggtggctccttacatcgaggagcacttggctctaattcgcgccagaaacatcggtaagttcgatgcatggattacacggcatcacattgatactttccccacgtggctatgacaacatctcatgggtaacgagacgattaaccaagaactggccttcctggcgaggggaccatctggctcgatcgcgacattccagggatatgagatcaataggtacacattgtacacgagagcccaagacatgaagagcacgaaccaaaatagcgttgttcgtatcgatgccatgggacacgatggaacaactggcacgtattacggtgtcatcgaggatatatgggaacttgactatggtcctctcaaggtccctctgttccggtgccaatgggttaggttgactggtggaggcgtaacgattgatgacagtgggatgacaacggttgaccttaacatggttggatactcggacgaaccttttgtccttgccaatgatgtaacgcaagtcttttacgtgaaggacatgtctagcaaaggaaagaagggcaaagggcctgacgagccgaagcgccacgtggttctcccaggcaaaagaaaaatagtcggagtagaggacaagactgacgagaattacgatcagttggatgggcaaccccctttcacggtgacgattgaccctagcatcctcctatcaaatgaagacaccccttactcacgtagagataacaaggaaggaacaatagtgaggagaaagtatgtgcggtcaaccgtcaccgctgatgtattgccgtaattattgtgtacacaatgtaaactattttggatgtattgaatatccatataaatcaattgttgtatggcatatgataattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtacttcaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactccc

SEQ ID NO: 89672 - DNA, 1011 bp, Oryza sativa
cagctgtgtggtggccattgatcgacgtgaagatacagggtgccgccgataaggataggtgggtgctgatagtgatagcccatctaccacgtggctgcatgctgatcttattggtgtatgcacagtgcatgggtaccacagttgcaatcagtgttccttcctctcgaaaagaaaaacggttttgctattttgagccacctacacctacgtaatacttactccccctattttttttatatgactttgggacaagctagaaagacagccttgcattcgcgcgaacatgtgttatgtgttacagactttgtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagct

SEQ ID NO: 89673 - DNA, 1157 bp, Oryza sativa
agatcatcctgaaaaaaacaaacagtgaactcatgactcacacagctcatatactattgttcaaacacaatagatcacaatgcgagttcagaattaatattcgggacactggacgagttcagaattaaattgatgtcctacggatggtcaatgatcagatcagtgctttcagccttcagctcaggaaagacataccataaaaaccctgaacgtgggatagcgggtagccgcgtcctacggacgccggcggcggcggcaatgccctccctgacaatttgacagcgccctacagcggggaacaccgatctcaacgccatcgtcggcaggagaaaactccgcagcggcccgattccagcaagggcacacgtcgacgaaggccgcggcagcagcaggccttgccaccgctgccgaacgggtccggcccgaggagaaattgcgtgtggccggcctacctcctactgggccagttgtggaggaattttcgtcccgtctagacgggccatttgttttgaaggctagtaatgggccaaattggacaggaggtcctgaaatcaggaattcagaagagctctccactctttccctcgtcatgaaaaggaataagttcactttgggtccctctatttgtcgaccagtccgattttcatcccttgactgcaaaaccgggtatgacccgtccccaacttacgaaaaccgggcacataaggtcctaaggcggtttagatagtggttttggctgacgtggcgcctacatggcagatttgactaggtctccatcccacgtgacattgacgtggcgcttacgtggcaattatatctcagaaaaataataaaaagcgtggcctcacatgtcagctgcacaaaaaaataatttaaaaatggtgggacccatgtgggtccacatgtcagctacacagcaaaataaatatggtgggtcacacgtgggccccacatgtcatcccatctatgctctcggctcactcccatcttccctatcggaaccacaacgcgcaccaacaagaggacgcccccagcaccgtcgccgccgatgcgcatgggaactccccaccggcttcatccctattcctcgcgggcttggcagttgatgccgcgggagcggcggcggagccttcctcctcgtgatcacgtccgtgagc

SEQ ID NO: 89674 - DNA, 2435 bp, Oryza sativa
aattctttttaaacccggtaagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatttatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattggcacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaatttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcactgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatagacccagacagtcccctcgccaggaaggcaagttgttggttgatcgactcgtaacccatgagatgttgtcgtagccacgcgggaaaagtatcaatgtgatgccgtgtaatccatgcatcggacttaccgatgttcttggcgcgaactagagccaagtgctccccgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctttgccttgctaagagtgtagctggctggactcaagtaatggcttcctttctcctttggttccgggtgaa

SEQ ID NO: 89675 - DNA, 929 bp, Oryza sativa
ttgaaaaaaaacatatgtgagaacctaattgggacaattctcaatataaagggcaagacaaaagacacagctaaagctaggtttgatttgaaagatttgggtattaaaaaggtgctgcaatttagagaggatggagagatgcctcatgctagatataccttgtctactgaacagaagaaggctttttgtgcttttttacaagaggtcaagtttccagatggatttgcttccaacatctcaagatgtttaaatgctgagggaacaacggtacaggggctggaaacacatgattgtcacattcttttgcaaagaattttgcccgctgccatgagaggatttctggacattgatatttatgaagcaatagctgagttggggatgttttttaggaaattgtgcagcagaactcttaacaaggatgtgctggttcaaatgaagaaagaaatccctataattttggtgaagcttgagaaaattttccctccagctttctttgatgtgatggtacaccttgctatacatttacctgatgaggcattgctcaggggtcctatgcaatatgggtggatgtacccaattgaaaggcgactatatactttgaagcgatatgtgaggaataggtcacgaccagaaggttcaattgccgaggcttatattgctgatgagtgtctgacattttgctctaaatacatggacgatgttgaaacaagatttaatcgggagccaagaaataaaggtttctccaatgaagaagcttatggtgttgatgtttttgggcatggagttaattttacttctgcacctgaatatgtatatgatgaaaatggcattgatcaaatggtgtggtttgtgctaaacaactgtgcccaagttgagtattacgtcaagtatgttctatatacttacttttagacttcttctatatgcta

SEQ ID NO: 89676 - DNA, 993 bp, Oryza sativa
ggtcttaggtacacgtcgatgtcgttaccaggttgcttggggccttgaataataatcggcatcattatgtacttcctcttcatgcatagccagggggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcagacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttccttctcgcccgtttgatttccttcaaatccaacatactgagcaaagtccggaatattgtcgtcttccacttcatcttcttccatttcaacaccttgctctccgggggatgtccaacaat

SEQ ID NO: 89677 - DNA, 5754 bp, Oryza sativa
ccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcacagtctgggccgtagaaacattatatggacttaaacaaggagaattatgtaacatgaagaaatagtagtacaatttgaacatgatacgactattttcattgcggttacatagatgatattagattcgaactaggagggaggtagtgcaatagttgaacacaacgacgatgtagtaatgggacaaggaagcatgatagtagaaatttcaataagccaagttgtccgataatagctaactcctacgtgaggatccctctcctctctcaaaccgcgctttagtaaccctttattgctctggtagttcaagctgcacaacacggctaggtggagttagaacccttctggtgtatatccattctctgtattgacatctccttggtggttcctgggaggaaagaatagatgtaaagcaagcaaagttagtaaatattgtgagaaaataaggattcatgtaatcaaaatattcttaccatgaaatcgtcgtcaagaatatttggacaaacaaagaaccttcgacccaatgttgtaggatttatggagcgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaaacgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctatgccagtttggatcctcaacaccccggcgtctagccattgacgaaagccggtcggatttgtaatgaagcaagaggggaagagagtactgattgtgactgagttctgaaagattgtgaggcctcactcgttaaggaaacttatataggcgcaaaaaatcgagtgatacccctgacatgtgaacgtggtggggtatggtgggtacgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaagagaagattgctctactggccctgccccgcgccgcgaccacgcttggtcctccgggcctgtgctcgcacgtggtcctgggagtaggtgaaacgatccggtggcatagcacgggtagcacgagtgtcccgcggaggagtggcctgcgcctggtcctgcgtctgcaccggcggtgcgcctcccagctgtgaggggccaatgacgtcctctgtcgagcctgaagcgaagtcgaagtcagtgatgtcaaagagcaaggtggaaggcagcaagcggttcgacgaggtcctagcatagtccagtggtggaccctgactcgacgtgccggctgcctgtgacgaagtcccggtgtactgccagaactgcgctgagtgcgaggtcgacacagctacctgagacgctgaccctgcagcctgggagaagtgggcggcctgcgtcatagcgaactgggcgaaacctacacatcgacaaatgggacctttgtaagctaagacataaaatgtatgtaaattgattgtcgaagtaatgttgtttttttaagtacctgtggggggcacaacagaaggcctagccgaggaaggcggggtgctgaacggtgtacgaaaccctgaagcaatcggcaagtgaaacggctcacttatatgtgcgaggcatgtacagaaatagtaataaaaatacttacctccgtgtggagggggagtcggcctaggaacgtgcgcagctggacggggaccagtcggtatggttggccgctgtacagctgcgtctgctcgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaacgacgacccggttgatgtcgtcgacctgcatggttaatttattcgtaaatattcgtaaaatttgacgaagagaaagacatgaaaacataaaggaatggtgcgatgcagggtactcacagcacgagcgaagtcctggtcgcggtgcctggcatagaggtctctagtgctcgcaacgtggggctgctgctccaagggagcgaaggtgaccctagtacaggtgcgtggctagtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcatattttaatgcaacaacggaaagcgtagtgcaagatcttaccggtgaacagcagctgggatggtggtcggaaacggtactggaaagggctgacggaagccgaactgccgcatcacgcggaaaggggcgtgaggctcaacgcagatgtcgaagaccatcggaaccgtagtcatccagtacacctggtccctggtgcagagtgtggacagacccaacggcgcacgagcctgggtagccgctgcactgtagggctcccacacgatgtcagtcggcagaaggcggtcgaactccataacaaactcaggatacgaccgcctaacctggacgtgagcccatcggcgctgcaatacgagacgatcgatgtgatgtacaatgaacttagcaattagcttaacaatacgataagatcgatgcaacgtacctgacgacggcaccacagagtacccatcgtagggtaatcgacctctggtcgctcctcgtaggtgtgcccatgtaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttattttgacatagtatctcaaacctgtgctgttgggtaccttgcactacagctcgatgtttcatggcctttttacgcaactcctctagctttttctgcatgaaagctccaaacaaaatgctgttgttcagcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaatccagtttttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctctttgttcttgaattgcttgaagaaattagctcccatatgacgcatgcaccacctactctgtacatcttcccaaacaccggggtatcctcgttccatactcccaaattgcaactcttctatcgctcgcagaatgccagcgtacctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctggccccgatactttcctgtcaagaatgtcccatcaatgcagagaacagaacgacagttcacgaatgccatcttgcatgcatgtagagctaagaacgccctttgtagcacactcttgctaggatgttcaattgaggggaatttcttcacttcgtaagagctcccatggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccccgaataacctcattttctttgtactcccatctcacactatcctcttcagagacgatcagcccagaaaaatcctcactagcccattctgctggattaatatccgtctcatcatctgacgaatcaccttcctctacacgctcgttatcagaatcctccctctccatttcatccacaatggcaccgacagtctccccctcgtcggacactccacctggttgattgccaactggagctactacgcccccgtcctctcgtgcgttgacctcctccacagaagtctcgtttaccttagcacttggtccctcgccatcatccatgttcatctgcacacctggatc

SEQ ID NO: 89678 - DNA, 4234 bp, Oryza sativa
aaaacgaattgcaaatgcactggataatattttgtcgagaaaatttcgtagccaaactgaccaaaagtgtcgcgcttggaattcagtcgaacagaagcaccagtatgatcgataattgtgctctctgcactgctgcctcaatagatttcgtagtaaatcctttatttctatttatctatgaatgcatatatatatagtataaattgaacttcataacaattaacaagaacccagccctggtgtgccaggttctttatcctgcatccatactagttactgctgtctagtagtactattttttagcgaaattagactacagttgtttttacaaaattagatgcaacataactctatctactagcaacaaatgggtcagattctatcaaacagacaaatgtaggccctatttagatcccaccacaaaactttatacctgtcacatcgaacgattaaacacatgtatgaagtattaaatataggctacagaataactaatagtacagattacgactaatttgcgagacgaatcttttaagcctaattgctccatgatttgacaatatggtgctacagtaaacatttgctaatgacgaattaattaggcataataaattcatctcgaggtttactaactgattctgtaattagttattttattagtacccgaacaccacatacgacaacctatataatacacacgccaaaactttacccctaaatctaaacaacccggtagatgaaaggagaattttatttcagttggtacgtgccaattaagtggcagagtttgaataagctcactggtggagaaaccatttgtagtcccggttcgtaaccccctttagtcgcagttttcaaaccgggactaccaatccaggactaaagatcgctatctttagtcccgggtaaaataaccgggactaaagattgatctttagtcccagttggtaacaccaaccgggactaacgatggctcagccacgtggactaaagatcgagctgaccttttttttatttgcatggccctgttgctgcatgggttatatatatatatatatatatatatatatatatatatatatatatatatatatatatatatatatatatatatatatacactagctatatatatatatatatatatatatatatatatgtatgtatatatatatatatatatatatgtatgtatatatagatatattatatttatatatgtttcaatacatatacatgcataatatatttgtatttatacatatatatatgttatgcaaatgcatatgtatatatatattaaagcgcttaacattttatgtgcatatatatatgaccaaaatatatatttacactaaagtaaatgtgtacatgcatatagaaaaatagacatgtattaattacaattcattatgatgtccgagctagctacgacttcgacgtagtagtaggcgttatctcagaagctaacgacctatgaattgtatttctctcgggatcaaggatttgttcgttgatgaatcccatgagttgttcttgaaccgccgcgataaattacttgtgtgtgaggttatccctcatgcgaataacctatatgaattaattagtcaacaacaaatcgatacgtacccaatgaaattttgaatttatttgtatgtacatcgagctctcttgtggtgatgatttggtatgcaaggcagtagcaatactcgcacacgtagtagccgcacaagttagttccctgggcttgcttttgcgcactatatatatatgacaaacggcgagagatctaattaatatacacttgtatgtatttgaattggagattcaatataaatgtagagcaggtgtactcacaggaaatttaaactttcgcctaagtctttctctccaattgccgcggaccaaacgacggaaccgataccaagccctacatggagtttaaagctatgattcgtagtagcaattaattataacaagattcgtaattaacattgaacttatgacagtacctgtctataagttcaaaaaccttgtcaaacgtagactcttttttatccattgagtcatatacgttaactacgcaggcctccaagtcgaagagtaaaaggacccagtggaatgtgcaatgtgcgtcggatgcattacatatgaaacacttagcttgttcgtacgggaatgaaatttggtaggaagacagtaaaaactaactctgtgttgtatggcaatagtatgaacatcttgtaatgctgcgccttcaggagatggacgagattgtcctctgtggcttgcggatactggtcgagcattgtgatgtttactttccgagggtcgatgaatccagtatcgaaaaccccccaccgtcgggccctttgaatctccattctacaacgataaaaggaagtatatattatatatggtgtacttatatacaaggacctaattaattattaaagaaaacgtaataagaaatctaactgaacgatacttacaaagtccaacaactcataatagagacatcgagggcgtccagctggtatagttcgtagatacccttgaaattgatccagagaatatcttctccttgcaagaagtccgtgtccctgatcatcgctccgatcatctctctaccggtggcgcttatctccatgtacagttgatggaatttgtacatttgtgtcggtagggactgcagctgcttaggcttgacaagcggtttactgagttcgtacatgtatttcacttccaccttttcgattggcgcgcctcgtagcaattgatccgtagttaacctggtgtcattaataaaatcttgtattccaaattcttcaccggtcaccaacggctcgatctcctggtttggttgctctccaagctgagggactggtttggactttccagaagatgctttcttaagtgttcgctcatagtccgccgatagctttatggcctccttggcaggtgcagacatacccctgaagaagttcctgacactcgggtctataggaatcttcttttctgaacttcgaggcttcaattgtctccttacttctgatgccacataagcatcaggctcctcttgcgtgcaatcgtaccccgggtccttgtttttggcggcgtcaactttcgccttcttcgttgcccttgtgggggcaggcggtggagcttggggggcccttgacttggaaggtgccagacgaggagcttgcggaggagtcggtgcaggagcctgaggaggagtcggtgcaggagcctgaggtggagacggtgctggagcatgaggagaagacggtgcaaaagcctgaggaggagatagtgcacgagacgccggtagtcacccagggaggatgatgtaccgcttgcgccatagtataatggtgtggcttgtgtctcgtagatgcgtctcaccgtctcctacagggtagtccaactcgaggtcctcgtacgtggctttcaccaactcaacttcgaccttggagtattctgctggaatcggcctgcagtgttaagtccctgaagggtccgttgggatggccatgcctgacgccaccttcacgtggtgagaggttatttattcgtaatcaacatatatcagcagcaatttgcggaatggacaagtctaaaatctataaactacgaacttacctttattgataagttcttgaagggaatatgcagctcacatggtgtccgctgagtgatgtcatcaacggggcaggtggtttcgtcctgggtttgcatggtgtccatgctatgtgatcctacctgccccgttgaggcgcagctgcttcgattgcctgaagggctgaccattgcaggagaaatgtacggctggggatcctgggactgatgtgcggccatgcgttcatccaccttccttgccacctcctcttgcatgctgagctcgtagctcgataccctttactcaagatctgcaatcttcgcctcggtatctctcttgctcctcatccaactcctgtacgtctggatgccctccttgaatccaatcttctaaggaatcgcccctttccctcgtgttcgtcctggatgctcgggagtcttcagggcgagtgacagctcgtccttctctctgttgggtcggaacgtgccctgagaagaggcttccactgcgtccgttagtcgactcgcagcctcgcgtatctgatcgctgaagactagggagccatcaactaggttgagcgttccaccatgagcatagtaccagaacttcgat

SEQ ID NO: 89679 - DNA, 1269 bp, Oryza sativa
  unsure (1)..(1269): unsure at all n locations
ggagccnatttgaanatcgatatgcagctcganacccncacgccgttnccttgcaccgcccgtttncggcgagctccggccgcccgccactcgtggtacaaccaacgtctggccaatccgacaccaccatcggcttcgcggacccgtgccacagcccggcctatactccatttcccctctccgcctcgggaacaccgccgcctcgtgcaccactgcctaccacctccggccgcctctagccgccatcctcaaccacctcaagccacgccactgcctcggttagatccaccaccgcaagggcaagcccggccgcccatccttttttcccctccaccaccagaaccacctccccaccacgccaccctaccggccatttttttttccgtctccggtcgccgttcgccatcaccccagctgccgccgcgacgcgccggccgcatcgcctccttcgccgcgtcccgctcttccccgtccgccgcccggtcgccgccttccgcacgctcggtgagcccctcctcccactccccttccctttcgcgtgcatcgccactgcccgtgagcgccgccgtcttccgcctactcgccgccgtttggcgccgccggctgctgcctccggaggccgcacgctgccccgcaccatggctcggccgagccggtttcatgccgtgcccgtgccccagccgcgccgcctcgtggccatctgatcggctttgggccaatccgggccgtcggttcccgtggaccggcggtggaccgcctcggtggtcccggtccacggtggatcgacgcccttgtgtcgctgaccggtggggcctgcttgccggcgccgcccctcccccttgatgacgtcagcacagccttttcctttgagaaaataagtaataattgcgcaataattcgtgaataattctagaaattcatataaatggctcaaaacttctaaaattcatatctaattcattcgaactccgaattgagccattcaacttgcaaaattcatttaaaattgagctctacatgtttgtttagtttttatgtactgtttccttggtttttattagagttttcctcgttttgcgcgccagcgtgtagaatccgttgtttcggaagttcgcgttcgcaaggataagagttcagaagatccaagtgaagaagcaaggcaagtcacacattccccttgagcatgttgatcccaatttataaatgttttaccgtttacaaataaatatgcatgttttgctaattacatgggatccgggtattacctat

SEQ ID NO: 89680 - DNA, 646 bp, Oryza sativa
cccggacattatctggaaggataccccttattacaactggtagcagttgtgtcatcaacacgtgacagtcatgagactttaggtttgggaacttcttatccttcgggcttattattcgctttatattcgcggagtattcagacggtaccttgatgctctccaagcattcaaacatactttccttctctgccttgctaagagtgtaactggctggactgaagtaatggcttcctttctcctttggttccggatgaaggtcgccgcgttgttccatacacttgagatcattacgtgcttacagggtatctttccactttccatatacacctaggaagccaaaatggtttacagaacggttcttaggggggagcctcagctagatagcctggtggacatccaagtattcaccaaaaggatgttgacaaaatttacaccttcttttacacatctgcgaaggaccaactttggaaccaatgggcgaattccagggccttctcccactgcttgtccacaaagtttacgccctcccaacgcgttttcaccgttgtatgtttaacctcccaaacatatggccccctttcggccacaatgctatgctatctcctccaccctggacttttgcgttactgttagactacatagacct

SEQ ID NO: 89681 - DNA, 872 bp, Oryza sativa
aatagaaacaattgcctttccaggtctctatccacgtggggcaatcatcttgaagcatatcaactcaaacccaatgttggatacgagtcatattgctggaatcggctgtatcacctaacccagtctgattcagatttagccgattctagtcgtagccgatctggactccagccgattcttactctgttcccgcaacaatccttatctctggttccgcttcgatcccatcttcacctccgatgctgatattaccaaatttggtcgttaacacagacctaaggagcaagctttgttaattattctctgcagcaactcagcaccaagaacaaaaaagcaatggtgagagtggatctcattgcccaaccccccttctgcatttaaaagagtttctaggtaccccattaagtagtactgaaaaatgtgccgtagaaaaaatcatctgtatccactgtagccacttttcaggaaaccccatacatttcataatggatatcaaggtggagtgctctatagaatcaaatactttagcaatataatttctctctttgactactggcattgatgaatatactctaaagaccatgctaaacagtcttgaattgtcctgcctttgataaaaccatattggttctcatgaaccagtttaggcattacactctgcaacctatctgccatcaatttggttatgaactttaaactgatgcccatcagtgaaattggcctgtaatcattgactgtttctggagaggacttttttggcactaaggttatgtaagacatgtttagcagctgcagatctgtatagcaagcatgaaagtgagctgctaacctgtaaaagtcctgtgatatgatttgccaacatttcttaacaa

SEQ ID NO: 89682 - DNA, 673 bp, Oryza sativa
tcttgacgaaaaggatgttgagtgcactgccaccatcgatgagggatctgcgaagcttgacgttgcgaaccactgggtctagtaccagggggtaccgccctgggtggaccacacggtaaggatgatccaagcggtcaaacataattgttgtctctgaccaccgaagatattggggcgtgtcgggctgaatagcgttgatctcccgttcggttagcttttgctttctcttggattcataggacaggggtccgccaaagatgtggttgagttccttgcgatggtcttgaaaaccagtcggggcgtcaacttcatcatccttctttaacgtgctttgatctccgtcagaggccttgcgtgcattcttggcgtattgttctgcaaactgtttatagacgaagcaatctttggccgcgtgattggagtttggatgatgcggacattgggagttcatgatcttgtcaaaagtgttgacccgtgaacgttgtcgggaggatggtgtagtagttgccacaagttccttgggtttacgcttgcgatccttgtgattggtacttccactcccccctgtagttggcgtatctttcttcggcttccaagtggtgcccgactgcttggacgcggtaatgacatcttctgcttgaccgtcctgggaggcttgcgcccgaacttgccg

SEQ ID NO: 89683 - DNA, 658 bp, Oryza sativa
tcttccagatccagacaaaaggcctcgacacatgcacatttgagtatgtcagcttatgaaacctcttagctgtgtatttgtcagagttccggatgaaagaccattcatcaccattaccgttcagcagagagagaagaccattcctcctctagaacagtgaattctccataagcctgggtgctcaggggcagtaaaaaacaatcctcaagaggagtagaacctatttgcttaatagagagagttttatctaaggcaaccatatataaagatggaaaagcattgcttcttatcttatcattccaaatgtcatcctagaaaagagctgaagatccagtcctgatatggcagtttgagattcccctgaaaacatcagtcagagccactatatccctccaccaaaaagatcctttattccaaactaaatgtggcactttagagctataataagagttccatatcagttgaacccacggcagatcatgtcctttgtaaaatttgactagatgtttaagcagaagcgctatattctgaactcttagattgatgactcctagtccaccttcatcctttggtctgcacactagatcccaagaggctagagatcttctggttgaagttggattgtttcccctccaaaggcaatttttccttgcagtgt

SEQ ID NO: 89684 - DNA, 691 bp, Oryza sativa
  unsure (1)..(691): unsure at all n locations
tgatgaagggataaaagaattaataaaaagaatacaggagaagaaggacaccgatttctcaaatagacgatcaaggcacagtttggtgcggtccacacatctgtgtaccggccaagaaggagttaagagatcccatcctaaaggaagctcatgagtccgcctactccattcatccaggaagtacgaagatgtaccaggatatcaaggcatatttctggtgggctggaatgaagcgagatgtcgcagaatacgtggcgttgtgtaacatttgccaaagagtcaaggcagagaatcagaggccagcgggtctgttgcaacccctaccgattcccgagtggaaatgggaagagatcggaatggatttcatcaccggtttgccaagaacccctagcgggtacgactccatctgggtaatcgtggaccgactcacgaaatcagcttatttcgcgccagtgaaaaccacctttgatggaaagaaactagcagaactctacatgacccatgtcgtgtgtagatttggcttgtccaagaagattgtgtcagaccgaggcactcagttcacctcagggtctggaagcaggtgcatgaagctctcggaacccgatctaaattntagtacaggttaccattcgcagaccgatggtcaaacagaaaaggtgaaccanattctagaagacatgctacgtgcgtg

SEQ ID NO: 89685 - DNA, 504 bp, Oryza sativa
cacaccggtcattgtcagtgatgctggctttaaagtgccatggtataaatccgttgagaagctgggttggtactggttaagtcgagtaagaggaaaagtacaatatgcagacctaggagcgggaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgct

SEQ ID NO: 89686 - DNA, 946 bp, Oryza sativa
actgtctcggcatggcgaccgatctatcccaatcacttgatttaagtatatatcgatataaggactatatgccgttaatatctacggccgatcgagtagatttagttcaaagataatgactatcgatcggtgcatatatgacatcggctcaaatgatatgtcctagctgatcagctatcgtttatggatttaaccgcggtttctttgtctttgttttttgttgattgcaggatcaaatcaactggcacgctagcatacccgaaggcgagttttggacctgcactggagttaagcagatctcccaggcctcgtgttttcacatcaacacgcttttggcacacccgatgggactattagaagtcagaatcacaacagcattttcccatggctgagaaaccaccagcatcgccgtcttcagctggtaaagatggctcttctaaatttaagatctagaagcctggtctatctgaagttaatgagagcaatatcgtgcctatcactctggacaagctgacacccgagcagcaaaaggatcttgaagctatgatgcagcaagcacggaaccaattcttgaactcattcatggagacacgtaagggaacaattgttcagaagtataaagtaaatgtaattgctgatgttcccggaacaggttcgtccaaggatcgagaaatacagcaggttccagatggtgcaactcaatcaggtgataaaggtactgcggatggttttcaaggggtttaaggtgatggctctcaaggggttcaaggtgttggttctcaaggaattcaaggtgatggttctcagggatttcaaggtgaaaatcctaaccaagatggcaacacggcacagctacagtttaacaacttccaagatcggattgattatgatgtgcaacatgctttgattaattaatctggggtattagtcaacacattgtcaaaca

SEQ ID NO: 89687 - DNA, 709 bp, Oryza sativa
  unsure (1)..(709): unsure at all n locations
cgaaggtcgcgtcatttaaagtccgacgtgcaagaccgtatctcctttcgattcagttcatggattttccacccgtctccggaggtaatggggcgggcgtctttggcttttccttccacaccttctttgatttcggtgtggaagacggcttcttctgagctgactgctctaacttcttggcggtataggtgattttaccggcgtcctccaataacgattcctgggcattgttgtttccttctccaggaagttctgcataaaccttaccaggctatccgtcttgggtggctccactttgacctcttgaatattctgcgggttcggcccatacttgattctaaccatggagcattgttccgtccttggttgaaactcaaacttctcctccttcccgttgatatggagacggatactccccgttcccacgtcaatgttggctcctacggtgctaaggaacggtcggcccaggatgagcggcttctccttccctgtgtccatgtccagcaccacaaagtcaaccgggatgaagaaatcccgtatcttgactggcacatcctncgctatccctgccgggtaacggactgatgagttagccagttggaggcgcatcggtgttggtgtcaacacccgtgaagttgagttgtcgaagacgtcttttggcatgacgctgacgctggcttcaaagtcgcacaaggccttgtcgaattgt

SEQ ID NO: 89688 - DNA, 656 bp, Oryza sativa
actataggcgaattcgagctcggtaccctcagaaagacctattattcatttggatattaaacctagcaacatactattggatgacaacatggtgccaaaaattgcagattttggtctatcaaggctcttgggtgaagaacaaaccagagtttgcacacaaaatgtcatgggagcaatgtaagtcaccaaacacattccaatgtctattgttttgtagttttcctacaaggtgaatttcatttgcattagtcacataatcctccaactattgatgctgatattatacagaggatacatggcaccggaatatttatatcgaggtgaaatctccactcaatcagatatatacagtttaggtcttctaattatcgagatcacaacaggggagaaaaacttccccaatagagaggacatcattgctaagaacttcattgagaatgtaaggcaaaaataatgactgtaccagttttagaacaaatttactgttttcatactaaggagttcttttagaataatgttatatataagtttgtgtgctgtcgttgtttataggtacgccgaaatcggaccaatattgtgcatatatcactgaagtacccatcgttagacacaaattgcctccagcaggtaaagacatgcattgaaattggactgag

SEQ ID NO: 89689 - DNA, 601 bp, Oryza sativa
gagagataattatccatcattgttcatcgtttggaagcgtatccttctactgtgtttttgaccaatttcacatgaaaatttacatcatatttcattccatcgacgggtcgacgatgtgtccggcgaagacgaccgcacttgacatctcctccactatgaagtaggcgaacggatgttcggcgacgaagtccaccggcggcggcggcacaccggaaggaagcatccttgtcatggtggcggcggcagccacggttccttcctcgttcacctcgatcaccgccttgtgctggatgtcgccgacgaacaacggccagccggagccgtcgtcctccaccatgtcggacaggtcggcgagctccggcgaaaacggcagccggaggcccagctgctcgagggcgccgacgacgctgccgccgcatgacaccttgaacttgggcacccgaaactcgccgacgggcactggccacgccgccggcatgtgctcgtgcaggaaccccggccgcgacgccatcctctccaccaggccgcgcagcccgtcgcgcgcgttcgggaggaagatggccatggcgtaccgcgtgaactcgccgccgacatcgccgcc

SEQ ID NO: 89690 - DNA, 1503 bp, Oryza sativa
atggctatggtccaggctcctgttgtctgtgcggccatgctagatttttttcaagaatttgtgtggaaactaatgcctatgacaggggtaatggagctgtgttgacccaaaatgaacacccaattgcctatttgaccaaggcccttggagtgaaggctcaggcattatcaacatatgaaaaagaatgcttggccatcttaatggcagttcaaaaatggagggcataccttcaacattcagaatttgttattctaacagaccacaggagtttgactcacttgggtgaacaaaaactaaccacaagtatgcagcacaaagcttttgtgaggttaatgggccttcagtatagaattcaatacaaacaaggatctgaaaacaaggtggcatatgccctttcaaggagagatgctcagacagaattgttagcaatctctgttgggaggcccaaatggttggaaatagtggtagagcggtatgaacaggatgatgaggcaaagcaactattggcacaattgattttgaatccgactggtgttgagcatttctctctacttaatggggtcattcggttccaaggcagaatttggttgggtaaatttgaagatgcacattaagcagctttgctggctttacatgctagtggggtcggtggtcactcaggaataacagccacttataacaggatcaaaaatttgttttattggcctggcatgaagaaagatgtgcagaagtatgttgcttcttgtgaggtttgtcagcaagcaaaacctgaacattgcaaaagccctagaaaattgcaacccctaccagtcccttttcaggcttggaccaccatcagtattgtaacgccccgattttcgttcgggaataaaaatcaattaataatacattttctagaaattaaataaaagttaaatcaatttaatcaagtaaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaatcctccctcctctctttgggcccctttcggcccaattcccccccctctctccctcccgggccggccttctccctcggcccgctcagctctctctctccctcaagtctgttttgcctccccagccggcctctccctccctctctctccgacagatgggacccgtgggccccacctgtcatccccaacctccagcccgggccggcaactgccatggccgcccgagccgcccacgtagacgcccctccccgcgcgtcttccgattcccgcgcgcgtgtgggcacggtccaccccacgtcatccccttcctccaccatttcccctacttctcccctccaaaaccggcgccaaactgcccccactcacccacgtcgccggcgccccttcccccttcaaat

SEQ ID NO: 89691 - DNA, 670 bp, Oryza sativa
gagcttctcgtcctcggggaccttgacggcgtcgtcgccggtgccctggggctccagggcgtcgttcacgccggcgaaggcgtggcggcagctgtcaaggcactggtcgaccttgtccttgcactcgtccacgggggcggtgcagtccttggcgccgtccctcgccacgaaccaggcggtggcgatgcacccccgggcgatgctcctggcgtccttcttccccgcgacgatgttggacggcatgttcttcaccagttgctggcacgccttcacgtccgtcgtcttggggcacatggcctccatgttcaagatgttggggtcggggatggcgccggcgttggtgttggcgctggcggcggagtcgtaggcatcggccgccgagacgagaacggctaggaggaggaggaggaggagtgacggcattgcgggagaggcggccatgactgggcttagctagctttgtcgatggagatgaattaatggtgatcgatggctaaagaggccgtggttacgccgtttttatataggctaatcgcacagcgttttcgcctgcatggatctaactaataggagagcttcacaagtgtttggttcagttttgtacacttctttttttctattttaagtcatgggactagctatccatcacacgacagatttttgggtccaa

SEQ ID NO: 89692 - DNA, 1161 bp, Oryza sativa
catcggtaagaatcatttcttagagtcttacatgttgagcctcttcaacaccttgtcaatgtatgtactctggcttaatccaattagcctatttgatctatctctatagatccttatgcccagaatatatactgcttcccctaagtccttcattgaaaaactatttttcaacgatgtcttaacggattcaagcataggaatatcattcccaatcaacaatatgtcatctacatataggattaaaaaccacctctgccagttgagctcattggtccacatacattagtatgtactagtgccaatagttcacttgccctttcactttgacccgtgaaaggtgcctttgtcattttgccaagtaaacaagattcacatgtctcaaatgattcaaaatcaaaagagtgtagaagtccatctctatgaagcttctccatgcgtttctcatttataagacccaagcgacagtgccaaataaaagtgggattcaaatcattaggacgttgccttttcgcattaatgttatagactgaacatccatcaagattcacaatgtataagccattcatcattggtgcatggaaatagaaaatatcattataatagattgaacaaccattgtccactgatctaaaaccataaccctctgcttgcaaacaagaagcagagataacgttcttacacaaagcttgaatgcaataacaattatttaactccaaaactaatcctgacgataaagataatggcatagtgccaacggcaacaacaacaactcttgctccattgcccacgcgaatgtccacttcgcttcttgataagctcctacttctttttagcccctgcaacgatttttatatgtgagcaactgacctgctatcaaatacccaagaatcagtagaggaagtagcaagattaatttctataacattaatacctaaggtggaactctttccatcctgctgcatctgcttgaggtgctctaggtatttcctacagttcctcttccagtgacctgtctccttgcaaaagaagcactctgtatccttagcgggccctgtcttttgaaccttggtcttagagttgccagtactcgtgatctcatcagagtttagctttctcttttgaccagtcatcttgttattgggcttgcgcttatgcataacc

SEQ ID NO: 89693 - DNA, 689 bp, Oryza sativa
tctctcctctctcattcctacttatcctctcctcctctcactttcctctccctctcaccttctccttctcctgtgccgtggcgccgtgtgcctccttctcctcctccgggcggctctcggcggcgggctcgcgatggcggtgggcggaccgggagtggcgcgtgcttccttctcctcctcctctgggcggctctcagcggcaggctcgacggcgagtggcgggagtggcggtgggtgggagcggcgtggctcgccgaccaggagcggtgtgcgcacgacagcaagctcgcggcagagggtgaccgggagcggcgtgcgcacggcgggtggacggtggggaggcggcggcgggcagacgggggccactgccaacgacgacgacggggaccggcggtggtagctgccccccacccagatctggcggcggtggcggtggggtgcccggatctagggttagagtttccattttttgaattttttttggatttttattttcccgtgcgggcggcataagcacccacacgcaaaaatagtgattttcgcagacgatttgctctagacgggccgaagttccgcacgagaaaatctgattcgaccgcacggaaaaatctgtcgtgtagatccatacaaaaaaaacttttatatttataggcgaaggtagtgtcacgcttgttctcattttcttttag

SEQ ID NO: 89694 - DNA, 667 bp, Oryza sativa
attagcaaggtgttgcttacctattttgataattgtctagctgtgatgccaaagctcactagacactaataaaatgaggatcttgctagagggaattttgtttcacaacacatagtgggagtatctttttttaaattgtttaataaaagattaaatgtagacatggtgctaattttgcatatatatatatatatatataattgttctcaggtaagagcacaaagagtttgtgcttaaagagccttttccagctaacttgcccaacaatgctagtactgctcagcgtagggatcatgaaaagcgatgcaatgattatcttgatataagctgtctcatacttgctactatgtcccttgagcttcagaagcaatatgaaacattggatgctcatacgataatcatgggactacataacatgtttgaggaccaagcaagagctgagaggtttaatacctcaaagtccttgtttgcgtgcaggcttgcagaaggtaaaccagtgagtccccatgtgatcaaaatgattgggtacaccgagagtctagaaaagcttggttctccagtcgctccctcccagctttgagccattcatattgaatttcaacatgaacaacatggacaggaccttggccgaattgtatgggatgctaaagactgccgaggaaagcat

SEQ ID NO: 89695 - DNA, 601 bp, Oryza sativa
agcatatggtttggtaatggcctcaataaagctgaaacattatttccatgcccatagaatcatagtgcgttcgcaatacccaataggcgaagtgcttaggggcaaagaaatcactgggcgattgagcaagtgggcatttgagctatctcccttcgacctacactttcttgcaagtctcaagttctggctgacttcttagccgaatggactctagccttcttccccgaacctgagccgatcaaccaaccatgggtaatgtactctgacggcttatggtctcacaaggggtgggagttgccatgatcctaacttcgctaggaggcatgccgatccgctatgctgcccaactgcagttcgacacaacgaacaataccatagagtatgaagctgtgttgatgggcctgaggaaggcgaaagctctaggcgtttggcatttgctgattcgcacgaattccaagctagtggcaagccaggttgataaatcttttgaggtgaaagacgacactatgaaaaaatatttggaggcagttcgctccatggaaaaatacttcactggaataacgttcgaacatttacctagagggcataataaagaggcaga

SEQ ID NO: 89696 - DNA, 696 bp, Oryza sativa
catcgactccttcactgcggcctggaggtacggaaggttcaccacatcggcctccgtgatcgtcccattgcctccaagtgcggccttcatctctgctcgcgtggtggccatcacattagggttgcgcagcagttctgccatggcccactccaccgtgatcttggtcgtctcggtccctgctgcaaggatgtcaaacaaaaggattttcacgtcacggcgagagagcttgccggtggacatgagcacaaggagagagtccagcacatccttgcactggtcgtcggtgccctgggctaaacggcagtcaattatgctgtccaggatatggaggactcgactcatgtgtatggccgtccagtggcgaatgccttgcaaatctagcggccggagcagcgggaagaaatcggacgcgttcggcttcgcaagtattgcaacgatatcctccataagatcccttaaattggggtgggcatcgacggagagaagcacgttcgccaggaggtcgaacatgccatggtacaggacctggccgatatcaacctcctgcccagcgcggcgacggaagctgtccaccatgtcgtgcaccttacgctcgcgggcgctgcgcgccacgccgagactgcgtggcgagaagacgtgcgttaccgcgatgctgcgcagggtcttccatagaggatcgtagctcggcagccaaac

SEQ ID NO: 89697 - DNA, 604 bp, Oryza sativa
atggggagcgtcgcctcctcgtctacggcgacggcagcgcgccccagggcgcgctccaagctgcgggcgcgctcctgcgtcacccgcctgtcgtccctgacctggagtctccagcccaacgatgactggacgacgtggccaacttggtcatgacggcacagcggcgcctaggtgctggtggttggtcctccgccaccaagacctctggcgctgctaccaccggctccgtgtcgtcaaggcggagggcgcgacgagcggcggctgttgctcgccattcggctgccactccctcgtcagcgcctccgacccgggaagatcagcgtggggggccagatgcccgcatcgatatcgagcgccggcgtaatggtcggcgtgctccccacgcaacggagggcgcctcctcgtccggagagtcacctcaacacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgc

SEQ ID NO: 89698 - DNA, 1594 bp, Oryza sativa
ccaccgaggtgaacctgatttccaggtttagccctttgcacatctctctgaacttgtcggagtcgaattgcttaccattgtcagtgataaattcctttggcactccgaaacggcaaacaatgtttttccatacaaatttctgtactgctgccgaagtgattgccccaagcggttcagcttcgatccaacgggagaagtattcgattgctacaattgtaaacttgtacccatttcgtgctaccgggaaagggctgatgatgtctaacccccatctggcgaaaggctagactggtgcgataggttgcagctcataatgggatgctgcttggcttcggctataccgctgacagctttcgtacttcttagcttgctcaacacaaactttcagcacggtgggccaatacaccccctggtgaaacactttggaagcaaccgttcttgcggcttgatgagcaccgcacagccccttgtgtatttctttcgccatttcctcgccttcggcaaaggagatgcagtgaagcaggggttggagcaccccggtgcgatacagctgccctgagaccaacttgtatcttgcggctctgagttgtaggcgcttcgcttctgcttcgtcctccgggagccaaccgttcttgaggtactttatgaacggtgtttgccagtcttcagggtcttcgcccagttctgcctggtcgattgccatgatgtccaggctctctgtgggcacaattggtgtgtacaagacttcaaagatgatgcctggcgaatgtgggcctccacaagcagcggatttcgctagggcgtctgcttccttggtctggcctctaggtaagtgttagaccgttatgccggtgaaacacttttccatagatcgaacaacctccagatacctcttcattccttcttcttttggtcaaaaagattgtcaacatgacttgcctccagcttggagtctgttccgatgagcaagcgtcgaacccccactgctttcgcctttcttaggcccacaagtacagcttcgtattctgccgtgttgttggtcgtgtcgaactgcagccttgcagcgtaccgaatcggcaggccccctggggaagcgacaactgctacggcgctcgcccccttgtgcgaccacgagccgtccgagtacatcacccaaggttgtttggcaggctcgggtttaggggcgaatgctggcgtccattcggccacaaagtcggctaggatttgggacttgatggcagtacgggcgacaaaatgcaggtcgaagggagataactccgccgcccacttgctgagccggccagtaatttccttgccccggagcacttcgcccaaaggatactgtaatggcacagtgactttgtgggcctgaaagtagtgtttaagcttgcgcgaagccatcactagggcgtaagcaagcttttccatttcaatgtatcttattttcgccccttgcaaagcttcggagacgaaatacactggtttctggcctgactctgtctcttggatgaggattgcattgaccgccactggcgaagctgctagatagagtagcagatcgcttcccggtgctgggctgaccaaatcgggtggg

SEQ ID NO: 89699 - DNA, 509 bp, Oryza sativa
cgaacgtgttgacgcgcgagcgctgtcgagaagagtgggtggcggttgcaacaagttccgcaggcttacgcttgcggtccttattgttgttacttccacctcctcccggagccggcgtacccttgtttggcttccaactgggacccgactgctttgatgcggtgacgacgtcttcagctttggcgtactcgttggctttttcaaacataagcttgactgtcctgggaggcttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaaatggtcgcgtaattcggcccaagatccaattgtaccacggggcaatccatggagccaagatcgggcg

SEQ ID NO: 89700 - DNA, 1460 bp, Oryza sativa
caaacaggaaagctgacacaagccatcagggagtttggtgcagcaaggcaggccatccaacttaagactcgtcaatctatcaagcctcacagatgcttttgatgtcatccactttgggagctgccaaccaaaatatcctctgatgtaaagttgttctaagcagtatgaagggcacaactcatcaaaaacctccttgattcgtcgctgctcgtctatagaaatgattccttcctctttcaagaatccatcatctctctgcctatcagtgcactctaaccaccatatggcaagatgtttcttggcaccaagcatggcctttgcagcggaagagctggcagatacattctccaaaccctttatatggagatccctgagctgagaaagaggtcccagctcctccaaactacaccactcatcttttgatgaactgctacccatctgagctggaaacgagtataatgttctcaaacttgtaaggcgaccaaaacccctaggtatactttttatgtttgtgcccataaggttaagagatcttagccgctctagttttataatgctaccaggaagttgttgtatttgttcacagcatgtaatcccaatgtactccaagaatttcatcttgccgatgccatctggcaggctacgtatgtcagtacgggaaaagtacaagtgcctcaagttcttcaattggcatagagaatcaaaagtagcaagttgtgcatatactatactcagaacccttaagtttgagaatttgctgcataaatcattggccttcaacttgatatgagtacttccataaaaaaataacgttctaactgagttttgttcttgccatgcactccaatctaattcattctgtatgcacaaccaacgatatctatttgaatcgaggtcagtgactctaagatgttccatatgaaagggtagtgcttcatctttagccacatgtcgacaaaatgagcgaaccacatcatgcatggtccaattattattgtcgccggcattgtctgtaaaaggttccttatgattaactcattgtaatactcctttcctagttcttccggttcatttgattttccattaacaaaaccttcactaatccatacttcaacaatcaaatgtttattgggtttaccatatttagggaagagtgagcaatacaaaaggcattgcttcaaatgagggtctaggtcatcgtagcttaaatatattgcatggtttatctcttcaggcattccatccactaaccatgaaggacttcttagtacctttccccactcaatttcatttatctctttgtggttcaaaagccctgcaatcgctttgatagctagcggtaaaccaccacatctttctaaaattctaaagccagtactctttagcttctcaatcgcatactcatctttcaaagttgaagcaatctgcaagcggttgaagcccatgatgttaatacatat

SEQ ID NO: 89701 - DNA, 1294 bp, Oryza sativa
ccatcaactatagtaaattcttggcaaggatatgacattaatggatattcgtttagcacatcgatcaacatattgaactaatacgagctaacaataagggtcgctccaccgagtggataatgaaagaacacaagcgtctcttcatagattggttgcgagacctagacttacctgagggagaaactaccgatgaaataactatgaagcggttggcttgtggtccatcaactacagtaaattcttggcagggatatgacattaatggatattcgtttagcacaagagcccgagataataagacctgtacgcaaaacagcggtgtccgtgtggaggcaattgatgaagccggggaaaaacaatcatacttcgggtttattgaagaaatatgggaaattgactatgggcacacaatgcaattccccatatttaagtgccagtgggtaaaatacccgaacggggtaaatgttgataagttcagtcttactgttgttgaccttgcgagagtgggtcacaaggatgatccttgggtactcgccaatcgcgtggcacaagtgttttatgtgaaaaacccttcaaatttgaacaaagatatagtgctaccagggaaacaaaagatattgggagtggatggggttgaagatgtcgaagattacaaccaatacgatagtatgccactttatagtcagtttgtacagaagattaagaatgtcgagacatctactcagaagaccgtgaagccttacatgcgcacggacggtgtgggcaaaaatgttaaagggtaatgattgttgagtggcatataagcatctaagaagttagtagttatgtaatggtcgtatgtaaggtgatgtgtgatcgtatcgcaaattgacgaacaattgtactcaacattttgcatataatttctaagtactaatttttatgtgcaattaccatttgaattgtgaaaatttagttaaaaaaatttaaagttagtaatatccgaaaagtgtaaatatttttatgtgcaactaccagtttgttaaaaagatcttcgcaggcggaccggccgcatgcgaagatagtaaaagagatcttcgcagcggaccgacccgcttgcgaagataggaaaagagatcttcgcaggcggaccgaccgcgtgcgaagatgatcatcgcaggcggaccgcccacctgccaagatctttgccctatataagggcaagcctgcggcgccaaaatttctaagtccaggcggtaaccctagaaaatttggcgccgtcaggcgaacgaaatttttcaccgccgcacgcttc

SEQ ID NO: 89702 - DNA, 695 bp, Oryza sativa
agctcgtattagttcaatatgttgatcgatgtgctaaacgaatatccattaatgtcatatccttgccaagaatttactatagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgaccttcttggaatgatttgtgatcatgggtgacgaatctcttctttcctatcgttcccctgccactcaatctgcccacgtgttggggcacaggtactccaattgcatatccatccttgagataatcgatacagcactcgacaacctcttcagtactataaccctcaaccattgatccctctggatgtcattgatccctctggatgtgcacgatttcggacgtaacccttcagaaccgccatgtaacgcttgtatgaccacatttgatggaggtacaatgggccaagcgcaaccatctgcggcacaatgtgaacattgaagtgctccatcatatcaaaaaatgacggagggaaacacatctcaagttggcactgggtctcatgtgcgaatgtacggagatttc

SEQ ID NO: 89703 - DNA, 9019 bp, Oryza sativa
cgttctccctgtcaaggaaatcatcgggtggcggccagcatgcggtgaggcttttccgacccccgatacaaacgaggttgtggtcttctctcatttcttctatggcggcttcgctcttctaacctcgaaatttttccgcgggatattaaacttctacggaatcagcttgcatcacctaaacccaaattccatagtccacatcgccaatttcatccatgtttgtgaagcctttttgggaattaaaccccacttcgctctgtttcgccgaatcttctttctcaaaccccaaccgaacaagaataaaccatgtgtagtcggaggggccggatttcagctgaggggaactctgagccagaagtacttctcgatgcccttcaagacttcaaacaaagggtggcatgcaaactggttttatgttcagaatcctgagcctgctcttcccgagtactcttgtcttcctccggtgtaccaagatacttggaactctcttccgattggggatgaagcagcccaagccttggagttgatggatcgcatgctaaaactcaaagaacaaggcttacaaggagagcagattactcggcacttcatcaaatgccgattggcaccaattaaagaaagatcccgcacagcattcgagttcgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaaccttcaacccatgaccaaaacataatctcgtcttcatgttgagttaactaaccgtggaggcatctcattcaggaatatgcattgatgaagtctgaccccccaatcactcagcgccggtctcctcgtcagcacaccgttcagggaggtggagggccaacaatcagatcagacccgcaacctcaaacctccaatccaactggacagacaggttctcgcaagaggaaactggtgcttgacaacgatgaaggcgatgacgacaacaagtctggggacaagggctcgcctaataaactcccaaagcgtaccatgcccaggaaaaaacttgctaaccgcccaacgccaaagattagaacatcttccaggtataaacctcttggtaccatttcacttcggcacgcttctctcatgaaaataatactgaatattaaaagaatactttgcaggaaaccatccgacatagatccaactggaaaggatcctgatccggctgtgacagggccaagttcatccaaagatcctgagccgactgccgaaagccagccagctagcgcccatgcttcgggtgataaggccgatccgagtgaccagccgccgactggaaaccagtcggcagcagctgaaactgcaacaacccaagagcccccgactggaaaccagtcggatgtaggtcccgatcaagaaatccccgaagttgaagcgcagacgacaacttctcaaggaccagaggctggtaacgactcgatgattgggtctccaaataaagaacaaggatcacgtcacgctcagctaggaacatcctcaggtaacccatcctctcaagtgatgccgatttgaacaacttcagcttattcgtctaatgtcttggaaatacatcaggaacaccaggcgatgacgaagaagcaattcctcgcataaaggcggctgatgactctcgtcctcctatcttgctcaaatggtgggacgagaactcacaagtcgccggcatcgtcataaatcgtcaaaaagaagatgaggaagtgtgccagctgaagaaggcacttggagaggccactcgcatcgtgaatgtaaatcttccgggtgactgtctttaataactttgttctctctttagcagaactaaaccatgaaccatcatgcagagaatccatcttcgcaatgaggccaagactacaactttggaaaagctggttcctcatttgggaactcttaaagcagttagggaccagctacatgaggccaaggagctcgccaaaaagtcagagaaggaattaagggaccgaattgcccagctccaggattcaaacttcgagctgagtggtgcatcaaaaggtaatctctagatctgtcccattaatttatgctgtcgtaactgtatcctcaaccatctggattgcaaacagcgcaagccgccaggatggctcaaatggaaaaacagattgaagccttgaaaaaagacaaagcagaactggctgcacaaagggactcggccttgaaggaagttgaaggtactgccagctgacaatctgaacttctctctgttaaatgcggcagattcttatcataaatgtgttttgtagaccgcaaaatcaaatctcaagctcaatttgacgtcctggttggtaagatcaagagacttgaaggagcaagagatgaagtcgccaatgtcgcaacaccactcgtccaagccatgttcctcaataacagtggtccgagcgcactcgacgcaaccgaaatattcgacaagctgagagttgctccggatgtatatttcaagaatatcaagaaagctggaagtatgggagctagcatggcattggcgatgaccaaatccttgtacccaaggattgaaattgacgccattgatggctttgcagacgggacaagcgaagaagctgcccttgatcttatcagcaatgctcaaaacgcggctgacaagattgcaggtgacgttgtagatcaattccgcaataccgaccttcagccaagtagtaataactctgatgatgaaaagactgattctgactgagtgtaaatgtagaaaatggaggctcaacttgtacaatactggtgtatttatgctgtgtttgataattctagccaagtcgttgatttcttaaaagcttttatcaagctttgttgagcctaaaacccaaagaagctattaaaaactttcagtcctcgcagactaagtagaaaaaccaaacaaggcaatgatagaccaagtaagcaaattgaattgataagtaatcaaactccattattatgatgatagcccccgactgacaacttcaagaagaaaacttgatgttgacagtcaagatagggaagtacaatgataagcttaagcataaaaacgacgaagatgttcaatgttccaagagttatcgacgagtgtaccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgaccgaatcaaagctgcttcgcggacttcttccaatcggtgcaagtcatccactcggtcctcttcgtagcgttcttcacggaaattttgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgtagtatcatgccattggctcgctccacctgtccattgctcatggggtgccactgaggcatagcaaatcttaattccaaagtcttcacaaaagtctttaaaaactccgccagtgaattgtctgccattatcagtgatgatccgattgggcactccgaatctatgcacaatgttgatgaagaagtctcgagcgttatctgctgtgatcgtgacaaccggtttagcttcaatccacttggagaatttgtcaatggccacaaagaggtgcgtgtaaccgccgactgcctttttaaacgggccgaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcagtaggccaaaagaaaccctgccggtaagctttgccgacaatggtgcgcgcggcagcatgatttccgcatatcccagaatgtatgtctttcagcaattgtctcccttcctctaaagatacgcagcgttgcagaatccctgaagggctttttttgtacaactcagcttcatgcataacataaagtttgctccgccttgaaatccgctcggcttcatctttgtcttgggggagttcttgagaagtcaaaaatcgtatgaggggttctcgccagtcggcttcaaccatagctatgtcatgagtgcccgcaacttgagtagtatctttgtgaggtactgtcggcgtataaaggtgttcgacgaaaacatcagagggtgccgcctcgcgcttggatccaaagttggcaagtctgtcggcggcctcattattgtgtcgaagaacatgactgagctcgagtccatcgaacttgtcttccaatttgcgtacctcttgtcgatatgccatcatattgtcgtcaaggcaggaccactctttcataacttggttgacgaccagctgtgaatcgcctcgaactattagacgctttatccctagggaaatcgcaatcctcagtccatgaaggagcgcctcatactcggcgacgttgtgggatgccgaaaaatgtatccaaagcacatagcttaatctttctccagttagggaaattaaaaccactcctgctccagtacccgaaagtcgttttgatccgtcaaaatgcatggtccagtgctccatcttctccgcgggggtatcctcctggcactcggtccattcggcgacaaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccctcttcctcgtgctcaacgaccaggactgtgctaacaacctgggaggtggcagatacatacagcaacaacggctcctgcggatgtggtgaagctaagactggcggctcggtgaggagtttcttgaaatcttcgaaggccttctgtgcttcgggtccccactggaaatcatctgttttcttcagtagcttaaagaagggcatcccccgctcgccaagtcttgaaacgaatcggctgagcgccgccatgcatccagtcagcttctgaacatctttctgggtacttggcggtttcatgttgaggatagcagtaactttctccgggttggcttgtatgcccctatgagacaccataaaaccaagcagcttccctgacggtactccgaaggtgcacttttcagggtttaatttcatcctgaaagcgcggatgctcgcgaaggtttcttctagatccaagatcaaatcatccttttgcttggtcttgacgactacatcatccacataggcttcaacgttgcggccgatctgtgttgagaagcatctctgaatcatacgttgataagttgctcctgcgttttttagttcgaacggcatggtgacgtagcagtatgctccaaagggcgtgatgaatgaagtcttcaagcagtcggattccttcagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttctttcgaactagaaccgggtttgccagccagtcgggatgaaggacttctttaatgaagcctgctgctaacagcttggttaattcctccttgatcgcgtccttcctgtcttgtgcgaatcggcggagtcgttgtttgattggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaggggaatctttttagtcttggcttcgctttctccactctttgagatcttggtagcgggcacttctccttcgctcgtcgtggctgcagccagtcggatatcctctcgggcagacgccatctcgcgggtttgagccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctcggtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccgtcaatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagccagggggccgccgaagatatggttgagctccttgcggtggtcttgaaatcctgccggggtgtcgccgtcgtccttcttccttgacgtgctttgttcttcgtcagagttcttccgtgtagtcttggtgtattgctccgcaaactgcttgtagacgaaacaatctttggccacgtggttggagttaggatggtgcgggcattgggagttcatgatcttgtcgaacgtgttgacgcgcgagcgctgtcgagaagagtgggtggcggttgcaacaagttccgcaggcttacgcttgcggtccttattgttgttacttccacctcctcccggagccggcgtacccttgtttggcttccaactgggacccgactgctttgatgcggtgacgacgtcttcagctttggcgtactcgttggctttttcaaacataagcttgactgtcctgggaggcttacgcccgaacttgccgaccaattcttcgtggcgaatccctttggtgaatgcggcgatgataacgtcgtcggtgatgtcggagatcttgttacgttgttcagaaaatcggcggatgtaatctcgaagggattctccggacttctgaataacgttgtagaggtcgtattgtgtgccgggacgctcgaaggtgcctcggaaggtggcgatgaagtggtcgcgtaattcggcccaagatccaattgtaccacggggcaatccatggagccaagatcgggcggaatccgctaaagccactggtaaatagttcgccatggccttgttgtctcctcctgctgcgcggattgcgagaccgtagacggtaagccacgattctaggttagtggtaccgtcgtacttctctattccagtcggcttgaagccggctggccaatccactcgacgcaggtcgtcggtgaaggctgctactctgtcaaggtcgtcgtcgtggcggtccggcgaatgatgatggcctcgagctgctcggcgctgtatgattgtgtcgcgaagatcgacggggcggcgacgaggtggtgagtgaggccgttccactcggcgctccctatgatggtcgggaggtgagtgaacggaccgctcgtcgtgacccctgctcctgcgattggatcctgcgccggtgatgctgaggcttggataacggtagtcatgagatcggaagtgggggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtgcggaaaaccggtgtcccttcaacatcttgttggccgataagatcacgcgctcggcgccctgcttccaaagctcgctgccgtcgatcttcagcctccttcgcggtccgctcacgctcctgctgctcacgccgtagccgttcttgttcttgtgcttgatgctcctcctccagtcggcgacgctcagtctcgcgacgtgcttcggtctcccgggcttggcgttgctcctccgtctcgttgttggccatgaagacgccgaagaagagaggggtgtagttgtcatctaggctttcgtcgaagtcgtcgagatccgggtcgttgtagcgagagctaaactcatcgtactccacgatgtcggtggggcgcgagtcgacagtgggagagctgtagtagccatccagttgatccgtcgaaaccgtgccgagtggttggaggatgacgccgacttccctgaagctaggcgaaatcggtgttgaagccgacttccgcctaggcctacgggatggagacgctgtcgtgatggagatggccgccaaatcgtcggggagcttcatcaggattggtgggtaagccccatcatcttgatctggtgtcg

SEQ ID NO: 89704 - DNA, 557 bp, Oryza sativa
gcacgacatggtggacagcttccgtcgccgcgctgggcaggaggttgatatcggccaggtcctgtaccatggcatgttcgacctcctggcgaacgtgcttctctccgtcgatgcccaccccaatttaagggatcttatggaggatatcgttgcaatacttgcgaagccgaacgcgtccgatttcttcccgctgctccggccgctagatttgcaaggcattcgccactggacggccatacacatgagtcgagtcctccatatcctggacagcataattgactgccgtttagcccagggcaccgacgaccagtgcaaggatgtgctggactctctccttgtgctcatgtccaccggcaagctctctcgccgtgacgtgaaaatccttttcgttgacatccttgcagcagggaccgagacgaccaagatcacggtggagtgggccatggcagaactgctgcgccaccctaatgtgatggccaccactcgagcaaagatgaaggccacacttggaggccatgggacgatcacggaggccgatgtggtgaccttccgtacct

SEQ ID NO: 89705 - DNA, 1811 bp, Oryza sativa
agatgggaagcatccatattgttcttctgccatatcaccttcgacccttgttttaataccagatagcttaattccaacccatcgactattatgttttcaaatattaatgtctcctagatcttcttatctgtttgcaggtgtatccgaacttatcaatgtagatgcatggcgggtacctttatgggtttcatccaacaatccttatcttgatctgtaaaaggggtatccaaactcctatccccaactactatctcgttggctttttaacccaacacagtttaattggttttcttttccatcaacaggttggttattaactcgaggttagaatatagttcctctgacatgagaccctaggtctcctatgtcagtaaacaattatacacatgatcacatatccgcatctttcaaaagaatcctcatggaacttgtctgtattacacatttctcccttattacacgaatacgaggcactgccgtaaacaaaaagggaaggtgcttatcatcggtacattgtatcctcaacatgaatcatccataaacatagtaagctcactgtttacagacatgaatatatttatgaatttcatgattgctgcaaactttcgattacaccatgataagtagcggactgaaaaccacaaacatggctgctcattttgattctggagagatatagctggcattgttctagtgactgcatccttgattggttctgtgatgatgtgataggactgcataatgctatcattcacaggagaagcttccttctgattgttggttgcagcggatgacggtcttctgcttggtatcgccctccggaggttgattgcccttggctcggcctggagtaggtcggggagagacacaactccttccatctacgacaattctttgctgaggctgtcgttgcagagaatggttgctaagatttattgccgagtcaggtgcagcaggtggagcattggtgcattgtttctgctatgggttctgattaacacgaggccttacgggtacggcgtttgctccagtgaccacaatacgattggaatgtctgcttcgtgtaaattggcgaaaatgtggaggtcggggacagtttttggagtaatgcccttctccactgcagttgtgacaaacaataactttcttacactcgggttcttcatcttgtacttgatttctcagctgctgtattggagcttctaaaggtacaacgcagatactggcatctgtcttgtcagctggtggctggggctgaaattgagcattgacaccttgtggtagtgcactcattggaattggagctgttgcaacgcgggctataggactgcttcgggatgcatggatgaccattcgttgaggagcaagcttctgattgcagggagttgcgtggactgacgtgccggcagctatgtttctcggttttgggcacttgtcggcgaaatgacccattccttgacaattgaagcaacagatatcttcccggactcggcattttcttttctcattttgattcctctgtcctggcactggagttaggctgaaactgtaatcttggcgaggattggtgttgccttgatgcttctctccgttgaaaccggcgggttggttagccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattt

SEQ ID NO: 89706 - DNA, 1233 bp, Oryza sativa
ggtcttcctctgattgtgagtatatcagaatgtcatcaatgaaaaccacaacaaacttatccaagtattccattaaccctttgttcattaagttcataaaaaaggcagggtgctttggttagaccgaacgacatcaccgtgaattcatacagcccgtatcgcgtggtgaacgcggtcttagggatatcttcctcacggatacgtaattgggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtttttcttctccacaaaaatcacaggagcaccccaaggggaagtactcggacgtatataccctttttcttttaactcttccaactgtttcttgacttcggccagctcatttgctgccatacggtagggtcgcttgtgcagaggagtggttcctggagcaagatctatccggaactcaatctctcgcttgggcaagccgagcaatgtacccaagttagtgttttaatccttaaaacctgcttaacaactaaaatgtggaatggttggcctgggttggcttgggacgagctgggacccagggtcgggttgccagttcggtccgaatcatcataggccttgggttaaggcaggttcgtgtgggttcacgggcttgattaataacattgtatagttctaggatcgcgtttacaaaatagctttgagcaactaaacgtctttaaatgctgtttactgcaaccctaacccttattataactcccttgtactcccttgcatttatcctgcatttgtgggtgtgtcttgttgagtacggtggttgtactcagtcttgctcaattttttttcccaagcccagaagaggagctccttgaagatgaaggttttggtgtctagctcgtgcctgccgtcaagcgcctgtggtcgtcgccctagtcttccgctgtttctcgtttgtctttgtgtgtgctgggccttcgtcgcccatgtaataagttaactatttacgcttccgcttgttaaactctgaattgtatcaacttttggtgtaccttgcctcctgggacaaggattaatgcacgcacgtcaggaacgcccgttgggttatttccggacgtgacaagttggtatcagagccacccttgaccctaggacgagccg

SEQ ID NO: 89707 - DNA, 1713 bp, Oryza sativa
gattgagcccctagcaataggatctagaccgggtgtgccacacgcataggggtgagaccacccgtgtactagtctagtgccatggcatctcgactaacgggcaccgacccgtgtagccttcatttgcctagacatctcgattaccgagccgcagctcgtgtagccttcatttgcctcagagatatccatcgtcgcaacgacttcatccatctctatccgtgtccttttgttcaggactagactgagcaccgagttaagccttacccattagacatgtggttagtacggtagtgctttgcaacagaggcccgaaaaccggtccttatagtggccgaggtgctactagcaaaaccctgcacctcgagcccagcctaaaaccattttgggagttttgaatagaggggggaggtgtgtgttcaattccatcacaagccaaccattccacagtgtccaaatgatatgagaattcccaaagtctaaagttataaaaccatctagtgttgcctaattaatcagtgaagcatctacctaaattcatactagtggaaccattattagagtacccactagttggggttttgttttgctagggtaagcaaggtgataaaaacaataacaatgataaggctataacaaggattaataggaagtgctaaataaaacagtgataacgcgggaatttaaataaagcggtaatgcaataatttaaatcaaaataattttataaactgggattcaatatgctcaagggtgatgtgacttgccttgctcagagagaacggccttctgaaccttcggcgacgaccgcgaaccacgcttcgagaaccttcggaacgacagaagctacgcgaagcacacaagcaaagctacaagcctataaagaagcaataacaatacataaaaagaaagcacacggttctttaggttacaacaaacattaggagacttgaacgggtcgattcggggttcgtatgaccaacatatgatcatccgaagtttaatgctgttacatggagatttacggattattgtgattaggttttgcaattataaaacatgtataagtgctagcctggaaaagactggaagactacgctgttgacatgtggaccccacatgtcaacctaagggaccacagtagaccgagtacacagagacgttccacgggtcgaaggaagcggatcccgtgtgtcaaccgaggcaagcggtcgacaaatggactccactagacaccacacgggctgcacacgtggaaaccacgcggctaccgagcgggcacactaacacggacactacacgcacaagcgaacgactaccgacaccagtacacgggtaccggggtcgacaaccgcacaacgggcacgggcgacaccgaaaggactaggatggggcagcgagaggacggacccttaccaccacgtgacgaggcgtgggaacgacaaagacaaacgagcgcggcggagacggctcggagacgacggaggcgaacggcgagggagcgacttcggcggcgatccttggacgaaggcgagacgcggccggcgcaacgcttggcgacacggaggcgaggacgaagatgacggggctggagcggctcgcttgatgaaccacgggcggcgaacgcgatcggctttacggagggacgaacgccacgacgacccggaacgacgggaggacgacgacgacgacgaccgggaacgacgggaggacgac

SEQ ID NO: 89708 - DNA, 2917 bp, Oryza sativa
aggacggacccttaccaccacgtgacgaggcgtgggaaccacaaaaacaaacgagcgcggcggaaaccgctcggagacgaccgaggcgaacggcgagggagcgacttctgcggcgatccttggaccaaggcgagacgcggccggcgcaacgcttggcgacaccgaggcgaggacgaagatgacggggctgcagcggctcgcttgatgaaccacgggcggcgaacgcgatcggctttacggagggacgaacgccacgacgaccgggaacgacgggaggacgacgacgacgacgaccgggaacgacgggaggacgacgatgacgatgaccggggccggcgaggaggcgacgtgggcagccggcagcggctgcacggagacgaggacggcgtggaacacgctgctgcgatgccgacgatggaggcggcgccgcgagacgatgagccggcgaggatgaacggtgaagacgacgacgaacaccggcggtgttcgggtggaggggaggcgaggccgagggcgaccttgccgctgtgatgccggaggtggagatggcgacgtcggccagcgcacgggcacggcggaaggggctgccgaaggcgacgtcgacgaggagaaaggagaggccggcgcggcggcggtggtgttccgccgaaaccgaggagcagccggaggagaggacgacgctgcgacggcgacggaggagacggcgacgtcggtcggcgtaccggcgacgaacagcagccgaccgaagatggtgtagtggtggcgacgccactggacgccggcgggggcgcgtctccggcaatttccacacgaatcgaaggcggcgccggggaagagaggcggctgcgatgccggggaaggcgacggcacggcgcacgcacgtgcgcggcacgggcgggagggcgccgctcggcttgggcccggaggcggcccaggaggagatgagggagaggcaggcccgggagagagaggggagggaagggagctgggccgggagggggagggaagaggtgggccgggaggaggagggaagaggtgggccgggaggaggaggagaggcccgggagaggagggaaagagagggaggagagggagactttgggctgggcttggcccaaaggaggaaggaggattattcccaagtttttctttttaataaactttaatcatagttgttgttgcttaataaatatttccggtgctctgaaaattcaagtaaaatttaagggctccttttagaccaaggagaatttaccaaaaattctccgtgccacattcgaaattttcttgtacgtattttagtgtttgccaatttcttttcgaattttaattaattctattattccttttagaaaatgatttttatttcgggatgaatttatcaggacgtgacagcaatgccactggacgctggcggggatgcgtttccggtggtccccgcgcgaaacggaggacacgccggggaagaaaaggtagctgcgaggctgaagacggcgacggcacggccggccggcgcacggctgaggcagctggaggtggctggtggcacgggagagagaggaggacggcagggaggcatgatgcggccacgggggagctcgggaaagaggctaaaacgagagaacggaaggagggggttccattttataggcgcggggagggatccggcggccatggaaggtggccgaaaaaaggcgtgggcgttccgagtgatggagggcgccattcaagggggaattaggggggaaataaagaggaaggaaaggggattaattcccccaatcaatttcggaatccaagtttgaatcgcgcggatttgagagaggaagaagctagggtttcacgggagagagaggagaggaggccgccggctggagatcggggacgcgcctgacaggcgggacccacgtgggaggcacgcggtcaacgcacggcaatggtgcgcacgcgcgcgcacgtgcgtggcacgggtgactctaggctaaaacctgtagttttgaagcaagggatgagcgcgaaagcgggaggcgcggctcagcttgggccgggtgaagccaaggcgtcccaggaggagaagaggagggagctgggccgaggggaggggaggcccgggagaagagggaaaagggagggaggggagagggacttcggccgcaggccgagggggaggaggggaactttgggctagactgggccgaaaggaggaaggaggattgtgtttagttgttattgcttaataaattattccgttgctctgaaaatttaagtaaaatttgagggctccttttaggacaaagagaatttaacaaaaattatccgggctacattggaatttttctcgtacgtattttagtgtttgccatttttttcgaattttaattaattctattattccttttagagaatgatttttaattcaggatgaatttatcaggacgtgacattcaatcacctccctgggaactcccggcatgtatgacggttgccaagcgaacacgtctgcattgtcgcggagaaaggtgatgagcgcgggttcctatttgtcatccagtgtagcccctatcctgaccatcttgtcggagttggaacttgacaacaggattatcttgatggtaccgtctggctttgctttcttgctgggcttgctcactttcttggggtgctcagttgtggcgggtgggttagagtatgctcgaccatgtcgaggctccgcttgtcacattgtactgccaacttagcattgccctggatagtgattgtcccttttggtactggcattttgaatacctgataagcgtagtgagatgctgccataaacttcacgagtgcagttctcccaatgatgtcattgtatgcggtgtcaaactccacgacatcaaaggtgatttgctctgttcggaagttattggcctgccga

SEQ ID NO: 89709 - DNA, 2393 bp, Oryza sativa
agaaaagaaaatgccgagtccggaaagatatctgttgcttcaattgtcaaggaatgggtcatttcgccgacaagtgcccaaaaccgagaaacatagctgccagcacgtcagtccacgcaactccctgcaatcagaagcttgctcctcagcgaactgtcatccacacatcccgaagcagtcctatagcccgcgttgcaacagctccaactccagcgagtgcattaccgcaaggtgtcaatgctcaatttcagccccagccatcagttgacaagacagaggccagtatcggcattgtacctttggatgttccagcacagcagccaagaaatcaagtacaagatgaagaacccgagcgtaagaaagctattgtctgttacaattgcagtacctgttaagcctagcgctagtcagaagcaaccataatactcttatatccgtgttcaaatacttttgttttatagttgttccccgtcaatcatgtaataatagagaaacatgagataaggaatgagtttggccagtttatgaagggtccatattaagattgcaagtgttgtgtgatgtgtacatctggttgatgattaaggagacctagggcctcatttccgtaagctcataatctattatgaatcaaataacctagcgattgatggcgaagaaaatcaagtaatcaaccaaagagacatttgtttggactgagagtttcagatgtgccttcttcggatcaaaggcatgcacccgttgtggagaaactggacacgttgctagcatgtgtctcacactctgcactcactatgaagaagaccattcaccaggggagtgtcccactcgcaaggtgacatgttttctgtgcgaaggtacaaaccatgtgcccaaggattgccaactcagtgtgttgttgaccaagaccgcagaaatccaacgaacaaccctacaattgtctcatcagctagtcagctccaacagcaacctcgacgatatcatccacagcaccaatgctcctcctgctccacctaactctgcaataaatcatggcaataatatcttcagcaccaaccattctctgcaccgacagcctcagcaaagaattgtcgtcgatggaagaagttgtgtctctccccgacctactccaggccgagcaaagggcaatcaacctcaggagggcgataccaagcagaagaccgttattcgcttcaaccagcaatcagaaggaagcttctcctgtgaatgatagcaatatgcagtcctatcacatcatcacagaaccaatcaaggatgatgcagtcactagaacaatgccagctatacctcttcagaatcagaatgagtagccatgtttgtgattttcagttcgctacttatcaccgtaatcgaaagtttgcagcaatcctgtaataaataaatatattcatgtctataaacagtgagcttgctatgcttatggatgattcatgttgaggatgcaatgtaccgatgttaagcaccttccctttttgattaaggcagtgcctcgtattcttgtaatatgggagaaatgtgtaataaaaacaagttctatgaggactctttcagaagatgctgatatgggattaggtgtataattgtttactgtcaaaggagacctagggtctcatttcagaggaactatgttctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcatctacattgataagttcggatacacctgcaaacagttaagaagatctaggagacatcaatatttgggaacataatagtcgatggttggtaattagtctatccggtatcagaaaagggtcgaaggtgatatggcagaagaacaatatggatgctccccatctcgaggaagcactaaagatgatcatcggcaattaaaccctagtggcatagatacagatagcaagcaatgtatttccctgaaggtagtcagtgcagctttttgacgaaccacatcaaggtttcactgaaaggcagcaagccaaagggcctcatcgtccccagaagcgtccgcaatccccattaaagaataccacctgttagagataagccgaaaggtgatcgataaaagagattggcaaagatgttctccagcatgaaagaagtaggccgaaaggtgatgtataaacagaaacatgctctgcatcgctcaaggaagacccctgatagtaatcgccccgcaacagtcaccttgtcattaagtaagcaagatgacctaggtaaaagtgtttctatgaaggcaaggagtgaaatcttcaa

SEQ ID NO: 89710 - DNA, 1924 bp, Oryza sativa
ggatttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacatcggttatctgcataacttttctgccgggactgtgccacctttagattatcccgaatggttctgactttagcttcagcttctctcaggatgtcagtcccgaacacttggctttccccaacttggtcccacaaaagcggtgtccggcatttgcgcccatacaacgcttcataaggtgccatttgtatgctggcttgatagctgttattgtaggagaactcagcataggggagactcttatcccaggtcttcccgaaatctaggacacatgcgcgaagcatatcttccaggatctgatttagacgctcggtctgtccatctgtctgcgggtgatacgcggtgctgaagtttaatcgggtacccagctcttcttggagcttcttccaaaagtgagagggtgaattggcttcccctatcagatacgattttcttgggaacgccatggagactcacgatcctagcgaagtagagctcggctagttcgttccctccataggtggtctttacgggaatgaaccgtgctaccttgggtagtcgatccactactacccatatagaatcatatacgccttgggtttttggaagtccggtgatgaaatccatcccaatttcatcccatttccattctggtacttggagtggttggagaagtccggccggtatttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgagcttcctgaagtatcaactgtttaagttctctattatctggaacgcatacccgatttccgttccatagggttccgtgttcatcctctgtgaaaccaacagctttaccctgtttcatattcttgaggagtccatgcatatccggatcattcttctgagcctcgcgaatttgatcgagcaaggtgggcttggcttccaacgcagccaaaaatccgcgactaactatgcttaggttcagggcttccatctgttgattaagttcgggtggaatgcctcggacgttaagagtgttgcaatggcttttccgacttagagcgtcggcaaccacgttggccttaccaggatgatagtgaattcccacatcataatccttgatgagttctaaccatctcctttgccgaagattcagatctgactgggtgaagatgtatttcaaactcttatgatcagtatatatttcacagcgattaccaatgagatagtgccgccagatttttagagcatgaaccaccgctgctaactccaagtcatgggtagggtagttgccttcatgaggacgtagctgacgtgaggcataggctaccacatgaccatcctgcatgagcacgcaccccaatccttggcacgaagcgtcacaatacaccatgaaatccttgcgagtatctggcaagactaacactagcgaggaaaccagcttttctttgagagtttgaaacgccttctcgcattgcgggctccacacaaatttctcttctttctttaacaactgtgtcatgggttgagcgattttggagaagttctcgatgaatcttcggtagtatcccggcaaacctaagaaactgcggacttgaatgactgtcttgggttgcttcc

SEQ ID NO: 89711 - DNA, 2122 bp, Oryza sativa
tttcgtgagctttcttaaagtatcagctgtttaagttctctgtatcgggaaacgcaaaccgtatttccgttccatagagttccgtgttcatcctctgtgaaaccagcggctttaccctgtttcatattcttgaggagtccatgcatgtccggatcattcttctgagcctcacggatttggtcgagcaaggtaggcttggcttctaacgcagccaagaatccccgaccaactatgcttaggttcagggcttccatctgttgattaagttcgggtggaatgccacggacgttaagagtattgcaatagctcttccgacttagagcgtcggcaaccacgttggccttaccgggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaagtcatgtgtagggtagttgccttcatgaggtcgtagttggcgtgaggcataggctaccacatgaccgtcctgcatgagcacgcaccccaatccttggcgcgaagcatcacaatacaccatgaaatccttgcgagtatccggcaagattaacactggcgaggaaaccagcttttccttgagagtttggaacgccttctcgcattgcgggctccacacgaatttctcctctttcttcaacaactgtgtcatgggtcgagcgattttggagaagttctcgataaatctccggtagtatcccgccaaacctaagaaactgcgaatttgagtgactgtcttgggttgcttccattcagtgacggcggtcactgtttcggggtccacagcaactcctttagcagatatcacgtgccccaagaatttgacttcggacaaccagaaatcacacttgctaagcttggcatacaattgatgttcccgcaactttcccaacaccagacggagatggtgctgatggtcttcttctgattgtgagtatatcagaatgtcatcaatgaaaaccacaacaaacttatccaagtattccatgaacactttgttcattaggttcatgaagaaggcaggagcattggtcagaccgaacgacatcaccgtgaattcatacagcccatatcgcgtggtgaatgcggtcttcggaatatcttcttcacggatacgtaattggtgatatccggaacgaagatcaatcttggagaatacagtggcacctttaagctgatcgaacagatcatcgatccggggaagagggtacttgttcttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttgacttcggccagttcatttgctgccatacggtagggtcgcttgtacagaggggtggttcctggagcaagatctatccggaactcaatctctcgcttgggcggcataccaggtagttcttccggaaacacgtctccgaactctctgactatggggatttctgacagtcctatctgatgaagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtatctagcagaatcagatccgagggaaaaggaatcccctggatttctatagggacggcagggctataatactttgctgtcataacccctccaggggtggtgatgagcagagggtttctaagcctttctacccccaactgatttctccccacgaatggcacggatataaacgagtgggaagctccagaggtcaacaaaatggtagcagggatggaatgaatgaggaacgtaccaacgatgacgtctggagttgtcagcacgtcttgggcagtcacgtggttcacacgacccggaatgacgt

SEQ ID NO: 89712 - DNA, 1627 bp, Oryza sativa
gaactcggcataggggagactcttatcccaggtcttcccgaaatctagtacacatgcgcgaagcatatcttctaggatctgatttagacgctcggtctgtccatctgtctgcgggtgatacgcggtgctgaaatttaatcgggtaccaagctcttcttggagcttcttccaaaagtgagaggtgaattggcttcccctatcagatacgattttcttgggaacgccatggagactcacgatcctagcgaagtagagctcggctagtttgttccctccatacgtggtcttcaccggaataaatcgagctaccttggttaatcgatccacaactacccatatagaatcatatccgccttgggtttttggaagtccggtgatgaaatccatcccaatctcatcccatttccattctggtacttggagaggttggaggagtccggccggtcgttggtgttctgccttgacacgctggcacacatcacacagagccacgaactctgcaatttcccgcttcatgctaacccaccagtatttctccttcaagtctaagtacatcttcgtactgccagggtggattgaataaggactttcgtgagcttcctgaagtatcagctgtttaagttctctattatctggaacgcatacccgatttccgttccatagggttccgtgttcatcctctgtgaaaccaacggctttaccctgtttcatattcttgaggagtccatgcatgtccggatcattcttctgagcctcgcggatttgatcgagcaaggtaggcttggcttccaacgtagccaaaaatccgcgaccaactatgcttaggttcagggcttccatctgttggttaagctcgggtggaatgccacggacgttaagattgttgcaatggctctttcgacttagagcgtcggcaaccacgttggccttaccaggatgatagtgaattcccacatcatagtctttgatgagttctaaccatctcctttgcctaagattcagatccgactgggtgaagatgtatttcaaactcttatgatcagtatatatttcacagcgattcccaatgagatagtgccgccagatttttagagcatgaaccaccgcggctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatctggtaagactaacactggcgaggaaaccagcttttctttgagagtttggaacgccttctcgcattgcgggctccacacaaatttctcttctttcttcaacaactgcgtcatgggtcgagcgattttggagaagttctcgatgaacctccggtagtatcccgccaaacctaagaaactgcggacttgagtaactgtcttgggttgcttccaatcggtgacggcggtcactgtttcgggatccacagcaactcctttagcagatatcacgtgccccaagaatttgacttcggacaaccagaactcacacttcctaagcttggcatacaattgatgttcccgcaactttcccaacaccagacggagatggtgc

SEQ ID NO: 89713 - DNA, 1704 bp, Oryza sativa
gtcagttaacgttgccagtgtcggtgtagctcttagggagatggacggtattgattgcctgtctggaaaggtttgggatggagattttctaaaattgttcgattgtgatatacagccaattgaagatggagagcccaaattattatttagagggcgtcgtgaagggttgaaacgtctacaccaaggacatagtagatgatctcgatgacaagcaaggacaaggtttcatgtcggccgatgatttggaagaaattgatataggaccaggtgataaaccaaggccaacatttgtcagtaagaatttatctccagagttcagaaccaagttgatagagcttttaaaagaatatagtgattgtttcgcttgggagtatgagatgccaggactcagctggcatgccaccacgacataccggaaagaggccgtgataggacccttcacataacccactctaaccaaacataccacaccttaggtttcacccccactcctcgcaaggcggcgggcagtctcctctcatgcctaggtgaatcaaaaagccgcataggccatcgcagggcccatccgaacttcatcacgctcacccttgcttggatatgtcagctagagaagagctacactacaagcccaagcgttgcccacgctggcttgtggcaagtacgaggaattttttcagggtttcccgcgaaccggtccttaattgccattagtgcgaccatcaaaaccatgcacccacagcccaccatttattttaattaaccaacaccacagcggtggcactaatccaacatcaaactataatctgaagtctatgtattagtgtgtttcccccattgtgtgctagttgaactaagcatgactaagtaatctctaatccaacatctaatcaagttacatcccaagctagcaatggaacacgataacaaataatatggctgagacagtaggttaacatcccatggtatcattataaaccaatgcaatatttaaggaaaacaatagagcatttgcaatctgggatcaacatgttcaagtgacaagcacgatttgccttgctcttcggctggaggaacctcagcgactatctcaaagtacaccggagcgtcgggagagccgtaatctatgcgacaaacaaagcaaacaggctacaagactattgaaatagagaaaaaaaccatttttaatggattctttgcatttttcttgatttatggagagttgaatgggcttaaacggagcacggatgaattttctatgaattttcgaagattcaatgtgtttaactataaaagaaaaagccttaattgaattattgcgcattaattaaccccggatgacgtcagcgaaggaaggggggcgccgacatgcgggcccacatgtcatcgacacggaggaggcgtgtcacgtcctgataaattcatcccgaaataaaaatcattttctaaaaggaataatagaattaattaaaattcgaaaagaaattggcaaacactaaaatacgtacaagaaaaattcaaatgtggcccggggaatttttgttaaattctccttggtctaaaaggagccctcaaattttagtggaattttcagagcacaaataataattattaagaaataaacaaagttaaaatggttttataaaaagaaaaatcctaaaaagtcttctttcccccccccttaccttactgggccggctcggccca

SEQ ID NO: 89714 - DNA, 637 bp, Oryza sativa
cgagctctactccgctaggatcgtgagtctccatggcgttcccaagaaaatcgtatctgacaggggaagccaattcacctctcacttttggaagaagctccaagaagagctgggtacccgattaaatttcagcaccgcgtatcacccgcagacagatggacagaccgagcgtctaaatcagatcctcgaagatatgcttcgcgcatgtgtcctagatttcgggaagacttgggataagagtctccctatgccgagttctcctacaataacagctatcaagccagcatacaaatggcaccctatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcacgccattgcgaggtgtgcacaggtttcagacaaaaggtaagctcgcacctcggtatgtgggtccttaccgtatcatcgctcgacgcggagaagtcgcttaccagctagagttgcccg

SEQ ID NO: 89715 - DNA, 3080 bp, Oryza sativa
ttcgggattcgcggggcgaacttttgtcaattaatgtcaatattggcatattttgagtccccacgggtgcgatgtttttgacgggattgaaaaacttcaaaaagcatccaaacgtgatttttagacatattggagtgtattgggtgcgttcgtggcaaaaactcacttcgtgattcgtgcggcgaacttttgtcaattagtgttggcaaaaaactcacttcgtgattcgcgcgacgaacttttgtcaattaatgccaatattggcatacgagggtgcaatgtttttaaccggaatgaaaaagttcaaatagcaccaaaataagatttttggacatattggagtgtattgggtgcgttcgtggcaaaaactcacttcgttattcgcgcggcaaatttttgtcaattaatgccaatattggcatatattgagcccccacgggtgcgatgtttttgaccggattaaaaaagttcaaaaagcaccaaaacatgatttttcgacatatttgagtgttttgggtgcgttcgtggcaaaaactcacttcgtgattcgcacggcgaacatttgtcaattaatgccaatattggcatatattgagcctccacgggtgcgatgtttttgaccggaatgaaaaagttcaaaaagcaccaaaacatgatttttcaacatattggactgtattgggtgcgttcgttgcaaaaactcacttggtgatacgcatggcgaacttttgtcaattaatgccattattggcatatattggtacacgtgggtgcgatgtttttgaccggaatgaataagttcaaaaaccacaaaaccatttgttttagacatattggagtgtattgggtacgtccgtgtcaaaaaatcacttcgtgactcatgcggctgatgaatcctgagttccacatgaaactcaaggctgttgttggcccgatctttcgatgagttgagataactacgatttgggagaaacgttgacgacccgactacaaccgtacaagacgttgtgttgcgccttagcgatcgatacacctctccgtaggttgttgatcttgccggtgcaaagcaaccctattcctgcaagcaaatcgaagaaacaagcacgaacaagataaaagcaatttgaattgcaaataggaataaatgcacacaataagttggggtttcggatacaagcagatggacggtctagccgacacgcgcgctgcaaggaagtagcaatggctaaactttcatctaaacaaaagccaactaaccctgaaggggttactagctatttaagggatgtaggaggtcagaagggcgtcctccctctgtttggagcgcaggccccccttgggccccacttgggccggggtcccagacgaaattacaggcccataggcccattacagacaatgcagccccttgtttcttcaattgccaatgactcagatagaatttgacaatgaggttggatccgttggaatgaggattccgagagctttctatcaagtactcgtgggcctaaaatgaaggccatatggagatttggcgaccgtttgaattcagcactatctcaagtggtcgaattggattctagaacgcggcggacttcatctccatctctgcatgcaccatggccgtcgtctttatcttccatatgcagccccaaataagtggattggtgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgcaatattctttgtgccctaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgtttttcctccctcccgggctcccctctcactcaggccgacaggtgggacccgtgggccccacctgtcatcttcaacctccagcccgggccggcaactgccatggccgccgaaaaccgcccacgtcgccaccattcccgggctcctcgagccctctctcgcgtgggaccgggagccatccctcttcttcacctcctcccccgtttttcccaatttttggcgccgaatcgagccccactttcgccacgatgtcacccacgtcgccggccgttgccgcttcaaatccgccacgtccggccacgatttctcctccccgagcctataaaaatggtccccgtgccatcctcccccttttccccaaaaattccgaacccgctgcactcccaaccgctctgcccttgttgctcttgcgctctgtcgctttccggcgagctccggatggacgccgacggacatgaagccgccgccgcgccgcaccgcttgcaccggcggctccggtgctctttgccacaccccggccaccgctccgttgccacaaaactccgccgaaacaccacatccaccgagcacccgagccacagctgcctctcgtcacctccagacgcgcgccaccaccgctcccgtcgctgccgcgctgcgctaccaccgccatcggcatcgccggtcctcgccgcaccccggcccctactccgtttgccctccctgcccctggaacgccgccgccgcgttcaccatctctctccgccgccaccgtcgagtccagccgcgtcgcgccgcctctccggtcgacgccgacttgagccgccacctccttcggcttcgtcatctcgagggccccgccggccctcggccgcgtctccgccatggtcgggtgtcgccggaacgccgttcccgccgcctctcgtgccagtcgccgccatcctttccgccgccagccgcctccctgtggtcgtctcgccgtcgccgtcctcggtgagaatccccaccggcccttctcctttttttttccctcctccaccactccccgtgcccgctgccgcgacgcgccgctgtcgcc

SEQ ID NO: 89716 - DNA, 581 bp, Oryza sativa
ggcgaattcgagctcggtaccctttgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgctagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattacatgtgacaagacgatcacgcgtgggcgtgattcactttatgtcaacgggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaata

SEQ ID NO: 89717 - DNA, 2044 bp, Oryza sativa
  unsure (1)..(2044): unsure at all n locations
ggcgtcagcgacctcccccaccacgagcagcggaagcgacgctcttctccaccgcatgcggcagcggcggcgacagcttcctgtggaggagggggaaggggaggccggctgataaatcctgagtcccactcgagacactcaaggttgttattggcccgatcttttagtgagttgatgataactacgatttaggagaaacgttgactacccgactacaaccgtactagacgtgttgcgccttcgcgatcgacacacctctccgtgtgttgttgatcttgccggtgtagatcaaccttattcctgcaagcaaatcgaagaaacaagcaagaacaagataaaagcaatctgaattacagataggaattaaatacaaatgataagttggggttccgaacaacaagcagacggacggtctagccgacacgcacgctgcaagcaagtagcaattgctaaactttaatttgacaaaacccaagaaaccctgaaggggtatctagctatttatggaggtgggagaactacctaggggtgcctagggtcgtgctccacctggttggggcacacctcacatgggccccatttaggccggggtcccaaatgaagttacaagcccatatgcccattataggtgacgtaacaccttgtttctgtgattgtggccaaacgatacggaattcggggatgaggctggatccgttggaaagagaactccgagagctttccatcgagtactcacaggccgaaacaaagcttgtatacagatttggcggccatttgaattctgcaatgtcgcaggtggccgaatcagattccagcacttgatcaacttgatcttgatgcgagcgacgattgtatcaatagtagtcatggtcacatcactagcaagccgaagggggaagaggaggtcgccgcacgggaaggggaggctggcgagccggaggggaagaggatgtcaccatgggagagggggaaggcaaaactagtaaaatgtgcaattaatataggcaaattagtctttactagtaaaatggcaaaactttaccatggatctaaacaccaactagcaaaacttcaatgtcaaatcttttgccgccaaaacttttgcccaaaaaatttgccacaacaaattgatctagacatgccctatataaatgatgaggggaaggggaaactattttgatccctcatggggagatcccctcgttatttgcatgtcactctaatggttatgaaaaaaattggaaatttgaaaatgtgtattaacatgtgatataacactccataaatatgcaagtttaaattcaacttgtacatctcgttaaaaaaacaaattaaacactagtagagaaacgatttttccgtgcggtcaaatgtgaatttcgcgtgcggaggttccaactgtctggaaccaagggtctgtaaaaatcactatttttgcgtgcggttagcgcacccacacgtgaaaatctgatttttcgcgtgcggggtggttatgtcgcccgcacgcaaaaataaaaaaccgaaaaaaataaaataaaaaaacccctaaccctaaagctgccgccgccgccctcctcacggtcatcgtcgtcgccgccgtccatgcgggggacggccgccgccgcgcgcacgcgccgtcgagcccggcaattccgatcgccgccgtgcgcatgccgacgaggccggcaccgccgccggatccgggcggggcacggtcgccgtcgncagattctggacgggggtagtcgtacgccgtcgcgtgcacacgccgtcacacgcacgcgccgccaagcccgccgatcccgtcagccgcgcgcatgcttgttaggacagcgccgagccgcgccatgccagacggccttgcccacacttgtttttgtccaggaagatttttctgacttagtccctgaaaaattatttcttttattagggaaccgggggtttgctagacgttttttcaccaatcaaatttggttttttttttccttgggagaaggtaatgttggaatttaaacttgaatggttgaagaggggattttttcta

SEQ ID NO: 89718 - DNA, 751 bp, Oryza sativa
  unsure (1)..(751): unsure at all n locations
cgattgactggttagctttataagcatcttgttgagctttgtctacgttttcttgtgtttctctaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcatagcttctacctactcctgatagacgcttccaaatgnatccacccag

SEQ ID NO: 89719 - DNA, 764 bp, Oryza sativa
  unsure (1)..(764): unsure at all n locations
cgctgtggatcagtattcgctnctactgcagngcaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactcacggtcagcangagtttgccacgcgacatcagtcgaagattctgtatggaaatgggcgacgacagctccaggacattgatctcngcagaagg

SEQ ID NO: 89720 - DNA, 4111 bp, Oryza sativa
  unsure (1)..(4111): unsure at all n locations
cgcctcaccccttgaangtcgatggcgnntcccgcagaagnncatcattcctcacaaagctgtttcgattttgatccagtggagagggctgctgtcggagaagctgaaggtcgaagtggatggtctgaaggactcattgcttgccagtatttgggcgtcaggaccaaactagtgcgttaatttttgctgtgtggttctttgtgagttccttactggcttgttagcgctgtgccagcagcaccttaatagaagtgaagttgagttttcagcacatcatctcaagctggcttccccagcggttacccttgtatctgcactcttatgcttgatagtaagctgggcctttcggccttttctctaaaaaaaaaatcttggttctcaaaatgaactgggaaatgattacatgctatataaataatcatatagtatttgaaaggaaatgctaagagtatcctgaaactgaccggatatttgggttgtcaaagagtgcaaccaatttccgtttatctggttttattgtcttcgcatttcctccatacagataacgcctgtgccccatcagaaaatgaggaaagttgctttcttgagtcgtcacaaactcttcgctctgcagacagaccgtgtagtccagtgctgccagtctagatgagtgcccctgatagagcataggtaggtgtctgagttgaaggaagtcgcatggagataaaaatggtttctaatccaattgttgtctgatcctcgaattaaacaaggatttcagatgcttgatggacagtaaatgataagatacacaaatgactaatccaaacaatggagtaccttgaactgtgcaagttcctcaggtgaagcgagagtatcttttgtctgtaaaagtggaaacaactggagaagaggagtcatatacttttcagcgttgtatattttaccagaggcaacatagagggaggtagtattgccaaatcccatgccctgcagcatcattccaacctgcataaactaaaccagtaagaactagcaatttatactattccataaaccagactccagagcataaaatttttaatgctttaatgcttttggcaaatcagcttactaaaatacgtctgaaatttgtgttggcatttttaatctgaaaaacgttacatagatgacatctagcactgcatattgtgccagcgatggaattgcctgtgggatgttattttgcatgaatgcacacccctcactctcccctgggtgcaactgaaccgcccaacaaattatagcctgagaagcatgacatgaaaacactaaaagagagcaggctagcaacaagaacatactcaaaagcattgcggcaggggcaaacttcccaacctctaaaggagttaaagggcacttcccattcctcctatttgcctcaggatttatcactcgaccaggtcggtgaaacttccctctccaactcctttcacgagcattttccatttcaatactctccctccagccaccatcatatatgcagcacgaaaaggctagcatatcttgaacaaaggggcataaacatcataaaacttagtgagctgaaaaaagaaatgcttagtagctaaaagagctattgcggtagaacctcttcaaagcgaaggtgcacggaaatgtacttcccaccagttaaagaactcatcttgatcattcggtcaaccatatttgttccaagcattcttatgggttcagaaaatctcaacgcctcatagttagcaaaacacctcaacgcctggatattcggtggaaccgaatgggccaatctgtttgagaaaggagcaatacgcacagtcctggcacagaaagcgagtgaagctatggtactacagaacacccttagttgcaaggatatgatgcagcatcaagggaaggaagaagaggagcacggaccctagctccaacaattttggaagcaccttttgtaggtagtagctttcagatgagaaggctttggtcctcatatttggtatcatgctgatattgtgatcaaaattcacaaatgcatcttcaggaagttttttgacaacccttatgtattttttgagcgacccaataaagtgatcttcatcaaagatatcaccaaatttgctgaaagcaataaaacgacacaagaaagaattatcctccagaaactgatgcgtgaaaactagcatatttttctgtgagttttcttcgcattttcttggactgttatttccatgctgcatttatatcagttgaaactgggatcgatctcacaattaaattaatttaaatggcactttgcttaaaagttcaaacacatatcagtatattacatagcatgagggtaaaaaaaaaaaagaggggagaccaaatgctacagcaaaataacattttttactcaatcaaattttgtgagcttcgatagaaatggaactggcaaaaacagcatctttaattagcaaagattgaaaggacaaattggagctaacagaggtctatgattaacaataaacaaaaccagaaagctagaatacatttctgaagtggaagtacaagataaatggcaaacagaggatgattgacggcacaaaaggacagggcatgccaagaaatatacttatgttaatattgcgaagaaaagaaaaggaaactaaaactgttccacttcacagttccagctaaaaaagaatgactatgctgtaaatgacaaactagtaacagaagtgaattttgctagttctctgaaggagaacgaggggaacatatgccataattcagtttatgcagacacatctggtattctaccagtaaatggagatagttacctagaatcacgccacacgctgttcaaatgaaaagctggggtgacaagagttgcattgagtaagcttgccacagcaacagcatcgcagatctgtatcgagacatttattgagatgctagaaaaaaatttacagaactttaaagatcaagattagtggtacattaattcattttcaatagttatgagctcctcatgaattgtgtggaagatagggaaagacgtgtaacaaaatggtaaataacatgttacagaacaaaagttcaaaatgtgtatatatgggatatcatataagaatttcggtatccttcattccatcaatgcttcagactgctatgatatatgtaacagaaatcataaggtttcttatcatagagcattcagaataaatttcagtaatactgaagatttgtttagtaaaaataaggatgtctctgaacttgtagacacaagactaaatgagtaaatgtatctacttggacgatttatgctgagggtaaaaacaatccagcaacttacagaaatgcgttgttgattcagaccaccatttgcttcgattatgagaaaaccatttgaaggtggtaactctgaaaagtgtgatgaggactatcagtattttttttgacaggtatgtggactatcagtataaagtgcataaccgagttttctgtcactgtctatgaatctatgatgacataaaagttaaaatccccagcagctttcgacttgggcaactctggtgtataaacttgtaaagagcgtttcaagttcacacctgatcgtctcaacttcttggtgatacaaggagcccatcgttttccagattttttgttttgtggtgtcattagctgcacaatgacaagacaatttatgttatataatatatagagttaaaaattagatctaaactgtttcaaaaaaaatctaaatgaaaaacaggtaaacactaaaaacacattacatgaccaagaacaacaacaaaaaggagtaaacactaaacagtatgaacatttgtaggtagtttagccaaatcaaaggcattgcaaccactgagaggatataaattgcacaaaccaatcaaagaactgagaggaaggtgctattttcactcgaatactgagaggaagccaagaactacaccccaaatggaatgccggtaacagatcgggcattacagttccccacggaacgagccaagaaacgcgcgcgctgggtgttccagcagctatccagggtcccaggtcactcaccgggtgcgggcggnaggtgatgngtnntgcagtacgagacgtacctcatgacgcg

SEQ ID NO: 89721 - DNA, 1254 bp, Oryza sativa
  unsure (1)..(1254): unsure at all n locations
cgcgcacccttgaccattgangtggagtcgcgcctgactgcaagncgntcatcacggaacctgtcgcggtcgtgcatccacgaggtggcggtgcccaagggctacgccgcggccaaggacgaggcggtgcacgggacgctctcgagcccggccttccatggcgagatggccaaggcctacccgttccagctcgaccccttccagagcgtctccatcgcctgcctcgagcgcaacgagtcggtgctcgtctccgcccacacctcggcggggaagaccgccattgccgagtacgccatcgccatgtcgttccgggacaagcagagggtcatatacacctcccctctcaaggccctgagcaaccagaagtacagggagctcagccaggagttctccgatgtcggattgatgaccggcgatgtcacgctgcagccgaacgcgacttgcctcgtcatgaccacggagatcctcagggcaatgctctacagggggtccgaggtgatcaaggaggttgcctgggttatctttgatgagatccactacatgaaggatcgcgagcgcggggtcgtgtgggaggagagtataatcttcctgccacctgccatcaagatggtgttcctctctgccaccatgtcgaacgcgaccgagtttgccgagtggatatgcaatctgcacaagcaaccttgtcatgtggtgtatactgacttcaggccgacaccgttacagcactatgtgttcccgattggcggctccggtctctaccttgtagtagatgaggatggccaattcagagaggataattttttaagctgcaagacacgttcacaaagcaaagtaatcaagtggatggaagaaagggtggtggacctaaagccagtggtcgaatagcaaagggcgaaagtgcctctggaaattcggacatatacagaatcgtcaaggtaggcatccactgacatttgttaatgcctgatgtattatggccttaatgggctcctgaatttaccataattttagtgttttttcccctgaaatatgctttgctttatcctaatgcaaagttgactatgttaaagactaggcaatgtttgcatatcgcttgtagatattcactcttcagatattgatgtttgatttgacattaacattaaaattttagatccttacttaattggatgaattctatctgcagatgattatggaacggaagtttcaaccggtgntggngtncagtgcagtcgtntatccctngagggccaa

SEQ ID NO: 89722 - DNA, 1258 bp, Oryza sativa
  unsure (1)..(1258): unsure at all n locations
gggccctnatgatggctttcgtggccagagnnataaaccggtctaattttagctttagcagaagagaatgtgaacaccatgccatgtcaatgtcaaaacttgacttcaacactgatgaagaaaaagataacatcgaacaggttttcagcagtgctattctatgtttaagtgaggaagatagaggtttgcctgctatagagttgatgttgcctcttcttaaacgaggtattgcagttcaccattctggattgcttccattaattaaagagctggtggagttgctcttccaagaaggccttgtaaaagctctctttgctactgaaacagtatgcccttatacctgatcattgcacttagtgttaaacttgttttattcttcacacataatatagtatggaattactatcctttgatttttgtaagttgtaaactagggacagctagggaacttttgttttgcacttcctgcattgcatctttcatcattcaatcaacagatgatctttatgtttcctccctcagtttgccatgggactgaatatgcctgcaaaaaccgttgtgttcacgtctgtcaaaaaatgggatggtgatactaaccgctatattgcttctggagaatatatacaggtaaatcgacatacgaaagtgcaattcatgcatatacttgaaattagttgaggaaatgaactacaatcccttcttactatataataattttgtgtgcactgcatttgtagatgagtggaagagctggtcggcgtggcaaggatatacgtggaatttgtgttataatgatagatgaaaaagtaagagcctacagtttcctgttataattatctttatttttcttaaatacaatttaagtaccttcctagatattcatgccaggaggtttagtgcatatttgttgactcaaataattcatcatgctattcttgataaaatgaaacttttaaaagataccaagaaaatacatatttggcccaatgcatcgtgattctgcagctgtctttcttggttcagttagcacaataaaatatgtgaaactgataactgacatactgctttactttgtttcctaattcaagtaaatgctatgtcatttgtagtaatccttctgattgtttatcacttttcatcttcaattcttttgtttatttcaactgttgtcggcatgcaaataacattaattaactaaagccagcatgatccaagttatgttttttgaaataattggacattcacatccaaatatagt

SEQ ID NO: 89723 - DNA, 2029 bp, Oryza sativa
  unsure (1)..(2029): unsure at all n locations
ctggtcatgttgagtgattttcgntaccgcagncgnncaacatggaaaatgaagctaccttacttgattcttctggagaggtatgttatttttatttatattagtgcattacacattttattcttccattgatactgacagtactgacacttgcccctgtatagactgatcttgcagaatatcataaattggggcttgatatatcggaacttgaaaagaaaatcatgtcggagatgattagaccagagagggctttgttatacttggttcctggaaggctggtacgttacacttataacctcataggttctgttccttaagaatgatttggatatatcatcagctatcaccattgtatttgtcttatgagaaacagaagggataatatatctacttctattttcatcgtttcctctgtgtactgttcctttgtttccactaagcaatttgcttcattgcaggttaaagtgagagatggttcaacagactggggatggggtgtggttgtaaatgtggttaagaaacctccacaatctggtactctccctcttgcactaagtgcatctcgtggtaataactatatagtggataccctgcttcactgttcttctagttcgaacgagaatggatcccgttcaaagccattgccaccacgcccaggggagaagggagaaatgcatgtggtgagttgaatttcacagataaatattttattgtggtcaacaaacaaaactttgttctgtagtgataattaggtgatgatcgtttaaggaaggacccaaaatttttggaatttgataaatgtaaggtatttgcaggtgcctgtaccactacctttattatctggtctaagcagtgttagaatcaacattcctcctgatctacgaccacctgaagcaagacaaaatatactttttgcagtgcaagagctgggaaagcggtacccccaaggtcttccaaagctagatccaatcaaagtatggttaacatttttgttatctttccttcggaagtaccattttaggttagcagctgaaaattacagagaatttaatatctgaaaaatgttgcatgatggtttagctgtatatgtgcacaacactctcggtgattttttttctccttttggatgccttgatcagctaactccctccaacacatacgctagggttgttattactatttctttctgcaatacattgtcgatgcatgatgcataggcagagcatacactagttctgtaatacctgtagaatcttcagctgcatattctacgctgacatatccgcatagatgcagactattgatggcttgttttgccctacccttgcaattttgctgtcaattgagctggtctattttcatgtataaaaatatatgctctggcatcatcaaacaatttgaaatcctgttctattccgtattcactctggtattctgacataattgataggacatgggtcttcaagaacctgaactagtggagttggttcataagcttgatgatcttgagcagaaactgtgttctcatccacttcataaggtactccaagtcacttatcagtcaagaaatttcttgtcacttagagattttgactgattattttgtgttgatattgtctcttagtctgatcaaagtgagcagcaactgtcatggtatcaaagaaaagctgagctaaatcatgaaattcaaatgctaaagtcaaagatgcgggattcgcaggtaggttgaatctttgcatgcttggttatttttaaacgctaaatgtgttcttactttttcctccattcagctacaaaaatttagagatgagcttaggaatcggtcccgtgttctgaagatgcttggtcacattgatgctgatggtgtgctccagctgaaaggacgtgctgcctgtttaatagacacaggggatgagctgcttatcactgaacttatgtttaatggtaccagtctaatatgattatctttgttcagttttgatganctgcttgcagtcaagcgcgaatcaaanntcaaggggcgcgg

SEQ ID NO: 89724 - DNA, 4084 bp, Oryza sativa
  unsure (1)..(4084): unsure at all n locations
gctggtattaggatgactacactcaanccncctcagaaatgtcgaatcaacttgtaggccctacctgatggatgtcatatactgttggtcaaaggtttgtcagcactatacaatccctgatgttggaaatcttgtactccgtttattttattggaaatttgttgatcgtcctctgtcaattggttctttatcttattgaatctccctatcactgtattgatattctctaatttccttagttatgtttaattgcttaattttctccatacagggggccacttttggagaggtgatagaaatgactgacatttttgaaggaagtatcatacggctggctagaagactggatgaatttctgaatcaggtatagcatcctatttatgctgctgctgccatagtgtcatcctattttacctccttttttgctgttagtacctaattcacttagacaatctgaacatctacccatcgattatggcatcttatgttcaattgcatgcaaataagaagtgcaattctggtatggaatgcccacaaaagtgtcgtgtgacattatggcctactcattgaagtcccagttcgaatgtctaaattatttcacggcaccagaaaggctaaactaggttcatacttagtttttataccctagtttcatgaatttggttcagtacaagtagttgtagtcttgcagatgatgtgaggatgacatttgcttatgccttgaaagcatcattaatagacacagcagtgttgccatcgtgtatttttaagaaaaaaaatctcaacatacaacctcacgatttgcgtacactcttttctagtcatatcatagataatgtgctgttctgcagttctcttcctcacaagcatgcaactgattggaatttggatgaacggtgattgatcattaacaaatcaacaacctaaaaagcgcatcattttcccatctgaactctgagccaactaactctgaatatgttatgacagttgaaagctgctgctcaagctgttggtgaggttaaccttgagaacaagttcggagcggccagcgacagcttacgtcggggtatcatgttcgccaactcattgtatctgtgatgaaggtccagcagttgtaacgccgtatgttagcaaagcaaatgtagttattctttttgagaaggcatgaaatgtaacccatatatcagtagaaccctgtaggtttttaggaggtaagctctctgcattagcagcccgtaggtaacgcaatttcatcagcagatcagaggcaatctggtatgcaaaaaacattttgatatatcatgttacctgtaggttttgaggcctgatgattgatatatgatgatgtgcttatgagaatttgtatgcttgttaacatacgagccagagattttgcttattcatgatacccttttttggggatgtttcttatttgccagcgacaaatcagtactatcacttatttacccttctcttatttatccacatgttattgagaggacaggagatgtataagggaacacgccaattttcagaggcaaatacacattttgggcttgtttgactcatagacattcatagccttgccaatttgtttggcaatggcattcctttgctttgctaacaaagttgcatttgccgttcaattaagccaaataatttggctacaaaccaaacaaactctatacttttctcgagtcgtttattcaaatgcttcttccaaaagttactgcccaatggtaatttaatactagctaccagtaaactaatccagaagaatattcttccaaaagtcgctcacaggctgtagtaactgaatcaagcagcagcaataatcgaatatctgagcaactaacttcaaaacatgtagtccgggagagaagaaacagctacagagaaagtaagatgctgggagattacacagcaaactaaacagctctggactacttttaagagagttctaaagacaaaattgttcttgcactacagattacatgagaaaaatggatacagattattctttttttctataatgatacataagtgatggacaataagaggccttttcccatcacattttatctccaaagaatgctcctgagcaaaactaatggcccagaaatgccaacaattttcaaagttacaagtgtggtggtgtggcttggcaaaatcaaccgttgacatatgcgcccagtttcttcttcacaaatgtaccattttttccacaactctgtatagcttgatcaacaatttggtatgctgattcagatgggggttatttaccagccgatagcatcttttgaagctgaatcacctgctgttgttgctctactggcaacgaactaagctgctcaggtgtcagttgtaggacttgctgcagaagaaccgacttaacatcgggtgtgagcttgaacaagacaagaacaactttattttgtagcgcatgaaaattatcatagtgttcagagattcggggcaattcaatgcaattccacaaaaatgaaaacaaccgtttagaacttcacataagtcatgtctcttaagattgtcaacagttcctcatactgaacaatcaaattctaaaaggataaaataacaataaacaccgggagattaaattatagggagtacctgaggcacttcgttctctggctgctggaagctaacagcagcagaattatagctccctgatggtccaccagggagcattccttgggatggagcaggataaacagctggattgttgtttacaattccaggtgtggatgttccatcctccaattttcgcaactttggatgatgagcaaactccgtcgaacgatttgcttgctcaggaaacctcatttccttctgtgctatatcaggtatagcaggtacctgtaattgggccgtactgagttggcatgtgcgggtaattaaatgaaaagtgcatattgtctacagcttgtgcctcataacttggaataacaatttagttcatctatggcatcgacaatgcctagctaagtaacttgtgctgtttgagcataaaggttcccagaggctctgcattggttatctcaaatatttggtttatcataaattaacacaaagttgattgaattacaaaggttcctttataagtgaagatcaagtcatgggtagcatgtgcatcagccaatggtagttgctgcatacccgctggcatagtaggtgtcctagggtgatgtggaataaatgggggctgttcatgcgatatcaggcttcctgaggtagcgaggtctagaggagcaacactgtaacaggcaccaaggagttgagatacaattggaggatgtatgcccaccccagactgacttccatgtggaaatattgtgcccgcaggctgagatgaatgcggatactgaggaaaattatgcagctgtgcagaagggtcctgcaggacatttgggtttggcaagcttgcagaaggtcttggaacacttgatatcatagcatctggctgtggaaatggttcgcttatgtgagatgatgattgtgccaaggagctagagggctgttggctctttgccatctgcatctgtgatttgaataaaacatcggttatctgtatgttacagaatcaaagaatacattgggtaccacaagctcagaagaaaatcagactataccatctggggcgtcaccattccaagcattatttgtgactgcattataagaagggagaaaaatgaaaccattaggcttttaatctcttattccaattctagatttagaactgaacgatgtgcaaataatccagtcaataatctgaaaataaccaagactaagaagtattctaatgtataaaaatgaaccaattacaaaatcagctcataacaaacaataagcagttgattaagtacaaaatcaatattagcaaaagttaacctgaaatagggcctttgacagctgtggaattccttgcagcagattgttggcaacatccttattttgactagttaaggactgccataaaaaaaatacattaataaactgcaattggtgcttgggcatttctaatatttaagaaacaatagtgcttaagaattcaagataaccttca

SEQ ID NO: 89725 - DNA, 2333 bp, Oryza sativa
caatagaatctctagcaaacccaatccgatctcaaggaatcctataaatcaataatattcattgttaaaagcatgcactaactacattaccgtattgaagctagctaatatctaatacacaatgtttatagtagtatattgaaagttttctgcatatagtgatatcaaacaataccactgcattataatctccagataattagaacaaaaacccacactgacatgtacaacaatgtataaattgcgctatttttcaagtcacacatcagtcaactgtatccagctgcgaacttgtgatgcacattttcttagtgtgctcattgacatttggcaacagaagattggtccacttatatcagcattagtcactggtatgggatggattcaaaggctggtgttgatagcatctcagaagattaagaatatttttgtgccagtgcagtagaaaaccaaaagaaactgtaaacccttctgcacatacataaaggtctcatttggaatttcctggttcatgcggaaattgaattatttctttgtgaaattccctgcatatcaaatggttctaaaaattcaattgggtactgtttcagcactcaattctactagcagtttcatctttttgctcaagtatatcgcataaggtgaaactacagatgcatctttcctagtgactactattcttcttttgctatttattcagaacacttttggcgaagctcttccaatgaagatatatggttttgctaggcaacaaacagcctttggcagacggattccataaataaaaggagatgtgacaacagagatattcttttttataaatggagatgccaaagataatgcgccataccagaatgataatttcacgagataaattggcagatatagcacgtgtgtgtatgtacagccaggcagctgtacatacatacacatgcttgaaacaaaagtgaaacatacgacacatggtggttggagaaaacactactattatcattcatgggaaccaaagcaatacaagctcttatcttaacataggaattggaagttgagaaatgtgtttcttctacagtagaaactgaggatcttcgactttttctctgtttctgtcagcattcctcccattttcagcaaaatcaacacgtaactgacggccattaatttcataaccttaaaggttccggcgtgcacttagagcagtctcctcatccttgtactcacaaaacccataaccctttggcttccctgtttctttatcaataaccaatctgcaaagcaccaaatgtttaagagcttatgagtagtcgaaactatcttaccacgtgttaccagattaaaaaacacttgcagctgctaggaaacttggcacattcctatgttcagagttatcagcgatattagtagcaccatgtagttcagccattaaacttcaattagcgattatttttaaatgtgcacggtataatgttatttcatagaaaaaaaagtgtgccaagcattatgtccataccagataccactgacccctgaactccttattatgtaaggagaataaaaggcatgaagttatttttaaaaacagacactagcaaaactttagtatccaacacacgtctgtctgaatcaaatccaaatatttgcagaacctatttagcttaactctaaccatcctaaacaccaattccacacacacacaattttgagggtttgtgcagtacaattaaacctgaatgagaccacagggccgacttcctcgcaaatctgcacgagctgctcctccgtcgcatcgtaaggaatgttcccgactgcaaccaaaattcaacaaccaacaaacgcatccgtcaatcgaaagggcacgagcagtaaaccctagaccaaaccaaattggtcaaacactaaaccctccccaaatctagcaccgcaaccgagcaaaacgcgcttcattttcctcctcactctcatcgacccacacccaaacgaagaacgaacaatcccactacggatcgaggagagcgaggcggctaggctagaaatcagccgaggcccaaatcgacgggaaggagccgagccgcctttgctctctctctactccgcaccccacgcacaccgtgagctccctccccggagctcagctcaggatcgaaccatgccgaagacggcgagagggaagcggggggtagggggcccgtaccgaagacgcagcggttcttggcgccggcgggggccgcggcggccatgctcgttagcagaggtcgccggcggcagggccgcggaagcggggcggcagcatccgcggcgcggcgttcggggtggcgacgcgggagatcgatgtgggg

SEQ ID NO: 89726 - DNA, 2317 bp, Oryza sativa
  unsure (1)..(2317): unsure at all n locations
cctttccccatggtatcagagctctgatccgttccttgcgatcagtctccaatggcgttgtcgtctagctcgacgaactccatatcactttcaggcccccttgatcacaaagaagctcgggaagccaaatcatgccctttggaaggtacaaatcagtgctgccgtcagaggagcacggcttcaaggccatctgactggtgcgacgaagaagccaccggcgaagatcagcgtcacggtagatggcgccacaaacaagacggcgaacccggtgtacgacgactgggaagccactgatcaacaagttctgggcttccttctctcgtccttgacgagggatgtgctcatgcaggtttcaacctgtgaaactgcagccgaggcttggagcgccattgaggggatgtattccactcatactcgcgccaggtgcatcaacacgcgcttcgctctcaccaacacgaagaaaggtaacatgacaactcctgagtatttcgctaaaatgaaatctctaggagatgagatggcaattgctggaggccgccccatcgatgaggaagaattgatccagtatatcatcactggactcggagaaggctacagtgaggtcatctcagctatctgcgcaagggtagagcccatctctgtaagtgatctgtattcataggttctcaacttcgaagcacgacaagccatttatagtggaacgcaagaggtcaatcttgcgaaccgcggcaacttcagccaaggtgggcacagcgacaacagcagccgtggccgcggcaatccgggaggtggtcgtggtcgcggcaacccaggaggaggacgaggtcgcggtcgcacgtctggaggaggcgttgacaagaggcccatctgtcaattgtgcttcaaacgaggacacacaactaccgactgctggtgtaggtatgatgaagattttgtccctaacaataagcatgttgcaacagcggctaccagctcctatggtgtagacacaaattggtacatcgacatgggtgccactgatcatattactggggagctggacaagcttactgtcaaggaaaaatacaacggaggagaacaaattcacaccgcaagcggagcaggtatggatataagccacattggtcatactgttgttcattcccctagtagaaatattcatctaaagaatattttatatgttccacaaaccaagaaaagtctcatttctgtacaccgcttagtagatgataactcagctttccttgaattacatcgtgattatttctttcttaaggatcgaatcaccaggagaacgcttcttagtgggaggtcttggcgccgactctatcccttgccgcaatcatccttgaaggaagcctacaatgtcgtgaaaccctcactagagcggtggcatagtcgtttgggtcatccatctatccctattgttaaacaagtcgtcaataaatttagccttccttgtttagatgcttcaaatgagtcagtttgtaatgcttgtcaacaagcaaagagtcatcaattaccttttcctgtgtcaacaagtgtctctcagcatcctttagaacttgttttttttatgtatggggccctgctccagaatctgttgggagaaagaaatattatgttagttttattgatgacttcagtaaatttacttggatctatcttttacagtacaaatctcaagtgcttgaaaagtttcaagaatttcaggccatggtagaacgtacatttgatagaaaaatcttggctatgcaaactgactggggaggtgaatatcagtctctcaattctttctttactaaaatcgggatagttcatcatgtatcatgtcctcatacacatcaacagaacgggtctgctgaacgcaaacaccgtcatatagttgaagtagctctctctcttttgtctcatgcgactatgcctttaaaattttgggatgaagctgtgcaggctgccacctatctcatcaacagagttcctagcagagttatccaaaatatgagtcctcttgaaaaattgcatcatcagaaacctgattacacctccttgagagtgcttggttgtgcctgctggccaaatctccgtccctacaataaccataaactccaatttcgatctaagcggtgtgtcttccttgggtttagtaatatgcacaaagggttcaagtgcttagaggtgtccactggccgtgtctatatttctcgtaatgttgtttttgatgaaacaatatttcctttttctgagcttcatgccaatgccggcgctcgtcttaggtctgntgnngnngtgtcccgatgttcgtacttnntacccc

SEQ ID NO: 89727 - DNA, 1835 bp, Oryza sativa
  unsure (1)..(1835): unsure at all n locations
acgcccatgagtggattccccnnctactgcaagnagntcatcagtgcctcaggaccacgttagacctcgcatcaggttgcaaagtggggttcgcaaagaaaaggtatacactgatggcactattaaatacaaaaactcctggtttactgagtctggtgaacctactactgatatagaagcattaaaggataaaaattggaaactagcaatggatgctgaatatgaagctctagtaaagaataaaacctgacacctagttccacctcagagagggaagaatgtcataggttgtaagtgggtttataaaattaagaggaaagctgatggtactctagacagatataaagctagactagtagcaaaaggttttaagcaaagatatggcattgactatgaggatacctttagtctagttgttaaagctgctaccattagaattattttgtctttagctgtgtctagaggatggagtcttagacagctagatgtacaaaatgctttccttcatggttatcttgaagaagaagtgtatatgcaacaaccacctggatttgaggatccaactaaaccacagtttgtctataaacttgacaaggccctatatggactaaaacaggctcctcgagcatggtttgcaaggttaagtaaaaagttgactgatcttggttttagtggttccaaggctgataccttgttgttctttctgaatagaggtggtgtcactatatttgttctagtatatgttgatgacattattgtagccagttcttcagagagggcaactgcagctctgcttcaagacctgaaaggggagtttgccctaaaagatctaggtgagttgcattattttcttggtatagaagtgagcaaggttgagaatggtattgtcttgacacaagacaaatatgccaatgatctattgaaaagggttggtatgtcagattgcaaacattcaaacactcctatgacagtaagtgataaactctctctgcatgaaggatctcttttgggagatagtgatgctacccagtataggagtatcgttggtgctcttcaatatttaacccttactagacctgacatagccttttctgttaacaaagtctgtcaattattgcatgcacctacaactgtacattgggtagcagttaaaaggatacttaggtatctcaaacaatgtacatgtttaggacttaagatccataagtcaggttctactctagttagtggtttctctgatgcggattgggctggtagtttggatgacaggagatccacaggtgggtttgctgtgtttctggggtcaaatctagtatcttggagtgctagaaaacaagccacggtatctagatccagcacaaaatctgagtacaaggcaattgcaaatgcaacagcagaaattatgtgggtacaaactcttcttgcagaattggggattaaaagtcctcaagcagcaatgatctggtgcgataatcttggagcaaaatatttatcagcaaatccggtgtttcatgctagaactaaacatattgaagtagactatcacttcgtcagagaaagggtaagtcataaacttttagagattgattttgtttcctctggtgatcaagttgcagatggttttacatatccgttgtcagaatggttcctggncnggtggtgnngtncaaaggagntagtcaatncaccgacatggggggggggagagttagtgtatatcccgagacatataggaaaacagaccgtttatatataaccgcgtcactntttattataaacgtgtcatttgtagatcacacaccactgtttatgtaacggaccacttattaacatag

SEQ ID NO: 89728 - DNA, 739 bp, Oryza sativa
  unsure (1)..(739): unsure at all n locations
ggttagctttataagcatcttgttgagctttgtctacgttttcttgtgtttctctaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcataacttctaccgactcctaataagagctgntcactcnnccatca

SEQ ID NO: 89729 - DNA, 1787 bp, Oryza sativa
  unsure (1)..(1787): unsure at all n locations
agagctttagaagaagatggtagaataattgaggaacctgcagaactgaaagctcacatatatcagttctataaaaatctgtttggtgctgaagttgccccaaaaattttcctaagtcaagatatgtggatgcatagagggaggctaagtcaagaagagagagagcatctaatcagaccctttacctttgaggaaatggatcaagctttaaaacaaatgaagactgatacagcccctggtcctgatggattcacagtgagcttttacagagccttttggccccagttgagggatcaatttaaagaaatgttggatctactatttgaggggagactggacttgtggagaataaactatggtgtgattagtttaattcccaaagttaaagatgcaaacactatcaaagctttcagaccgatttgccttttgaatgtctgctttaagctaatcaccaaaattctgaccaataggctgacgctagtagcacataatgtaattggggagagtcagactgcctttattcctggtagatttattttggatggggtgattattttgcatgaggttttgcacgaagtgaaaaaaactcaccaatctggcataattctaaaattggattttgaaaaggcatatgataaagttcagtggagtttcttgtttgatgtgcttcagaaaaaaggttttgatgataaatggatcaagtggattaagtcagcaactattgatggaagagtagcaattaatattaatggggagattgatcaatactttaaaactttcaggggagtcagacagggggaccctctatcacctttgctttttaacattgtggctgatgccctttctgagatacttttaaaggccaaagaggctggtcatctggaaggcttggtacctcacttagtgcagggggggctcacgcatttgcaatacgctgacgacgctatcctgttcatgaccaataatgatcagaatgtgataactactaaatttatccgactctgttttgagcccatgtcaggattgaagatcaattaccagaagagtgaggttatagtccttggggagagcccagaagagcctaagagagtggctggcctttttagctgcaaatgcggtaagttccccatgacttcccttggcattcctatcagtgagggaagcctgacagcagcagatctggctattccccctgataagattgagaaaagactttcaacctgcaaatgtggtttactttcttatgggggaaaagcaaaccgtgtcaattcctcacctatgtatatgatgggctttaatatgctccctgaacaaacccatcagagaatggattctattagatcaacatttttttggaaaggaatagaaagaaaaaggaagtatcccatggttaaatgggaggctctttgcagacccaaagattttgggggcttaggttttcttgatactagagtgatgaataaggtacttttgtgcaaatggatttttaagcttgaatcagggcagaaggacccctgctgtgatttgctaagaaggaaatacatgatgaatgggggaggctttttccagtcaagtactgagggatgctctcaattctggagaggtttgcatgaggtaaaacactggttgaaattgggcagctgttatgatttaggggatggcagtgctactagattctgggacgatgtctggctaggagatacacctctgaaaatcaaatttccctacatttacagtatagtggctgttctgntgnggtcgagtcgaatgcatgtcatnntcaccat

SEQ ID NO: 89730 - DNA, 723 bp, Oryza sativa
  unsure (1)..(723): unsure at all n locations
ttattagcatcttgttaagctttgtctacgttttcttgtgtttctcaaacgtcatcgtttagtttatacgtatctgtatagtcacgtagacgtaaaccatttagccaagatttttcacctgttgtatcacggttcaacaagaatccaagttgaataaaacctgtttctactgggataatcgttgtattagcaaactcagaagagccactaatcaaatggctgtacttggtgtacgtagtaggtacttgtatatttacgtgaccattcaaatacaaatatgtggagccgtcagaagttgggctaagtgtatgccctactgggaaaatcccatctgaactatttgggtttgcaactgcccatggcttgtttaacgtaatcttgttagctgtggtgtcaactgcaccaatatcatatgtcctcatctgcattagctgactatacgttccatcgggataagtatagccgaacgagtttttataaccccacatgataatactacgttggtagtcttgcggtgcctgtccgttccatagactaacatcttctacaaaaacctctgtatccccgactttaagtggttttgctagttttgtaaatttaacaggggtagtagagttgtagtttcgtcccccaagagaagggtacgtaatacggttaccatctacgtcatatggggcaatcatagcataacttctaccgacncctataagcgttttactcatg

SEQ ID NO: 89731 - DNA, 725 bp, Oryza sativa
  unsure (1)..(725): unsure at all n locations
tatgggnnnnattgatagcacctactcgtaggnactgaagttcatcatacctcggttaccctctcctcgtcggcaaggagaagggcccaccgatcggccacgatctcaaggtggtccacagttccaacatccgtcgggtggccccctcgggaaagccccggagggcanttncattgacggcncttcttacgngngnggnctcggccnaaggggnnaaccgggcctttccggnaaaaatttcccaaaaaaaaccccaaatttttttttgggggaaaaaccgacgccgggacgagcgccgagctgcccgcatgggggaaggcgccttctcatttagagtgccacgctccccttcacgaggcgggccttcccctacagtgaccctggggggacaggttgtagggcctttgtggcgagtctcccgaatgtccggtggccccgaagtttcgccccaaccttacggagaagtatgatggtagcatcaatccctccgagtttcttcagatctacaccacgattattggggctgcagggggtgatgacccggtcatggcgaattactttcccatgaccctcaagggtcacgcgcgtggttggttgatgacccaagcccccgactccattcactcctgggaggatctgtgccacagttcattacgaacttccagggcacatatccccgtcccggggaagagacggacctacacgctgtacaacggaaggacgac

SEQ ID NO: 89732 - DNA, 708 bp, Oryza sativa
  unsure (1)..(708): unsure at all n locations
gtgccccccaaggagcttagaaatgtccagtgcgtcactgaatgcatgcccgccctgagtcgatttatatcgaggctgggtgagagggcgctacccctattcaagctcctcaaaagctctgggccgtttatatggacggagaagctgagcaagctctcaatcagctgaaacgcccttttttttttaaaaacccccccctttttccccaaaactctttttacccccccctgggtctttggtagccccggggccgaaggaaccattgctactctacttggccgcgacccctcatgtggtgagtgccgccctaatagttgagcgtgaggaaggcgaacgggaggcccctccggctcgcaacggcccctcgtcccccgaaggcctagcgcccaaagctcccagcccccgggaggaccccgaggcccccgagggaggaggggaggctttggcaggtggccccgagccttatgatcctgaggcaatccgggatccccccgggacctccgaacaggcgcgccccggatcatctacccctgacaacacgaaccggccccgccgaaaggtgcagcggcccgtctactttgtcagcgaggcacttcgagatgcgaaaacccggtatccgcaggcccagaaaatgctttatgccgttttgatggcctcaaggaagttgtataanctactgcagcaaagcgaatcaccatcaaggggcca

SEQ ID NO: 89733 - DNA, 1020 bp, Oryza sativa
  unsure (1)..(1020): unsure at all n locations
cggcgcacccgtgattgacgattagttcagaaccncatcatgctttatgccgntttgatggccctaaggaagttgcgtcactacttccaagcgcatcaagtttccgtagtgacgtcgtaccctctcggccaaattttgcacaaccgagagggtactggacgggtggtaaaatgggccatcgagctggctgagttcgatctgcacttcgaaccgcggcacgcgatcaaaagtcaagtcctggctgacttcatcgcggaatggaccccagtggatgaacctgttccatccgatgtccctttcccccctagagaggaagaggatccaaacgccgacattcgcggcgggcactggattatgcatttcgatggctccctcaaccttcaggtgcaggtgccagagtcacactgacctcgccaagcggagacgtcctcaaatacgtcgttcgactcgacttccgagccacgaacaacatggctagaataatgaaaggggctttcccctttttttggggccccgggggggggggggaaaaaaatttttttagggcggnaccagaatgggcatccgccatctcctggtcctaggtgactcccagctggtcgtaaatcaagtatccaaagagtatcagtgcaccgacccgcaaatggaagcatatgtctacgaagtacggcgcatggaacgccacttcgacggacttgagctccagcacgtgccccgacgcggcaacacagttgctgacgagttgttgcgtgttgcgtcggcacgagccccactccccccagggactttcgaagaaaggctcgcgcaaccatcggcgcgaccgaaccctttgagggaccccaacaacacgccctccaaccctggtatggatgaccgacatccggggtatctcgacggcaatactcttcataaggatcgcgcagaagctgaaaaggtcgcgcgcatctccaaacggtacgtcctcatagaagggtgatgaacgncttgcagtcaacagagagacaaacaaaggtggcgcat

SEQ ID NO: 89734 - DNA, 1251 bp, Oryza sativa
  unsure (1)..(1251): unsure at all n locations
atgtatacaaccaagtnanaacagagtttaaccaaacantcaggcttcaggttccggaaccttgcagtgtaaacctatttttggctgatctacctttaaatattgtttccaactagtagttggtatcgccatatgtgaatctccaactattcagtttttttcagaaattttttttttttttttttgggggggcccccaaaaggggaattccttggcttttagggaagtacattgaagaggttcaagcggcctacgaacaccataagcatgataccctggtttgtactatttttttcccacagagatatgcatagtatccatcatctatgcaggatacattgacactattttttcatcgagcaggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaatcgcagcaaactccgcagcctcaacctcaggtccacccttaaccacagcagccttcacagctgcaaccgcaacctcagctttttcagcaaccgcagctgccccaacagctgcagccgcaatctcagctccccccacaaccgcagcagcccccacagctgcagctgcaatctcagcttcacccacaaccgcagcagcccccacagctgcagccgcaacctcagcttcatcagcaaccgcagccgcaggcagagctgcaatcacagtcacaaccacaaacagaacatggcttggacagttcatgattcagattccatgttgtgtagcctcagtataaggaaaagttggtgtacttccgctggcatttaactagagactcttgtggtggccccccccccccttttttttgggggaaatttttaaaaggggggggttttttaggtttccatgcttcatgtacaatgtaaatccagtgtgatttcagttaccatgttgctaataatctnaaactttctttaatcactgaannnnnnttcattcagtttcagccttgntnttactctatgactgnnnnnnnnnnntcgnatttcnccnatcatatcaagggttat

SEQ ID NO: 89735 - DNA, 697 bp, Oryza sativa
  unsure (1)..(697): unsure at all n locations
tgtgtgtaannatttgactacagttggtacagtagttcatcactattgcctgacttgttttaagagaaaaggcaaactagatgttttcccacctgccattctggggatcaaacccgggtggtgcatttcagccccacaccttcactactggggacattgacaaattgttatggtttgctgaacaaaagttcttgtgaagtgataactctttagtgctacagaactgaattatgtcagccactaaataaaataattgtgatcactcttacggaaaggctcttctcgtactttcaccactgaggacattgacaaaatgttctggtttgctgaacaaaagttcttgcaaagtgataactctttagtgctagagaactgaattatgttagccactaaataaaataactgtgagcactcttatggaagggctcttctcatttataccttgtcattgactctgcagctgagatcttcctgggacattgcatttctgcagtgtagaagaagatatggtcgatggattcccctatgaagtgccagaagaatacagcagcatgcctcttctcaaaggaagggctaccgtggacatgaaggttaagattaaggacaatcctaatttagaggattgcgtatttcggattgttctggatggatacaatgctcctgtgactgctgggaacttcttagatctggtggaacg

SEQ ID NO: 89736 - DNA, 716 bp, Oryza sativa
  unsure (1)..(716): unsure at all n locations
ggtgtnnaattgatgatcagtggtacagnagnncatcacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctgtttgtcctcgtcccacatggggacaccttccttcttccacaactgtttaagatcttcgaccagtggtcttaggtacacgtcgatgtcgttaccaggttgcttggggccttgaataataatcggcatcattatgtactttctcttcatgcatagccagggggaggttgtagatacacatcgtaacgggccaagtgctatggccgctgctcatctcttcaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtattcgagtgctttg

SEQ ID NO: 89737 - DNA, 535 bp, Oryza sativa
cgagctcggtacccatgcatttttaattcgagatgtgcactagcaaggaagaaatctttcatccagtgattcttgatatttaagttgttcaaaatgtcactgctagtgcagagagattgtaactctaaccaagcactccagttccaagggtagctgttgacagattccaccagaactgttctagctagagcttcactgcctttatcacgtagaacaatgccatacaagtacaaacaaaatgaatcaatagcaccagttctccgatgtgttgcgagctctctctccaatgcaactagttcctgattaacagcattgcttttgcccagagatccctcaagctcgactgtttcttcctctttccgtttctctccagcctaaattgtagagaaaagaactatgatcaccaagcatgtcaaatttcaaaatgctaattaaactatgaagcaaatgggagacagtttctagtatttagaagattagataacctgtagaggaaaagataaatcatttaatagaatccttccatggataagaa

SEQ ID NO: 89738 - DNA, 710 bp, Oryza sativa
tttgtcgcatttgatccttcctttgttaattgctataccatgtccccttgtaaccacccagttgcgcctcgatactcgtgcactctgtgcaagtatcgacggtcgccttcaaacttaaaatctgagtaacaacttgggtaaaactggagttttacaaaagacttggaaaacccgacacctgggtcggtgcttgcgaactaaatggattttccaaagccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtcccccggcgtggctgatccccacgggctgggtgacccgggttagtaatgtcatgtgggtaaagtgtaccccctctgcagaggttaacaaactgttcgaacagccgtgcccacggacatgggcggatgtgaggtgattcctagcgtagttttgtttgtctactgcttgtgaaat

SEQ ID NO: 89739 - DNA, 1227 bp, Oryza sativa
tcccatattcatattgatgttaatgaatctagatagatatatatgtctagattcattaacatcaatatgaatgtgggaaatgctagaatgacttacattgtgaaacggagggagtattcaaaaacagccatctctggagttcacttgatggtactgagagaagaaggcactcttgcatttcatgatatagtaatactgaggttcaatgtcctgggtacctcagaactaacacatctagttcagcaaattctacaatagtagattcaactagcaaaatttccagtacagtaatagtgcaatcctgtgtggatagagtgaaatatcacaaatcaaacaagcatacaaattcatacacaacattcagtaaaagagaacaactacttaaaactttacaaacagaggtcaccgaaaccaatatatcactacacaacattaattttacagagtaataaaatgtatgcataaaaaagaaggccaaacaccaatcaaactgtgaaagacctatctgaatcctgatcccgtgcagtaactttaactggaataacaaatccaatccacaaaacagtctaactcaattgctcaaaccgaggacaattccgtaacaaatccgatgcacaatttgtagttcagtgcatgtacaccacaatgtatcaaaccgaggcaagactatcgagcacattggatgcgctatgcggcaaaaacaaaacagatgggtacagccgtaccttgtccccagccgtggaagtggcagcagcgcctgattcctcctcgtcgtcgtcctgatcaccccacgaagcagcattcatcaccctctcgacaccacgtaaatccacaaaaacctcgaagcggaagcagaacgcgagggtgggaacttaccagggaagtgagcgggtagaggaagaggacggcgagcacgggctggggcaccatggcgagcagctcgtcgtcgaggccgtagacgtcgcagaactgcgcctccccctcggcgactcccagcccccacatgaactgcgcgacacgagcggaggcgccaaccccgcgacgaccggtgaggcggtgagtgtggaagaggaggaggaagaagaaaagaagagcgcgcgggaaaccctagcgatggacgcgagggcggcggaggagagagaggcgctcacctggttcatgacgtcggggttggcctcgagagggatccaccgcttccccatcttctcggcacgcggcgaggaggag

SEQ ID NO: 89740 - DNA, 529 bp, Oryza sativa
  unsure (1)..(529): unsure at all n locations
cgtcagcctctgcacgcgtctgtcgcccgtgtcgtcgcgccgctccaaaccgccccgccgtcatcgccgtcgtcatcgcccgtgtgctcgctgtgcccgtatcgccgtggtcgctccgccgctcgtcgccgccgcccgccgtccattcgcggccgggtcgtcgtctacctcccgccggcccgcgtggcatccacgtaggcgccacgtcggcgccagcttagccagaccgggtcgggccgaccccggttggtccctccgcgtgcgcgcgatccaccgcgagccgtgaggctgcgcgtgggcccgcccgacgtgcgtncaccgcggaccgcgcgcatgcactgcgtcctcttcccgcccgcgcgcgtgcgtcgcgtgctccctccgcacggtgagccgagccgctgacaagcgggtcccacccgggaccgcgcgtggtgagcccggtccaccggctcttttttcctccttccgcgcgcgcgcgagtttgggcccgcttggccggccggccatttagctcggccggaccgct

SEQ ID NO: 89741 - DNA, 1524 bp, Oryza sativa
agcttcccattctttcatatcacaagcttttgtgaaaagaaatggttggaaaacccaaaatttgcgtgtaccaatgatagtacattcccctggaaggaatataagggcaactcaaatatgcccggaagttaaccttagaattgaggaagttgacttcctagccaaaccgatagtcctagactcgcaaagcttggatatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccctggagtcggtacccatagtctgtgaatatcccgacgtatttccagaagaattaacgagtatgccaccagaccgagagattgagttcgccatagaactggcaccaggcactgcaccaattgcaaaaagaccataccgaatggcagctaatgaattagcagaagttaaaagacaaatcaaagaactggaaagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcactaatgctccagcattcttcatgaacttaatgaacaaaatcttcatggaatacctggaccagtttgtcgtggtgttcatcgatgacatcctgatatactccaagaacgaggaagaacatgttgaacacctgaggctgataatggaaaagctcagagatcatcaactattcgctaaattctcgaaatgcgaattctggttggaccgagtagcatttcttggacacgtgatttcctccaacggtgtcgaaggggatcctctagagtcgaagctgtacttgcttggaacccgcccaagaacgtgtcagagatccgcagcttctttggcttagcgggatattatcgaagattcattgaaggattctctaagctagccagacctatgaccgagctgttaaagaaggaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcttaatgcaagaacgaaaggttgtggcttatgcatccaggcagctcaggcctcatgaagtcaattatcccacccatgatctcgagttggcagccgtggttcatgctcttaagatctggaggcat

SEQ ID NO: 89742 - DNA, 1494 bp, Oryza sativa
aatccactatcatcctggtaaagccaacgtggtcgctgatgcgctaagtcgcaaggcctattgcaatgtagctcaaatacggcctgaccaagatcatctgtgcagagaattggagaagttaaggctgaccgtggtacagtcaggagtccctgccagcttgacagtacagcctaccctagaatcgcaaatccgggaggctcagaaagatgacgaagggataaaagagttaataaaaagaatacaggagaagaaggacaccaatttctccatagacaatcaaggcacagtttggtgcggtccacgcatctgtgtaccggccaagaaggagttaagagatctcatcctaaaggaagctcatgagtccgcttactccattcatccaggaagtacgaagatgtaccaagatatcaaggcatacttttggtgggctggaatgaagcgagatgtcgcagaatacgtagccttgtgtgacatttgccaaagagtcaaggcagagcatcagaggccagcaggtctgctgcaacccctaccgattcccgggtggaaatgggaagagatcggaatggatttcatcaccggtttgccaagaacccccagcgggtacgactccatttgggtaatcgtggaccgactcacgaaatcagctcatttcgtgccagtgaaaaccacctatgatggaaagaaactagcagaactctacatgacccatgtcgtatgtagatttggctgtcccaagaaaattgtgtcagaccgaggcactcagttcacctcaaggttctggaagcagttgcatgaagccctcggaactgatctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgtacggaagaaagtgccgcacccccttgtgctggaatgaggtgggcgaagcactggtattcggtcctcacatactcaagtcagcagaagaacaagttaagctgatacgagaacgtttgaagacagcacagaaccgtcagaagaattacgctgacaatcggaggcgtgaccttgagttcgaaaaaggagatcatgtgtacctgcgggtatcacccctccgtggtatgagaaggtttgggatgtccggcaagttagcaccccgctacatcggcccctacctcataaccgccagacgtggcgaagtggcttatcagcttgagctacctgaaggtctcgcagatgtgcacaacgtgttccacgtatcccagttaaagaaatgtattcgagttccagaagagcaagttcccctgggtaatatcgagctggaaaagaatctgacctacaaggaaagaccgatcaaggttcttgaagaggcagaacgtcagactcgaag

SEQ ID NO: 89743 - DNA, 1707 bp, Oryza sativa
caatatcaatatttttgcacttcacacatggttcattgcttgggacaattttggagcacgatgcctcactagggagagagacactactctttaaggtttcgaacttctcttcaagggagaggtaagctttgtccaagtcatccactgtcacgcccagaaattcccgaatagaattccaagcagaatgtgcattaaaatccccatccaggaccggccgaggtacacaaacgacaatgttgacattcagatccatgtcttacaaacatcataaaagtcttacataaatgcagcggaaaaacgaaagacaacaggagctaagccttgactagaactgcagcgggaacaccactccacaggcatcctcgacggcacggacgaaacctactcctcggagaaacctccatttgacacatactcgtactctggggctggggaaaaaatagagcaagactgagtactacccactgtactcagcaagtcataccggaataggggtatgatgcagggaattatcaaaggagagctagagtggttcatttgcataaagcgagcatttataaacagaagttgaaagaattaaacagttgcaataattaattaatattgatcatccgctgtccaacgctatcccacgttgcaacaggcccaaccatccacctatactatccaatttcattagactaaactagggtaagactaatcacggtgaatctagttgaccgcccataaccgcgggcacggctattcgaatagttttactctgatcagaggtgtacaactgtacccacaagacacagccccacaacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaactgccatgggtgcgactagcaaaaccatgcacccacagcccaccatgtgattcattttaattaaccaataccaaaacggtggtactaaaccaaccttaccaattgaacctaaagtctatattttagtgagctttccccattgtgtgctagtggaactaagcatggctaagcaattcctagtccaaaatctattcatgttataacccaagctaacaaaggagcatggtatcaaaaatggcatggctataacaataggtaaacaccccatagtaacattataaacaatgcaatatttgaagaaaaccaatagagcatttgcaatataggatcaacatgttcaagtgacaagcatgacttgccttgctctgctgctggagaaacctcggcgactatctcgaagtacaccggagcggcggaagaaccggaatctagcgacatacaaggaaaacattacaaacaggctataagactactgaaacagagaacaaacatttttaatggattctacacatttttcttgatttattgagacttgaatgggcttaaacggagcacggatgaattagttatgaattttag

SEQ ID NO: 89744 - DNA, 1348 bp, Oryza sativa
tcagatttttgtgaaataaatggggtgttgacaaagggtgataacgaattttcatgacattgattgatgatgctactagattttgctatgtgtacttgttgaaaacgaaagacgaggctctagactattttaaaatttataaggcagaagttgaaaatcaacttgacagaaagataaaaaggcttagatctgatcgtgatggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacaccgcgggactgcctaaagcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtcgactgtgtttttctgggatatgcttatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaatgacggctaagtcttttggtgatgatttcactgtgtacctcgtggatgacactcctaagtcaatttcagaagcatatgcatctcctgatgcagactactagaaggaggctgtccgtagtgaaatggattccattatcgctaacgggacttgggaggtgacagagcgaccctatgggtgtaaacctgtggggtgcaagtgggtgttcaagaagaagcttaggcctgccggtactattgaaaagtacaaggctcggcttgttgctaagggctatactcagaaagaaggcgaagatttctttgacacttactccctgttgctagattgaccacaattcgtgtgctactttccctagcagcctcacatggtcttcttgttcatcaaatggacgttaagacagctttttttaatggagagctggatgaggagatttatatgtatccacctgatgggtttgtagttgaaggtcaagaaggccaagtgtgcaaaatggtgaagcttttggatggtctgaag

SEQ ID NO: 89745 - DNA, 2711 bp, Oryza sativa
ctagctgcacatgacgtgatagagttatttggcatttggccacgccaggcggccaaaaggttcagatttacaaatacgttttggaatggtctgttaataaaattaaaaaaaataaaaaagtctaaaaaaaaagttttcagacataggtgggtggcgctcaagtaaatccatctctggttaattactcgtcgccccaacgtaacagaaagaatgcaaggaccaggcacaacatgagccccaggctagtaaagccatttctaaccattcactgttggcacatgattagcaagccatttttttttagaattacacagtacaatgcaaacactcacaacgcacgcgcactcacccctatgagcatcttcgaagactgggccggcaaattctggaatttgctgttaaattctagaaaattcattcccatgagaagtcgaacccagaatctcaggtgctactgagactcttgtaaccactatgctacatgccttttcgcgaatagcaagccattttgcttctcctagaaatgagcataaaatgtatttttccccactgcatgttctcaagagactattactagaatacacagagtaagactgatactgatgaaacaaaaataacagccacacaacacaataatttgctgccttgcacatcgatcacatagtacatagttttttttagacaaaaggcccagggcccggctttttaaagaaagccaaatacggcatcttcctgctggggttgccagcaaacatttttgtatcctccacgcagggaggcagaaacagggaaacaaagttcacaattaaaacatccaagagactgggcagataaacaacaagaaactctaagtaagctacaggagacaagcaaccccaaaaaccaactcttcggaaaccaaacagaaaacagcagcttcccagggacttctagtatcagcccacacccgtcctggaaggtctaagagtcgccaccatccgcttcatctcctccgctagtgtttccagtttagttgcctccccaggacgacaaagcttcttccactgcacaagattagaagttatttgaaaaaggatagcaaggggggaatacaccaacttgtccctgaaaatcatattattcctagtaatccaaagattccaacaaacagcagctaaaagactcagggtgattctaacagagcaaagatcaggagccccatcacacatcaagaaaaactcatcagagtttcttggtataaaattccagcgcaaagtgtctctacacacgcaccagacaaatctagccatgggacagttaaagaggatgtgattagttgtttctaactccccacacaactgacaaaattcagacccctcccaattcttcttttttagctgttcagcagattggatcctatctctaagagctaacgaaaggaaatgtttatgtttcatagggcaagggcaaccccacatcttagcattcacatccccaatgcctctgaaagttagtgctctgtagagtgatctggtagtgtatttcttgtttgcattcagaccccaattgagcttgtcatgtgtatcagagagaacaatttgatcaattatctctttaagatcattccattcctctaattcctcaggaccaaaagacctcctaaaggataggcagcctgggcccccctgacccacctgactaactaaaatctcttgttgattacaaactctatagatcgcagggaaaagggtcatcagtgggcagttaccaaaccaggtatctttccagaatttgacactcagcccattcccaatactccattctgcccccagcatcatccatcctctgatgttcagaaggcctctccagaactgggaaacatttccaattttacaggaaaagaaactctcattggtcaagtattttttcctcaacaactctatgcacagactcttgtcctctgaatccaccttcattatccattttgctaggagagcaatattcatcttcctagtttctgtaaaaccaagccctccaaaatcctttgggaaagccatatcttccaatttgaccatatggtatttccctctaagtttgttactagcccaatagtatctacctctaattttatcaaaactctgatggatcccctcaggaagatgataaaaacccatggcataaaaggggatggaggagaggcatgcattaatctggactgctctaccagcatgagataaattgcttccccatttggtcaacctcttctcaagtttctggcctaggaagtcgaaacccacatttaggatcttatcaggactaataggaagccccaagtatttcataggaaaatgacccacaggacagttcagcatctgggcaactctttcagtgtcaagctcactcatcccaatagagaaaacctcacttttatgaaagttaatctttaaaccagccatctcctcaaagcagtataagatgaattttgtggttacaatctgatgcatatcattggcaatgaaaaggactgtgtcatcagcatactggagatgagtgatccccagggaagatattagggactaaaccactaaggacacctctcttcttagcactatcaaacatggcagccagagcatcactcactagattgaaaaggaggggagagagagggtcaccctgtctaagtcctctaaaagttctaaaaaagtcagtcctctccccattgatgttaacac

SEQ ID NO: 89746 - DNA, 933 bp, Oryza sativa
aatgtggtttttcagattttcctttgatgttagttcagtgtcaccatccatcaaagaagtgatactacatctcttcttcctctcattagctatcctatgataatagtcagtgtttctgtctccctctagaatccattgtcctccacttctattatgccagtaaagctcttccatctcataaagttgttctaggttattttccaaagcatatctctcctgccattcatcaggtgataactcattttccaaagctttagcctctatcatttctaatttcttctgcagaacctgtttccctctgactctctcacagtgtgcattaatcccccaacccttcagaaatctccttaactcagcttgtttcttgttccaaaactccaaaatgtaggaatcatctcttgttggcattttttgggtaaccatctctttaaaattttctgcagctagccaagcagactcaaatttaaaatatctagatctctcaatgttaccctcacaggtatctagcaaaatgggaatatggtcagaacccactctcagaatagaggaaagaacagagttgggatacttattgtcctagtcatcagttactaaaattctatctaacacttcctgggtggggttatcttgtttgttagtccaagtaaatctaggaccaattctgtgtaattctctcaaatccaaaccagtaataaaattaatgaacatattcatgcatctgagatctaaattgccattggatttctcactagcaaattaatacatgttgaaatctccacccagcaggacaggatgtagtctgaactggatatgccaggacaactcatcaaggaaaccatttttcaaggtgttatcaacaggaccatagacacaaactatctcccaaacgaagttgtcctttttaatcttcaggacacaactaagaaaaaaagc

SEQ ID NO: 89747 - DNA, 1387 bp, Oryza sativa
tttttgaaaaatagctatggaaatgtttgaaaaaaaaattgtaagtctagtatatgcatatctattatctcattctaaactccacccacgcatcgagaaacaaagagacaaatcaaaataatatatgaacagtattgtagtgttcatctatggatttctcttgttttctatttatttctccaatctagatttgattgttgtgacctcagtagatgtcagtgcatacttaatattgttgccaattttccaaaagttttcatggaaattttgattgtatttgggaagtaaagacatatcagaggttgcccctggaaggatgaaaatccatcactgttttaatttaatcttatggctgcaggaaataatccttaattcggtagacaacccatcaaatgctgtagagtgggcactggcagagatggtgaacaatccaaaggtcatgaagaaagcagtagatgaactcgatatggttgtcggtaaagaaaggcttgtcgaggaatccgacattcacagcctcacatacctcaaggcgtgtatccgggaggcgttccgcatccacccctaccacccattcaacccttcccatgtcgcgatcgctaacatcaccatcgctggattcatgatcccaaagggtagccatatcattttaagccgaattgggcttggtcgaaaccctagagcacgggataacccactcgaattccgaccagagcgacatttgaagaatactgataatgtggtgctagctgagccagagttcggtttttatcattcagtgctggtaggcgtggctgccccgccgtatcactcggaacttcaattacaatgatgctttgggccgaaaaactcaatactgatgtaataaaaaaacatatttgtaattaaaaaatatttacaaataggtccttggcgccaataacgctggcactgaggaactatttgtaaatattttacaaataaaaccatttttattacaaataggtcttgttaaataaatttacaaataggtcctcagtgccaacgatatttgcgtcgtcccacatcacattagtgacttagattccatccaggggtggaggggatggtgtcaacttcattggtgttgttccgttagatcacggcgccaatgacgttggcgttacggaaagggccatttatagaataaattttggagtgtatatttgtaaaataagttttttaaaaggaccaaaaggtgaaaattcaggggtagccactgattagagaataggctgtttaggcgacgactaggcagattagacggtctaggcgtgttttctaatttttccatagaaatacaaaatattgattgaaaataacacatgttatatagtacttcctccgtttcctgttataagacattttgact

SEQ ID NO: 89748 - DNA, 684 bp, Oryza sativa
cctattatgccgctgtgttaggcgtctacgacttcaccgtcggcctgtcttcgccaccgccgactggtgtctccgcctacacagccgacctattaagccgctgttgttgggcgtctacgacttcaccgccggcctgcctttgccgctgccgactggtgtctgcgcctatacggttggttggtcacaccactgttcatgggcgtccacgtcttcaccgaccggcttcccttcgccgccgccgactggtgtctctaccaacacggccggcctattatgccgctgttgttgggcgtctacgacttcaccgccggcctgccttcgccgccgccgactggtgtctccacctacacagccggcctattaagccgctgttgttgggtgtctacgacttcaccgccggcctgccttcgccgccgccgactggtgtctctgcctacacggccggcctattatgccgccgttattgggcgtctacgacttcaccgcaggcttgccttcgccgccgccgactggtgtctcagcctacacggccggcctattatgccgctgttgttgggcgtctacgacttcaccgccgccgactggtgtctccgcctacacggccggcctattatgccgccgttgttgggcgtctacgacttcaccgccggtctgccttcgccgccgccgactggtgtctccgcc

SEQ ID NO: 89749 - DNA, 685 bp, Oryza sativa
  unsure (1)..(685): unsure at all n locations
cagaaacccagcggtcgcaaatcgcgcgcatcggncagggaaaaccgaccgacaataatgagcggnctcttcaagaccgctacattactcgagcagcgcgcgaatcggggcgagccggttcgtttcgcctggagacgtgatgatggcgtttttctcggttggcgagcgtagttaatgcgcgcacgatctgccccatctaaaccgccacggccgcacatttgccgtgtgcgccgcaaacggacgaatggggttagtggaggcgtgggcgcgagaaacgagagggcgaggtaatgggcgcgggaagcgaggagccgggcatagcgttggcaaggaaataaagacgccgaggaaaggattcgtttccttcctctcgccactctttcccttgccttcgccacttgcgctctaactcttcgtttcctatgccctacccttgccgcactcgctcgctctcaagctcctcctccaccggcgtcatggcacggggctccgcaccgctcgatggtagcgtgctgccgccttcccgcatcgtgagcgagaggtaagccgggctgccgcgccgattcatgccggaatctgccaccggccggaaggtggtcgcgctgggcgagggacgcccgacgccagactacccggggcggnnctttttctaacctctttaatgatgggggtgatgctgccctct

SEQ ID NO: 89750 - DNA, 1219 bp, Oryza sativa
  unsure (1)..(1219): unsure at all n locations
atgttcnnggacgcngtctccaatttagaccgcgtcgggcggcaggcgggcctctaggncggncggtgcgcgaagtacgccgccaacaaggggggtctcgcccagcgcctctcagagatggcggggcccctccgncggctccncgaggagctcgaggagacgatctagtcatcctcgagggacctcgcccggggggcggtggagctcgtactggcaagctacaaggcaagggaccctgacttctccccgtgggcagcgctgtaagagttccctcccggaacccaggatggcgcacgcgcgcaggtccggaacgccgccgaccacatcgtcccaagcttcgaaggtacggcccctcggctcgcgttcgccctcgactccgacgagaaggcggttaacggtggtgcgtacgacagcgacgacgaggctggtgacccgggcgcgtcggagtgagcccccaggcccccgccaatcttaaatagctttttctttcttcttccgaggctttcgggcccccttcttgtatagactaatttaatctgcaatcaaataaagaggaaatttctgtgtcaattctatttgttgtgtgtatgagacgaggatggtctgtgccgcggtccttctgtgtcttggcttgaacaagggctcgtgcccaggtcccagcctcaaacggcgcgggtcggggctagtgcctggggagatccacgtgtcgagactggccaggccgggagcgtggtgaccgagggttatggatgacccgattgtgggcctttgccgattcccccccggagttcaccacgccccggggcatggctcggttctgggccccttttggcgattttagccggccgaaccgggcccccgagggcaggatcgagcacgagcgtgctaatttcaagtcaaaattcttcaaaaaggaaaaaacggcacagacacagcccttaggaatttgaaactgcttttattgaaatactgaaataagagaaaatgagaatgtgcatgtgtggtagcccccggccaaccctgcacacccgaggggggggtgcggggttggcccgagcccgaaacctgacacccgaccccccctcaggggtagaagcgacgaaggtgctcgatgttccatgggttaggcaactctgtgccgtcgcccgtggccagccgtatggagcccggccgggggacgccgatcactcgatacggaccctcccacattggtgagagc

SEQ ID NO: 89751 - DNA, 695 bp, Oryza sativa
aactgacatcaggccagcatgaaaaacataagataaaattaattccagccggctgccaaccaaaatacacgtctacatgctgatagatgctacggaatgctcaaaaaaagtttatcgaaattgttcgtagaaactacctcttgatcacagctaatactccttcagttcaacaacataagctttgactaagaattactcttaatttcatgacataaatttgatcttatttgatttgtattcaaaagtagtctttaagtattatgtgaaggctttattgtactgaaacaaaatacatacttcttaatttttagacggagggagagtactactaaccgcagtttatcccctccttgtcatcggtgacaatgtagcgatgccccttagattcaagccagccgcgaatgccgagagcggagtcgacgcagccgacgaagttgggattcttgtcggcatactcgccacccttgtagaacacacccacgaccttcttgctgcctgctgatgtctgcggtacaaagagggaaaccaaaaggtgtcattcgtcatatcgagctgcatagaacaaatttgttgatcaagtggatttgttatatttaggggtgtaagtgggtcagttgtgaacaacttataggttaaaataagcgggttgatggcttgttttagcctataagtggatttcgcgggttagccactta

SEQ ID NO: 89752 - DNA, 674 bp, Oryza sativa
ttataatgttcatgcatgtagagggtcatcacacagggaacttgagcaaagaattctatgatagtgtacgggattggaaccttgctaggaaattgcttgcacttactttggacaatgcatcagccaataatgtatgtgctaaggggttagtacaaaagctcaacaagatacaacccttgatctgtgatgaggccattttccatgtgagatgtttgaatcatattttcaatcttgttgctcaagatgatttgaagcaaatttcaattaatatttcaagtaggacgaccaaccgagaggagaatccacatcctgacctgtaagatgtaacttgttagcatttataacttatgaccaaaaaatgaatcacaacattaaatattgtcactgttggtatttcttaacctcacagataaaattcgcaagcgcacggagaataccgatgtagcactttacccggaagtattccaaggtatcgatttccatagggaacgtgtgtgctcaactcctcgtcgtgttcattcaaggacacaaagcacaaggtggcaaagggttgaagagatttactagtgagaaacagtgtacgaaaaagctaagttaatcctaacgcgatacttaagcacttggcaaactgctgcttccagatgttgctctacttggtaaccgaacaaggaggt

SEQ ID NO: 89753 - DNA, 678 bp, Oryza sativa
aggaagaaaggcgtttccccagttgctcggcttggtgtggttcggttcgcccagagcaccgctggcaactcctcgatccatgaatcgccgtgcttcttgagaatattgaaggtcttggttttgaggcctttgaggatttctgcattggcgcgctccacttgaccattgcttctggggtgggcaggtgaggcgaagcagagcttgatgcccatgtcttcgcagtagtcgccgaagagttcactagtgaattgtgtgccgttatccgtaatgatacggttaggcaccccaaaccgagcagtgatgcccctaatgaatttaagcgcggagtgcttatcgatcttgatgaccggataagcctcgggccacttagtgaacttgtcgatcgcgacatacagatactcgaacccgcccggggcccgcctaaacggacccaggatatcgagcccccagacagcaaatggccacgaaagtggtatgatctgcagggcctgggccggctgatgggtttgcctggcgtggaactgacacgccctgcaccaccggaccaggtcgaccgcatcgttgagagccgtcggccaatagaaaccctggcgaaaagccttgccaaccaacgtgcgtgaggcggagtgggctccgcactcgccttcatggatatcggcgagaagctcgacgccttgt

SEQ ID NO: 89754 - DNA, 1259 bp, Oryza sativa
  unsure (1)..(1259): unsure at all n locations
acggcttgcatgncgccnntaagtcggttcatatcgaggctggaaaagagggcgctaccccctattttggctcctcaaacgctcnggnccgttttactggacgnaaggagactgagcgggtcctcactcagtgaaaggcgtacctcagttctccccctgtcctggtcgccccggagccagatgagccgttgttactctacctggcgtcaaaccccgcaggtggtcagcccgtcgttgatcgtggagcacaacgaggacaaccctcactccacgcatccccaccttgtgtcgactcgacccgagaaagagcagggagcagaggcccccgagccgatcggtggcttaaggcccccgacggccggagctggccctccgcctgcttgtccgacggtgccaggcgcccccgacccccaggacggcctcggggccactgcgcgagggccgcgcctgtcgccctttgaccccgaggtcgtcggcacagaagccgagtgctacccgcgtgccctctcggacgaagagcgccctggagatacggcccctagcgaaggggatcggccccgccgaaaggtgcagcggcttgtttactttgttagcgaggccctccgggacgccaagacccgatacccttaggcccaaaagatgctttacgctattctgatggcttcgaggaagttgcgccactatttccaggcgcatcggggcacggtggttacgtcttaccccctcggtcaaatcttgcataaccgagagggtactggacgggtggtaaaatgggcaatcgaactctctgaattcgatctgcgctttgaaccacgccacgcgatcaagagccaggccctcgccgactttgtggcggagtggaccccagctcccgagcccgtctccggccccgaggccacctcgggcccctcgcagctgcctcacaccgtctactgggtgatgcagttcgacggctccttgtctcttcagggcgccggtgcgggggtcacgttgacctcaccgagcggagacgtcctcagatacctggtccgcctcgactttcgggcgaccaacaatatggcggagtacgagggactccttgcgggactcagggtggcagctggactggggatccgccgcctcctggtgttaggcgactcccagctggtcgttaaccagatctgtaaggagtaccggtgctctgacccgcagatggacgcttacgtgcgccaggtgcggcgtatggagcgccatttcgatgggatagagcttcggcacgt

SEQ ID NO: 89755 - DNA, 695 bp, Oryza sativa
  unsure (1)..(695): unsure at all n locations
tttgtcttctgatttttcttctgactcagcgagatcccgtcgcgccccccccgccattccaagtccggccggtctgaggccgaggagacggtgaccgcggaggcccggaggcgggaagctgaccggcgagaagccacggaccgcctacgggaagccgaggaggctgcccaggaggccgtccgggtttgccaggctgaggaggccgctcgggaggaggccagacttcgccgggccggggagtccgtccgggaggcagaggcggcgcgcacgccaggcggtctgtcaagcccccgacccgactccggccgaggtgacgacgacttccgaggccacccacgacgaggccgcgggcgcgccgatcgggcccgacccctcgggcgacgcttgggacaagccagctccgggggacgcccccgagtccggcacgtcgatcagcgggccgagccgcgcggcacccacaccgaggcggctctcccctctggcttccgctgccccaccgagcgcggagcccctcctggcagccttggccgccacgaacaccacggtgttggacgggttaagtgcccaaatggaggtcctacaagcagagcgggcggaacttgacgcggcgtgggcgcgcgtcnaagaggggcggcgctcggtggaggccatggtggaggcggggccgaaggcacaccgtcggcacgccttagact

SEQ ID NO: 89756 - DNA, 695 bp, Oryza sativa
  unsure (1)..(695): unsure at all n locations
aattggaatcaacatgctcaaggggaatgtgtgacttggcttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaaaggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgcttgggcatggcatggctcaaagccggccgatcgagtgatggcaatgggtggcgcgcggtggancaaccaacggcggcgcacggcacggnggaggccagcgaagggggaaggaggaaaaaagggaggggagtgctcaccgagcgacacngcggagcatgcngnccgcgcgaggaacgg

SEQ ID NO: 89757 - DNA, 813 bp, Oryza sativa
  unsure (1)..(813): unsure at all n locations
cgcggnattgtagatccgatttttatanggcgaattcgagctcggtaccccgcaggtctctaacagatagcacgccagctactcggcccgttgagttgccgatgacgccgccaccctggcttcctcaatctcgcggcccacgccgcgagctccagcctggaggatgcgctccatctcagcttggagctccccccaggtgagggcatcaataggcgggccccgagcgggcacaagaccgccagctggtccactcggtgtcgcctcccgatccctagttgtgaccacgacatccgtcgaggtcgccacaggagacgcgctggaggttgcgccggacccgtcttgcgtcgccttcgcccgcgccgccctgtaaaggatttccgcgatttcatgaagacaggcaagcaagacttccaaaacatctacttacttctcgccaagcgtcaccagcctttgccttcgctaggacgggggagacgcatccgaggcctaagcaagatggcacgatatgaggtcaaaatattggaacgttgctgccactcatcgtagtagcagcagcagcagcaatgtcggatgcctccttggcaacgccctgctttaacgacgctgccgcctggtggtccgcgagcggcccgatgacatccgtcagagggagagcctgcatacatgaagtcacaatgcgatcccaggaaagcagaagtaaaggagtcgtcaaatacactcacgttgatcgcagccatgcaattggctttccccttcttgcaaatggggacggggatgttgctcgccgttgtaggaccgctgatcatcacttga

SEQ ID NO: 89758 - DNA, 1601 bp, Oryza sativa
  unsure (1)..(1601): unsure at all n locations
atcgtcttgaaatgacccagtctgnnnggagtcttcctctgagaatcgaatcttctgtcgnnaccacttcatcttgggcgcagccccctgccatgtcgaacaaacttcgcgctccactttcttgtactctcgcttcgaagagtacgccatagaacctcggaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttggccaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaagaactcctttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgccagttggcggttgctctggcagtactccggtggcggcctcttcgaacgcgttactgaggttagccactaatt

SEQ ID NO: 89759 - DNA, 718 bp, Oryza sativa
  unsure (1)..(718): unsure at all n locations
ggtgattgaaatgtatgcagctgccttaggtcgactctagaggatccccgtggcgcacacgtggcaatccagtcagcgttttttaataaaaaattgtggggaggcgggtatatatagctaggatagatcaggccatgcgagcaaaggttagatactcagaagcgttagcttgccaccaatttaggatgtccgtttcaaaaaaaaaaattaggatgtcaaaacatcacttcgagggcttatacatatatccatcatactcagaacatatttcagccgtcatctgaatgtcatggttaagatgttgatcccaatcagccaaccggtcacttgtagatactccaatatcaacatcagcactgcctgttagatccgtagtgaagttgatattagcactcactgaaagcctctcgaaaagcattcttgacattgacaatcatagactcggtatcattaccaaatgcaggcctgaaacggaactcgagaacttaagcttaaatatagggtccacgataacaggtagagatagtgccaaccaagaaatcttcaaatacttctcaaatttcttcttcctggacttgatcatcttagatatttcaattgtcacttgagaagcttngtaacggcntgtaaatataccaaatttacgccggcgtcaatccagcataaatctaaaatataaaacatgccatatagtggctggggttatttctaacaaatt

SEQ ID NO: 89760 - DNA, 745 bp, Oryza sativa
ttattaaacttgtcatttacatccccaaactgtgatgtaagcaatccattgagtgtccaagcaacagggcacatccaatagtaccacctccaccatactggaattctctgtagtaaacggagccatattagaaaaattagtggatgtgagataatttagccacgaacaatgtacaattagatacttgagaaaagctggtatacgtacaatccgtggtattagaaatcctgagaaaaggttccatatgttatagaatgccgtggaaacaacagcagacatggcattgtttggagtcaaacccgccatcatcatgccataaaatgtgaagtatgatagtgtgaagaacatgaagaagaggtaccaaagaaatttggcacatgtccactcataccctaccatggcatacactagcacccaatatattatggtctgaagaaaaatgtatggaaattcaattgcaacctgcaatgaaactagatgtcaagaaggctttttgtttcaccattcctttccacttactgagagccttggttttgtataaaaaaataatagtatgttaaaacattttatcaagactcgcatgcatatatttacaaaatgattatgatgccaacaaactttacctgtcccaaggcgtccgacaaagcagagtacatgtgtgatgctctttccctgtaaaagatcgtgcgcctcaccaaagatagctggctgaacagaactagagttctgcacccccattgccata

SEQ ID NO: 89761 - DNA, 5854 bp, Oryza sativa
  unsure (1)..(5854): unsure at all n locations
cttaaaatgtgacggagggagtagaagttacaaaaaaaatttagatacactcatagcatgacacgtccgtgttagtaagaaaaaattaatatgtatagccttttcatttttttatgttgtttaaatagtcgtaaaatgtttttctttcaaaaaagtagaagatctaaattattactgcctcggttcgattttaagtgtagcggtgggtttctgcatctaacatttctccatccatcttatttgaatttttttatgattagtatttttattgttattagattataaaatatgaataatactttatgtgcgacttttttttataaacttttcaaataaagcggatggtcaaacgttccacacggaaacacacgactacacttaaaatattggatggagggagtatatggtatatgtcttcacaaacatgcaagcttgatttgatccaaaaagcttgaatatgtcttcacaaatattcaaatctgaatatgaatggtcggcatactagtgtttaatctgtgtcatttttttctcgagttgtagatcaaatttagaattgagttttaataggatgataaacaactattgtataagtgttattaaatatttcgagattttatatattatacctacttgattaatattccaatggttagaataaacgagaggatcccttaaatgccaataaccagttgtccagctacatatcatatcatattaaatccttagatttcgtaacccattaccagcagtgctgtgattagtataggtatatatttctattttcactatattgtaagttatctactacctccgtcccattataagtgcacttatgaattttcgtgtccaacatttaactgtccgtcttatttgaaaattttataatttttttatagaaattagtcacaaataaagtactattcatattttatcatctaataacaaataaaatactaatcataaaatttctaaaaataagacagacggtcaaacgttcaacgtaaactctgcagtctttatgggacgcaggtagtacaagtttgaaaatatcactaaatcattttatgtgaaatttatttatttttcctgaaatattacttgattctctaactttctatgttcaatttttttgataaattccatgctaattttacttcatgtttaacgtttgcaaatgatcatttttgtatgaaaagtagtaccagaccttgcctagtaaatacatatatttaaataaaatatttacaaacggagaaccaatttatcagaatttttgcaaagtgggtgtagctccatcagttaggtttcttgtgatggaacctgcccacggagatcacatttacggctaattatatttttattcataggcgatgtacctatcgatagagagacaaccgtggtaacttggttaacctcaaaatatgtcatccgagttttacgaaggtgctcatacgggtagggtgtgcgtgtgcgttgagggatgagtgtgcgcgttttgagagcacatgcgtttgcattgtatttctaaaaaaaaatatcatattttttatgaatgttgttaccaatcagaaattacaaggctaattgactcattaatccatatgcaagaaaatttcctgaatgaaacattaaacttgaatttccggcttaaaacagtcaagcaataaccttcatatagcaacatatttacaaatattttttttccattcgtcctcgatttcaaaatatgtcgggaggctatctatacctatactaatcgggcacttttttggagctctcacgttaaccagaaaaatctaaccattgattagatggattgtaaaatcatggccgtacattgaaatctgtgttatcatgggcttttttaagcgaatccaacatgtatagagagtccctctattatacgtattgttaactacctacattgatatggatattcaatctgttaatatatctggacgtatcctatctccagttaggtcaatagatcgggctgtgttaaccacgtacgtacgtagcctagctgatgccgatcggaattaatggcggattaggcagcacgatatgcaaccgagggatcgtcgtgaggagcgaccattcgatggaatcgtccggcaagacggtcagccccatcatattcatgatttccaggttcgaccgctcctggccggggcttcatccatggtactaacaacttcttcatttttcaatttattttaattccgaataaaaattaataactgagtagacgaggaacaaggcaacatgtatgtgggatgatggaactgtcaacagcagtgcaatcatacagggtaagaaaaatacagcttattccctttggttctgatctgttaatgtcattgtgtacatatattttcaggaacatatttttaattttatttgaaattattacgatctttggcgtatcgatagagttattttatcacggtcgactgacagtaaaaatttattagttcaccaaagattaagttgtttcataataattttgaagcaggcaacttacatatcgatttatagtttttctgaacataaacaagcattttgtcctctctatacgccaggttgtgtaatgtgcaattgaactacttcaaaaaccattttcgcaggtatccctttactacgttctttttgccgtacttctgtattctttttgttggaaaatagctttcttcgttttggtaaaaaaaaagttttcgtcagattctatggtataattcaataaaatgtgaatactactatttgaaggtttgcttcaattcaattagtcatgaatatttactcaggcacccatctgtattccttctaaatagattttcaagccaataatatataggaaaagatatatctatatattattgattaaaataatgtatcaagacacatcacagcttcctaattgttaaaattacattaataaataaatgaaatactaaaattcagacccctaataggaggacgatctcatattttcaattctaatttacagaattattaaataaaaaattacgactccaaggagagttcaatttcgtatgtattaactctgagtccacattatctatgatttttctattttgaaaactattaaattagaaaataaaaaaactagaaaaaggatatagaaaagcataaataatgcatttggtactccagtactttgcataaaagcgagtgtcgttgtggagtaagattttgtatatattattattatcaaaattcacaattactttaaataggaaattaaattacttggtttttattaatctatttgtcaattaaaaatatataattctatgtataaatccatttatacattatatatatatatggtagttctgagtgaaaatcaagattcttttaaagttgatctccactcaaatccgctaatatgaaatcaactaattgcctttatgagatatttttgaaaataaataaccaatattctagcatatgattaaaatttttaaaatattaatatagcccgtgcaacattcttacaaattaacattctcaaacgcaggtggggtacactgtgatttaatcttaattttctttaaccttcaacttattgagttaagtggtagagatttagatttcttttattgcacatagtagttctctaatatttaagcgaataaaatctataattgggcttaaactaaacaaatagagcactctggggagctcccacatttattgtaattgacatctgatttatcttttagttaaaccgatataattaaaaaataactaatgatttttctataagtagaatctaaacattataatattaataataatagcccgtgcaacgcatgggttggcgactagtaaacataatatccaaaaaaagccatgttgcttgaactgtggccttgccaaaacgaacatattctcatttcatcttattccaatatgttccgaacattatctactgaaagggcgcgtgaagaaaagatgcatcatacttatcaccaattttttagtatggccggtcaaaagcttctttaataaggcaaaacaatatcaaatacaaggctaattgagcatttgtttccttctataatattcaatcaaagttccttgcttaattcaatgatactcaaatctcttgtgtgttcgaaaaaaaagagagtaaaagttcgtttttaccatgaagtagtgaatgatctcagattagctcctttttttagagttattgggcacatacaatggcagcatacattttggctttgaaaaaaaaaacataagattttctttgctgtcccaacttttttaatggatataggtgagacacaaactgtctggtggttggttagatatattagctataaagtatactagaaagggactaggctttgccgcgtaatgggtcatctagtaagaaatattaatgggccatcgtttataacgtttgtgtagtgattaatatttattagtaaatatatatgctatttgttatatttgtttgtttgcatttggtatcggtggaaattcctgggaactcaaaaaacatgacaagcgtggattggttgactaagtagaccatataaattttaatactgaattttagaagagaaagattacaaaaataatagcaacaaagggttgccacttttaaccataccataagttgatagtaccgaaattttgataactatagaagttttcactctcaaaagttctaccaaatttgcgaagtgagcatagctcaactggttaggttccttgtggtggaaccagcccacccgggttcaaatcctagatttgacacaggtgctcgcatttacggctaattattctttcagtggtaggcgacgtacccgtcgacagcgaggcgcctgtggtgacttcgtcaatctcaagatgtgccggcccagtcttccggaggtgctcataggggtagggtgtacgtgtgtgcgttcataggggtgagtgtgcgcacgttgtgagcgtgtgtttctcaaaaaaaaaagttctaccaacttttggtaatgcataatttaaaaagtacgaattaccccccccccgaactatcgcggtcatccgaattacccccgaaccacaaaaccggacattcttcgcccccaactatgcaaaccggacaaattaccccctcgaaccaatttagagtggttttgtccaacgtggcgcacacgtggcaatccagtcgccccccccccccccgaactatcgcggtcatccgaattacccccgaaccacaaaaccggacattcttcgcccccaactatgcaaaccggacgaattaacccctcgaaccaatttagagtggttttgtccaacgtggcgcacacgtggcaatccagtcagcgttttttaataaaaaattgtggggcccatctgccatacttttctcttcttcctctctctcctctctctctctcgctcttttctctctcgcggctcgcgctgcgcacacggcgaggacggcgcggggacgggtggtcggcgatggcagaggcagcgagcgcggcggaggaggtagcggcggcggcagaacgaggcggcggcggcggccggcgaagtggagcaaagtgcccgcagcgaggggcaacgggcaagggcgcggcaggcggagtggagcgggcggtggcgagtgaccggagcaagtgggcgagtgcgcggccgtcggcagagtggagcagagcagtggcgggagagggggagaggaggccgagcacgacatcgtcgtcgcgctagacggcgaggtgtcggcgtgggtgatcggcgttggcccgttggtaggaaggcgagaggggtaccgagccgaattcagccttaggcaacggcaatcagtnntcaannncccctt

SEQ ID NO: 89762 - DNA, 849 bp, Oryza sativa
  unsure (1)..(849): unsure at all n locations
agatgttnaaaggtacagacactctctatccggntcctacatgtttgtttatgaagtcatggagctggtggagattctctccttaaaagatgcactggttggattacctggcgttagtggattatcatctgaacgaaggaaaagactaacaatagcgggggaactagttgcaaacccatccattatatttatggacgaaccaacatctggacttgatgcacgagcagcagccattgtgatgagagcaataaaaaatacggtggacacaagaaaaacccttgtttgcacaattcaccaaccaagcattgagatatttgaatcttttgatgaggtgaatgaaactataacaatattgtgcatttgatctttcaagaaaaaaaaaagtaaatcattggtgagttaatatttgttgcacactcactcaatttattctaatatggntctttgttgcagctcttcctaatgaaacaaggaggtgaagagatttatgtaggtcctataggacgacaatcatgtgaattaaataaatatttttagggtagaaaaaacacataaaacaatacaattttgcattttttctgtacgaaacatgctattgaaactcttttattttctaaagctatccaggtgtcagcaagataaaagaggctacaatccttcaacatggatgttgaagtgactagtacaacgcaggaacaaagaactgcgtgacttttctcaatatacaagaatctgagtatataggaggtattggtagtgctttaatgttgnccaataacatacatctatgtgcaaagccaacttctaagatgtacagatatccgggatgtatgtgtagaaatggttcta

SEQ ID NO: 89763 - DNA, 766 bp, Oryza sativa
cgtggattgaatccacttgtagcccgccacctctttgaaaaccattttgaatgctgataactactcatagcatacatgtatacgaagctatcttcgatgcactcgccaggggttctcctcagccgctggtggcctgtgtcgggactggctaaactattcactatgagtacaaattgcactgatagcgcaccatatgccgtgagatataccagacacatgcgtcatgcgaaaacaccctattatgcgccattcaccattcaccctgcacaactgcagcgaagggcgatcgatgcaatcctcttcgatgatactccagctgacgaccggacgaagtgctgatatgcgacttataagagtaactccctaggttcccagtaacaacaattaaaaactacagccatatacaagtagagcaactctcattctcatactaaaatatctaagctaagtggaaagaaaatagaaggagaatcttttcctatacttctagtatacatagtatacgtacattctagttatctgattaactagtttaataccctctatccgatgccctgctggtacatcgagaagccatccctgactgtcgagttccttacgacagcctatcattaccatacaaccggggctaaatacggaggactaccatcctcagtaaaataacttaggactatatacacgcgccgaggaatatccggactgaggtgtcactatcaatggcccaactctcattcggagcatattacccccaataatgatattccgt

SEQ ID NO: 89764 - DNA, 1124 bp, Oryza sativa
  unsure (1)..(1124): unsure at all n locations
ctgtgagtangtacaccatgattatagggcgaattcgagctcggtaccctgaccgcgatgaggaacagatattgtacgatacaatcgcggagggaagcagccagtactgaaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcgcggtggaacgctcaacccagctgatggctcagtggtcttcggctatcagatacaagaggctgcgcgacgactaacagatgcagtggaagcctcctctcagggcacgttccgaccagacagagatagggacgagctgactctcgccctgcagactccagagcatccaggacgtactcgagggaaaggggtgattccttggaagattggtttcaaggaggacat

SEQ ID NO: 89765 - DNA, 1053 bp, Oryza sativa
  unsure (1)..(1053): unsure at all n locations
gctgctcnggtagacattcaagatcnatcgcgaanncgagctcggtaccctttgagagcttggaggctacatgttgaggatggcgctgattttttccgtgatggcctgtatgcctctttgagataccataaatacgagcgacttccctgtcggaactccgaacagcacttttccggacccagtttcatcttgaaagcacgaatgcttgtaaaagtttcttctaaatccgcaatcaggtcatccttctgcttggtcttgacgactacatcatcaacataagcttcaatattgcgaccgatctgagttgaaaaacatctttgaatcatgcgttgattggttgctcctgcattcttcaatctaaagggcatggtgatgtagcagtaggccccaaagggcgtaataaacgaggtcttcaagcagtcggattcttttagccggatctgatgatatcccgagtaacagtccaagaagctgagtaactcacagccggccgttgagtcaaccacctggtcaatgcgaggtaacctgaaagggtctttgggacaagatttgttgaggttggtataatcgacacacatgcgccattgccccgtctttttccgaaccaggactgggttagccagccaatcgagatgaaggacttccttaatgaagcctgctgctaacagcttggttaattcctccttgatccatccttcctgtcctgtgcaaaacggcggagtcgttgcttgatgggtttggcgtcttccttaacatgtaaagagtgctcaatcacctctctggggataccaggcatattggatggtttccacgcaaaaatatctttattattctgaagaaaggtgatgagcgcactttcctatttacaatctaactcagcgcctattacagcagtcttatcaggatcggagggatctaagggaatctttttcgtcttggcatcactttcttcggtcttcgtcagcttggttgcaggcgcttctccctcgcttgccgtggtcgcagccagtcggatctcttcgcgggcgagagtagtctcgtgggtttgggcca

SEQ ID NO: 89766 - DNA, 1151 bp, Oryza sativa
  unsure (1)..(1151): unsure at all n locations
tatgccgacgcgggaaggaggtgaaagtaccaaccacaaggatcgcaagcgtaagccgaaagaacttgtgccgaccacttctcngtcttnccgacaacgttnccgcattacaccttcgacaagataatgaacttccaatgtccgcatcatccaaacttccaaccacgtggccaaagattgcttcgtctacaaccagttcgcggagcaatacgtcaagaacgcatgtaaaccctcagacggagatcaaggcacatcaaagaagaaagatgatgaagacgatgccatgactggttttcaagatcatcgcaaagaacttaatcacatcttcggcggacccctggcttatgaatctaagagaaaccagaagctaccagaacgggagatcaatgcggttcagcctaacacgccccaatatcttcggtggtcagagatagcaattaagttcaaccgctcggatcatcccgaccgagtggtccactcggggcggtaccccctggtactagacccagtggttcgcaatgtcaagctccgacggactctcatcgatggtggcagcgcactcaacatccttttcgctaagaccctggacgatatgcagattccttgcacggaattaaaaccgagtaatgcacccttccacggtgttatcccaggattgtcagctacaccactcggccagatcactgttccagttaccttaggcactcgggagaattttcgcacagaaaatgtttgtttcgaaattgctgatttcgagacagcatattatgctatacttggacgaccggctttagctaaatttatggccgtcccacactacacctacatgatgatgaagatgcctggtcctcgaggagtcatatcactacggagcgtcatcaagcaggccgtcacatgtgacaaagaaagttgtgagatggcccaaacccacgagactactctcgcccgcgaagagatccgactggctgcgaccacggcaagcgagggagaagcgcctgcaaccaagctgacgaagaccgaagaaagtgatgccaagacgaaaaagattcccttagatccctccgatcctgataagactgctgtaataggcgctgagttagattgtaaataggaaagtgcgctcatcacctttcttcagaataataaagata

SEQ ID NO: 89767 - DNA, 750 bp, Oryza sativa
ttactatatggtgtcttaattaccgtcagaaaattatctcactactttcaaagtcactcggtcacggtagtcacatcgtttccactcggggatatacttcataaccgcgaagtaaacggacggattgcgaagtgggccttagaattgatgtctttggacatatcgttcaagccacgaacttcaatcaagtcacaagctttagctgatttccttaccgagtggaccgagtgccaaaaagacatgccagaggaaaagatggaatattggactatgcattctgatgggtcgaagaggcttacaggcactagagctggggttgttttaatctccccgactagagaaagattgagctacgtattgtggatacatttttctgcgtcccataatgtggcggaatacgaggcgctactccatggactaaggattgcaatatctctaggtattcgccgactaatcgtccgtggagactctcagttggttgttaatcaagtcatgaaagagtggtcatgtctagatgataatatgaccacttatcgacaagaggtacgcaagttggaaaataaattcgatggactcgagctcacccatgtcctccgacataacaatgaggcatccgacaaactggccaattttggttcaaaacgggaagcagctccttcagatgtgttcgtcgaacatctttacgaaccgaccgtgcccagaaaagagacagtcgaagccatggatactcaaggcgtaagcatgatcaaa

SEQ ID NO: 89768 - DNA, 771 bp, Oryza sativa
  unsure (1)..(771): unsure at all n locations
ccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactctccccttaccgtacgccgaaccagctcgctgtcgccctcccggaactcctcgcgccccctctctgtttccccggccatgccactctcgatgctatgaccaccccgccgtgctctgttcccgccgacgccgcgctcggctgagcgccaccgttggccaccctctcggcgactccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactcttcccgaaccgccgccctagccgccggccttctttctttttcccacgtcgtgccgcccgattcaccaccgcggcacacgggcgcgctctgccgtcggttccccccttctcttcgaacccgctcgccaccaccttcctcgggcccctcttgacctcccccttgctgccccgtggccaccgggctcccttcagntttcgcgccgcgccgcccttttcgttgccgngccgcgccgncgaacgagcaacacccgggaccatcaggctncgcgcccaacgcgtgtgcgtcgcaancaccacaccc

SEQ ID NO: 89769 - DNA, 853 bp, Oryza sativa
cgcgcttgagtacactactactatagggcgaattcgagctcggtacccaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtaacgaaaaccctccgccgtcgggccctttgaatctgcattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgcgggtaca

SEQ ID NO: 89770 - DNA, 1929 bp, Oryza sativa
  unsure (1)..(1929): unsure at all n locations
ccagcccttgaaacatagagtgtaaacggggactttttcccgggttcggcccgaaataaaggggcgcacggcgcccgaccggggtgncaaatctcccggtattcccaacgtggataccctttgggaggaaaaagggggcgcggcatatgtttcgatcaatcggttggggtgttgccacgcacacgcgttgggcgcgaggtttattgttcgccggtgttgctcgtgcggcggcgcggcgcggcaacgaaaagggcgtctcggcgcgagagctggaggggaggccggtggccacggggcagcaagggggaggtcaagaggggcccgaggaaggtggtggcgagcgggttcgaagagaaggggggaaccgacggcagagcgcggccgtgtgccgcggtggtgaatcgggcggcacgacgtgggaacaagaaagaaggccggcggctagggcggcggttcggggagagtcaagggggctccaggagggtggtgacgagaggatacggcgaggggatggccgacggcggcgcgcggtcatgcgtggcggcagcgaatcgggcagagcgactgtttggggtggttcaagggagctcaaggcgggtggtggcgcggacagtccccgagagggtggccaacggtggcgctcagccgagcgcggcgtcggcgggaacagagcacggcggggtggtcatagcatcgagagtggcatggccggggaaacagagagggggcgcgaggagttccgggagggcgacagcgagctggttcggcgtacggtaaggggaaggggacggggagctcaccaatcggtgaggaatggtgtcggcggcgatttgaggatgggaatgggaggaaggccgttggcgttgggcggcgaggccgacggcggcgcgcggtcatgcgcggcggcggcgaatcgggcagagcgactgtttggggtggttcaagggagctcaaggcgggtggtggcgcgggaactcccaaaaaggaagcccaccgccggcgttcacccgagcgcggcgccggcgggaccaagagcacgccgggcggtcatgcaccgagaggggcacggccggggaaccagagagggggcgcaagagttccggaaggccgacagcgagctggttcggcgtcctttaaggggaaggggacgagaagctcaccaatcggcgaggaatggcgtcgccgccgatttgagtatggaaagggaagaaagcccgttgncggcgcacggggacgaacgtgacgccgaagcgggcgcaccagggaaggaagggacgcggggtggaacggtttggtgacggcgcggcgttcttgcccgtggcgacgaagaaggcggcggtgctccggggttggccgcgcgacggcgaccgaggttgagggaggatttggggctcggtgggtaggatttataggcaagggggagatcacagacgagctggcgctcggctggcggtggggcgatggtttcgtgggcgacccgaaaacggcaacggcgaggatgcgttgggcggcgaggtcggtggatcaagcggtcgaatttgaacgcggagcgcgggccggcacggtcaaagtgggggcggcgggattcggcgccggggaggaaacgagatttggaaattgaatttggatttcgaacttgaaacttggtctcaggaaaacagggaggagtcaagggaatgcatccaagcgggaattcgggtatttctttgggatagatttcaaagatagataggtagacggacggaccgatggatatcgtagagatacatagatcaacagagagatcggtagacggatagttagatgggttgacaggtagagagatcgatgattagatcgagagacagataggtcgatggataggtagataggtagatcgatcgnaagggtccagtcagtnntntcagtnngnnnnttcaatccacactc

SEQ ID NO: 89771 - DNA, 1504 bp, Oryza sativa
cacatttagctttgaacaaatgctgagtgataaggtatttctagactccactatttgtttacttgtataaaagggtgtttttctccattaattttatttgtgttaaaacttttatgcgccacatatttgcttatgatgtattccagtatttgtggaaggatctgttgctctatgttctgcattggatattgaaaatcacagtctatagtggtcgctcttttgcataaatgaaaaaatatgttcttgagtagtttctgggcagattctttatattagtaagtagttggtgaacccattcaccttcttgcttactctcattacttgttattgacaagctcattcctttttgtcaccagggaaatacagctgtttaccttcagtatgctcatgctcgcatttgctctataatcaggaaatccaacaaggatgtagaagagctgaaaatggtaatacttgtgttatttctatgcactgattctattgttgattttataaagtcctgctgttgttattttagagttccatcatctttttttttttacttgagttccatcatcaattattcgttctctttcagctatcagacatggatttaaacacgttgactctgttttcctgtttttcttctcagagtggtgccatttctcttgatcatccagatgagcgtgtcttgggactgtacctgatccgatttgcagaggtatcattggcgctattaactgaatcttttttcttaaagatcttttttcagacctatattttcataaggcctaggaactaaaaatgagctaaaaagggtagtccagtttattcttgaacagcaaacagccgcagtggtctgacagcatgttgattgtgtgctcttgtttggagttgtttgtgcttagcccacaagtaggtgcatgttactgagattttcctgttcaactttaggtgtggttagtgcaagaacaatggaaaaactagaagtcatacattacatcattcagataatagtatttcattcagataattcctacgaggtgtaacaaacaccgataattctatttcatagtttagtcaacaatatggcttaattcacaactaaagcttttttcccctcttctgatttacgtttgctgtgtctgtcaggttgtggaagaggcgtgcaccaacctacttccgaatgtcctgtgcgagtacctgtacaacctttctgaaatgttcacaagattttacaccaactgccaggtatacttccatctgtttacatcattttcccctggtgaatcttactttcttccagaacttgaaaaaaagtttctgacatgttcaccaagtgaattttgtttctcttataaactagagaataattataccaaacattcaaaagaaatgatttttactgcgggctcactttacgttgaacccatcaggtggttggatcgcccgaggagacaagccgactgctgctctgccaagcgacggcggtcgtgatgcgacaatgctttgagctgctcggaat

SEQ ID NO: 89772 - DNA, 719 bp, Oryza sativa
catatattacgttacccctattcctctggcaacatacatagcctcatatctccacctcacatgaatgtcttgtgatcttcttacctcacatttggcatcatcttcatcatatgtaagtcgaaaaacgaaaggtacagtaacccacagcctgacgcctctgtcaatggcggcgtcgccggcgacacctcctctcgccggaggagggtggcatatgctactactgtctaggtctcttggagctgcagctcgggcacttgtactgctttatgctctccgccttcgccggagtgatcttgacgcacttgccgtggtaccacctctcgcacacgtcgcagccgatccagaactcgtcggcgctgtatatcccaccgcaagtcccgcatagggtctcactgtggtcgccatcgtcctcgtcgtagccttcatcttcctccttgatattattttcgacacgcgccacgtcgctggtatgctggggagatgggatttgttcatcaggactcgtgatggaagggaggggaaatggtgaaaaactgtggagaaattcttgttaccttcgatgaaattttatttctgctgctgttgtccatgccggatctgtccctctccttagattgtcttgaaccagatacgacttcgtaaacagttggcaaatcattcatcatgccaaacaaacgcttcctgttgaattggagagcgaaaacagcaaggacaatgag

SEQ ID NO: 89773 - DNA, 3458 bp, Oryza sativa
  unsure (1)..(3458): unsure at all n locations
gccgcccccgccgccgccgcctccgcggccgtcgcggcggtaggatgcgtccatggaaggnagncggcgcgtgggtaaggcgatctccggcgaggcgaggcgaggagaggagaggaggaggtgatcgcgatgcggaggagaggagagagcgaagtgaggagtacacggccgatgccgtggagatcagcggaagatgcgttaagattttgcggttttacgtctaggtcctcgtatgagtagttgtagtatttatttgtaacaaaagaaataaaatcccaacttttaatcgacccttatgaggattatatgtgggataatctgagtgaatgatagttggttaagatatcaaataatcgaaactcattttaatgggtgttagattatcaaatatatctttctaatgcggtgttattttatactgctaaatggcgcgttccgtgtaaaaattttctatagataagtttctttaaaacattagataaatattttttaaagtttgtaataattaaaattcaattaatcatttgctaatagtttgttgtgttttacgcgcctttaactttacattcatcgtgttaaaaaagaacatgtaatgaaagcaaaggattgaggtgtgatgttccatagcattcttttggaggcaccctagtaaagcccccacctcttttcttattaagatatactccctccgtatgttaatgtatgacgccgttgactttttaaccaacgtttgaccattcgtcttattcaatttttttatgcaaatataaaaatacttatgtcatgcttaaagaatatttgatgataaatgaagtcacaataaaataaatgataattacataaattttttgaataagacgaaaggtcaaacgtttattaaaaagttaacgacgtcatacattaaaatacggagggagtatattttatcttggtttttattaatacgttttcaaactgctaaaatatcgtgtgaaaactttctatatatatataagttgatttaaaatataagataaatctattttcaagtttgaaataattaaaactgaattttgatgcgctaatggttaatggatttctcgttttttcatgcgctgatggccataactaaataaccactgaaataactaatacaatgacataaataatccgaaaaggtccactttatgtttcttaactatgaatcaactttcattcgtgtcccttagctacaaaaccgatataaaacattccccaatttctaatgttggtgtaaatagagtccctcggtagtattgaaagtggttttagctgatgtgatatatgcatgtcttgttaacttgatcttagtagtctatacagtgctataaacaaaaaaaaaataaagatactactaggacccatatatcaatgatagttcagattgaaaaaaactaacaatttgtggggctcatatgttaaaggcacttcttccctcaccgctatatgcatttgacaacaacagcgatggcatgcactccccaagccagggcggcgacacaacgctttgctacctccgcggtggtgattttcggtggatgcagaaggtgaagctttgcccaataggtgaggtagtaggcgaaagaagctgtggatcttctcgctgtgttctctcacctcagtaagctcgaagtgctcgaggaggtcggctactcagtgtcagccgttgaaaagaacgtggtctctccggccctcggacacgatgtggcactccaagctctaggtcgaacaaggaaaaggtcccatatgctactaatactaatttctttttgctaattaggataccatatagatcaaaaccacttttaatactttgtaggtcccatatgctaccagtacttttttttttctttaattaggataccacataggtcaaaaccacttttaatagtatcgaggaactcaatttacatcggttttagaggttacaaaacaccctatatcaggttttacggttcaaaggacaagaacgaattttttttcctaaataatattccagagattgatcaattgtgaatacggcagagattgatcgtgagggataacaattgggcctcgtactgagctacagtgtacatataccaagcataactcataaattttgagtttagtaccccaaattttaaacccaacccacaaaaatgtggggccgtttaccaccccagatccacatcattttcggagttctttgtgatgtgatctctgcttacatttactctctgtgatctcagctgcaagaactgcatgtcattttagtacatatcatgtcacacccagttctttgaagggcagactacatcagggaatacaacctctcgaaacaaactgatcatatgctactacaggtcgcgtcaagtcacaggttattgatctctctactcaagacggcgtgaagttcatagcagacaggctacgtgaaggtgtcctccctatcaccttccgcgacctcgccctcgtcgatgttgctgaactcgaggaaatgtgtcggccgatggtcctcgtgatagaagtccctgggcgtgccaagcttcatgttgtacttcatcagcgggtcgtgcttcactcccatgaagttgaagttccaaggggtgttatccggcacctggtagagacacggaagaaatgtaaaactctcggcagagtaagaactatctccgccccaaaatgttataacttctggctccagctccagatccgtatgtccagatatatagccaaaagttactatattctaggacggaggtagtaattcttatgttgttgagtcttgaaaaagcatgcgttagaaaatcatcaaaacataccatgtagaatcctaggaatctgtcactgagaagcatctggaccttctcgtagtgagtcgggagatatccatgtgggttgcttccactgtccttgttgctacggccccactcgtaaccacttggcgtcaacttgtacgcggtcaatgaacaagatcctggggtaaagctgcatgtcaaaatgatgcacttctcaccatcccattgcttgttgttctccaagatcttggcgtgcgatgtcaaatcctgcaataatcaacaaaacgattagtctagtcttatgacaacttgtgttcctttgcaacagctaaaagaaactgaaagcataaataatctaacctgtggtgatagctggggagcttcattaggctgggtatgcatccagcccagtggctccaaatcattaaggaactcgtgctcaggaaggtttgcaggcagtgtcaccatctgatgagttccgtgctgtggaggaatagctatgcatctgatctctttaacttgggggttatcctgtggactcagcccatatagaaaacctgcaatctgtgtccttaaatctgctatgcatatgaacttctttaatatattcttcggcataatgtaagtgtagccagtctcctgcaggtagaatatttgagt

SEQ ID NO: 89774 - DNA, 3024 bp, Oryza sativa
ggctttatcaattagatgatgtatattgtatgggtgatagtgtgagaaggatttaaattttcgtgcttatgtctgtgagtttggggctttgaaaattagctacctggttgggatgtaaaatttgccttctctactgttctcttcatcccttctcctgtaagcacaactttccatttttttgcaactagctttattcaaatatgagaatcttgcatttaattaatttttacactgggaaacatttttagaactgttgaatgggcatccaaacattggcatgtttatgagattttttagctttgtaggaagattgtggcatgtacgttttgctgtttctgcatcataagctcttttaccatattgaatgctatgttgcaggaggtccgaagtttgagccactgtaccgtgatatggagaagggggatgaggactggaatgagtttaatgacatcaacaaactcatcatccgccaaccacttaggacagagtatagaattgcttttccacacttgtacaataacaggccaaggaaagtgaggcttggggtatatcatactccaatgataatgtatatcaagacagatgatccagacttgcctgcattttactatgatcctttgataaatcctataacttcgacaagcaaggttgatcgtcgggagaggaggacaattgaagaggatgaagatgaggacttctgtctcccggatggtgtggagcccctcttgaaaggaacagaactttacactgatacaacagcagctggcatttcattactctttgctccaaagccttttaatatgaggtctggtagaacacgtcgtgctgaagatatccctcttgtatctgaatggtacaaggagcactggtgagtgccattatgacatccttgatactttttaatgatctctttttaccaatgttctgcctgatgcacttgaacttccaatgctaatcacattaatctctcttttgtagcccaccagcttatccagtgaaggtgcgtgtcagctatcagaagctactgaagtgttatgtgctcaatgagctacatcataggcctcccaaggcgcagaagaagaagcatctgatccgttcactccaagcgacaaagttttttcaaacaacggtgtttgtctgggcagaagcaggtttgcaagtttgcaaaacagggttacaatatgttgaacttgttgatccacagaaagaaccttaactacctttacttatactacaaattcaatttgaaacctgtgaagactcttacaacaaaggaaaggaaaaaatctcggtttggaaatgcatttcatttatgccgtgagatattacgacttactaagttagtagttgatgcaaacatccagttccgcttgggaaatgttgatgctttccagttagcacatggcttgcaatatatattctctcatgttggccagctgactggtatgtaccgctacaagtatcgtctgatgcggcaaatcaggatgtgcaaagatctgaagcacttgatatactaccggttcaatactggtcctgtaggaaaaggacctggctgtggattctgggctccaatgtggagggtgtggctgttttttctgcggggtattgtaccactgcttgaaagatggttaggtaatctactggccaggcagtttgagggtcgtcattcaaaaggagttgctaaaactgtaaccaagcaacgtgttgagtctcactttgatcttgaacttcgagctgctgttatgcatgatgtccttgatgctatgcctgagggtatcaagcaaaacaaggcacggactatactacagcatcttagtgaggcatggcggtgctggaaggcaaatatcccatggaaggtcccaggcctaccggttcctattgagaacatgatacttcgttatgtaaagtccaaggctgattggtggaccaatgttgctcactacaatcgtgagcgtatcaggcgtggtgctacagtcgacaagactgtgtgccgcaagaatcttggaagattaacccgtttgtggctgaaggcaaaacaggagaggcagcacaactacctgaaagatgggccatatgtgacacctgaagaggcagttgctatctacacaacaacagttcattggctagaatcaaggaagttctcacctattccttttcctcctctttcttacaagcatgacaccaaacttcttatactagctctggaaaggctaaaggaatcttacagcgtggcagtaaggttaaatcaactgcagcgggaggaacttggattgattgagcaagcatatgataatcctcatgaggcactgtcaaggataaagcggcatcttcttactcagcgtgcttttaaagaagttggcattgagtttatggacctgtacagctaccttattccggtatatgaaattgagcctcttagaaaatcaccaatgcttaccttgaccagtacttgtggtatgagggggccaagcgacacctattcccgaactgggtcaagcttgctgattcagaaccacctcctctgcttgtttacaaatggtgccaaggtataaataatctacaggatgtatgggacactagtgacgggcagtgtgttgtgatgctgcagacaaaatttgaaaagttcttcgaaaaaattgatctgacactgttgaacaggcttctgcggttggtcttggaccacaatattgctgattatgtcactgcaaagaacaatgttgtattatcttacaaggatatgagtcatactaattcttatggtctcattcggggtctacagtttgcatcatttgttgtgcaatactatgggcttgtgctggatctccttctgctcggtttaacacgtgcaagcgagattgcggggccacctacgatgcctaatgagttccttacatatgctgataccaaagttgagacaaggcatcctattcggctgtattctcggtatgtcgacaaggtgcatataatgttccgctttactcacgaggaagcacgcgatttaattcagcgttatttgactgagca

SEQ ID NO: 89775 - DNA, 2116 bp, Oryza sativa
ctgtacgtgtcgctcaagatggagaacgcgcggatcaccggcgacctcgtcccgcacgtctacggctccgagcccatcatcggatcctgggaccccgcccgcgccgtacgtacgccaccacgatgatgctcctccattccgttcatttgcttgatgatgatgaatgccgctcacttgcttaaaattactgttttgcttcgaattcgcgcccccccctgcagctcgcgatggagagggagctggcgtccatgtgggcgctcagcttcgtcgtgccgcctgaccacggtacgtacggtctctgcagttcacatgtgctgtttgatatgatgagatcattgggatgtgccgcttgcatgatgcttttgctgtttttgtgttcgtatttggggtgtgttaagaatgcaattggttattagtgactctatttatagtctgtcccatcttttttttttcaacgcaaaaggtcctgtccttttgttcttggcagtttttacttgttattggtgttctttttctttgttttttgcgctttttttttatagaagcgggttttgtgagcttgtttgatggactctatttatagttagactgtctagtaatccttgctgggttgctgtaccttcaggctgtcttcctgactgtaatatcaagtaaaacatgtaggatttttgcgtttatatttttctgagtagaattatgaaatttcgttagtttgtttgttaggcatagagtttcttgactcagttacaagaggggcagttagatttaacttacttaaaattctgatgcaaattactatgctcatgctatttcctaaccattgcaacttgtggaatctaccatagaaacactcgacttcaaattcttgctcaagcccaaggatgcagacaccccgtgcatcattgaggaaggtccgacccggcatctcactggaggcatgctcgagggcgatgtgaggattgcatggttcaagatgaatggggatcatgagacgcttgagttcagggttttcaataaggcagacattgtgtccccacttgatcttgcagcgagttggagggtgttcaaggagaattttcagccttccaaagtccggggaatccctgatgtcagtataaatgtcgcacctgcgcatgggaccgaggtgataacagtagttcaatttctatttgcatttgaaattggtcttcttgtgctttcatatcaatatatgatggtccgatttgattgcaaactattactatttaacctttctactccaatacttatttactgatatcctatgtttatctatagccaaacaaattgacagaaaaggccaagcactgaattatctgtttaaaacatctgcttcctttgaaagttatctctcgagggcataagtggccttgttctgaaagccgagatatgcttgttaaaaaggcatgtttaggggaaacttaaacaattcagtattcagatggaagagatcccatcgtatatgttattacagaatataccaatgaaactttttttttcgctggtgggatatttgctcttccattttcttcattttccctggaaccatctggtgcaacatttatcattgtacacgcttaataaaatttctaaacaaaacgaaatgccctttccatttcttcaacttttccacaaagcttccaatgcttgcatgatgttttgcactttaatgatgatagctagtctaatcaatgttctggtttctaacaggttttttttttcatatcttactgtaggatacatctactgaaagtttggagcttgacttggagcattacgttattccaacaccatctgcagcaacatctgaatatgcagcaaaccttgccgcaaacccagcatcattgattcaaactggagctttatggacaaatgacatgcttctcagtgatggcatccagagtccaagtagcgccactgcagattttgaagatcacaataactgtaacaaggtaagcactaaccaggtcgaatcggtatgctagaatatttgtcccaccaatgaattattatgtattcccccccagaaaatgaagtgtgttgtgtttttattttaaatcatattttgatgtgatatgtcacctatcaataaccatca

SEQ ID NO: 89776 - DNA, 809 bp, Oryza sativa
gattgcatgggtcaaaggaggaccgaaaactagctattgttttggtaaattactgctgtcatttcctctcttatacgactttcagtatttaatcaccagacatcaggagaagccaactttgcttgttggctgttgctatctaccagcagacctttctatcatgtctatatggttttaaacacataaatgaataaaaataaatgaaaatacactgagttatctgggagctaaaaagctaatctccaactatcatagtataataattatttgttattgcatcttaagattcatttgtatcactgcttattttgaaaagcagattttcttcctaaacatgtctacttgcaaacaggttggcctaccagctcgtggtaaaacttttaccgcagctaagcttacaaggtaccttcgttggttaggtcatgaaaccagacatttcaatgttggaaaggtgattatattcttttcctgattaattgttttgccacaatggcgtatgttggattgtttggcaagtgaacataactctcttttggttgaaactcggtgtgcagtaccgccgcctgaagcatggagcaaatcaggtactaataactaatttgctgcaattctctttgcacacactgattttctttgaagtatttcttcttgttaaatgctaccatgtcagaaattttcatttcaagttttgtaatccaattttatttgaagttactccatttttatatttcatttgttacatcgctattttattttggtgtattaagaatgatattatcttatgttctgattcatgagacacatgccaa

SEQ ID NO: 89777 - DNA, 3719 bp, Oryza sativa
aggtgtatgaaccagtgcaggaaggttcttacattaaaatgattgatatggtaaaagggcagggaggccagttacaggtaaattctattatgttatccctttccatgttttgcagtaaacaggctacattagaaaggttgagaatgtgacatgactatggaatgatgcatgggcggataagggtgtaccagttgggcactggcagccccaaaaaattttaccatcaagtatgtatgcattggagagactaaatattaattgcaaaaaagaatcaataggggacaaggattgaagtgacgttttttgtgatttgtaggcttagattaaattgagttgatcaaatttaaaccttatttttgtttgtgtgtatgattttgtttttttattcttgagacgtgtgggcactcccaatgagatatttttgggtcctccactcaatgatgtatggtattggtagcaattctatttcatgtacctttaaaaatactgaaaaatacttctgaaggacacaatttcaccaagggtcatagctcttagtgtattcggatcaattcattacataacactgtttggcttttattatcatatgtttttagcttctgaaacaagtcatgcattttagctttattttgattaattattcattattgtcaagctattaatttgtcctgaccttttatccaggtcaacaatatcagtggttatctccctggaaggattgtctttttcttggtatgtacttcaaattcaataatcagaaaatacaagaaataaatagcagaatgcagttctatgagaaactataattttgataatgggtcaatgataaagagcttttaattactagtgcattgatgtgacacatttctcaacatttaactgcaggtgaactctcatcttacacctcgacctattttgcttacaaggcatggtgagagtttacacaatgtcagaggaagaagtggtggtgacacggtccctgaggtttgctttaactttttttttcctttactaccttccaatggggcacaccttcagaatatatatttctactctgatatctcatttgagtatatggaagttataaaatgctatgagtaatattcagcaagttttcatatttacggaaagtgtactctgaaaatgcagagccatttatttgatgtattgaactaataaatttataattaatggtgcacagtgaagatggagagctttactcgaagaaattagccaacttcatagaaaagaggctcaaatctgagaaaactgcatctgtacgtaatctcttgattgaattgcattgtttctagaggcaacttcttatgtcagtatagcatttggagatgaagactgtaaaggagatgagctaatagagtgagagtctctcatttttaattattctgatgtttagatatggaccagcacgcttcagaggacaattttgacagcaagtccaatagttggattcccaaaggtaatcaggaaagttttggagtatttcttacataactcttgcaaggtagttatttatatgggcgttgcttaacaattgttgtttgcagatacaatggcgtgctcttgatgagataaactctggggtgtgtgatgggatgacgtatgaagagataaagaaagttatgcccgaggaatttgagtatgtgctattgttatctttgtttacatttgtttgggagttctttctttagtagtttacatgatgtgcccatctgctagactgctgattgtcaatttgtatcttacattgcacttttaactatcatggttttttttattaaaaaaaacacaatttgagttgcaaaagatggtagtaaggtataaccatacaagtcgcagtctaatgtgtaagtcttgcacttatcactggctggtccacttgtatttattgaatgcttgcatatgaaacacttatgatgcttttccaatacttgttgcaaccagatcacgcaagaaggacaaattaagatatcgatacccccgtggagaatcttaccttgatgtgattcagaggtttaatcatttcttctaatattattcagaaaaaacttttcacagttctttagactgcacaatgcaatggaaataatcaattctaccagtacgtcttcagtcttcactaacttgtgatttggtaaaatcctcagactggaacctgttatcattgagctagaacgccagcgagcaccagtagtcgttatttcccaccaggtaaatctctaaacttcatgatttttccttctgcagagccattgatcgtaaaccatttatcctgtttgtaggctgtattgcgggcgctatatgcatatttcgctgacaggcctctgagggaagtcccagatattgaggtcacacatatgatcttctcttgttcattattgtgctagaaacctaagaaatacatagaccaaactaataccctttaatcttcatgtagatgcctctccacaccataattgagatacaaatgggagtcacaggtgttgaggagaagaggtacaagctcatggactgaatatacatacatctaggctcagtaggacagcaagtctttgctgttttcagatagtcatacagtaacacagatatacgatcgagtcactacaggtctacagctaccacattgtcatttttctcccgacggtgcaaaaacaaaaactagcacctccggtgtaaaactgtaacccactatacccatgaatcactgtaaaaagaagcattcacccaatcagtagttaaaaaaaaaaaactgtaaaataaaaggcatactgctaccaataaagagtgcagatatatacatatagggccctccctaaattttttttctaaaaacatcacatcgaatctttggacacatgcatgaagcattaaatatagataaaaaaaactaattgtacagttatggagaaaatcgcgagacgaatcttttaagcctaattagtccgtgattagccataagtgctacagtaatccacatgtgctaatgacggcttaattagtctcaaaagattcttctcgcggtttccaggcgagttctgaaattaattttttcattcgtgtccgaaaaccccttccgacatccggtcaaacgttcgatgtgacatccaaaaattttcttttccccgactaaacacacccatactgtcaaaaggtaacagaagttgtggctgatccatcactgcttagttggacttgatgagactgacctaccaaactttgaactgtcctgtcctcctgtgccatgtgaggacacaaggcaagcagtttcttgctccagaaactctgctcacatcatggcacgatgctgaatagtatgccaaaaacttccttgattccatgcggcctccatggctgctgctgctcatttgtccctgtctcaacaccccttctatctaacaaacactagtaccattttgtaaattatgtatgacgcggttgactttttattaacgtttgaccatttgttttatttaaaatttatgtgaaaatataaaaaattttatgtcatgcttaaaaaacatttgatgatgaatcaagtcataataaaataaataataattacgtaatttttttaaataagatgaatggtcaaacgttaaacgaaaagtcaatggcatcatatattattaaaatatggaggtagtactttgtaagcttgtatgcttctactactatactagtgtaatgcattgctattgcct

SEQ ID NO: 89778 - DNA, 1308 bp, Oryza sativa
gtgatcagcgtcacggcgtgcgcgctgaaggcgcggccctggacgccaagcagctgggcgcgctgccggtgttcacgtgggggtcttcttctccggcgacggcggcgccgaacgccgccgtgcagtgcacggtgtgcctcggggagatggaggacggcgagctggggaggctgctcccggcgtgccgccacgtgttccacgccgagtgcatcgacacgtggctcgccgtgagctcaacgtgcccggtgtgcaggacgacggtgggggcggcggaggatgatgagccagcggcggctccggtcgctggcgtgtcgccggcgagctaggtgtgttgagtatcagtgtacattcgatcacttgctagagtttgtatctatgcacttgaaaacaaaattcgggtattttttttctttaggaaacaataaacttcgtaggatttgtacattgcaaatcaaatcgaccctgaatgagcacagagaaacttagaattctcgacaaattccaattaaaaactttatatcccactttcacatagcgtataaatccaggtgctccatatttcaacctctctgtgtttagggcgactgggttgcttgagattgatttaaccacatgtgcttcaaacaaatatttaaccatatctcatcggtccggactaattcaactagaaagccaacaatccatggattaaccatgatgactcgaggtaaaacttgaagagctcattacagcatgacaccatctcgaaggttcactgcttgatgcataagaacctactccctccgtcccaaaatataaacatttttagctataaatctagacaactatatgtttagattcatagctaaaaattgttatattttgggacggaggtagtagtatgtttccctacatcactaacccctggattggcagcctcagatgatatcactgcacttcaccaatcacaggctttcagtttcagaccatataccttgttgggaatttgagacagctgaagatactggtggttctctcgcaaaacaatcctgctggaaatactaacttttcacataaatttcaaggaaatccagacaaagttgagatgggggtcacttgttcagggaaaatttttctttcaagagcctttcttcagagtcaccgacatcttctctgccgttgatgcgcatgcacgctgcatgtcccctgacgtcggtgggccgggccttcgtttgaagcccatatactacgcgcaaaaggaaggaaacagttttgattagtcccaccgtgtaaatatacgacgccagaaacctgcataaaaggaagcaa

SEQ ID NO: 89779 - DNA, 1046 bp, Oryza sativa
aggccatactatcctgctccacagagcaccaacataagtgcacctgtgccaacgcttcctatttcttgtgacagtgcaccatttgctcatggtgggtacgcccctagatcagctcatcgtaacaacttacgcacttatcctcctccagcttttgcatcgtcttccaaccctggagcagtctcccatgagccagctattcctagctatccacctgctgcccctagctatccacctgcaacctctgcagcatcatcaagtgtccagccatttcatgctgaagctgctgcacatttgaggcatccaaggcatgtatctgtagggggcagtggtagtgcaaggagtagaaggatgagggattcctatcatggttttcatcatttgatgattgaagacaataacttgggaagatcagcagctgaggtagatattattctctcctcttgatatcagtacaatgttaaaattttgaacacgcatctaatctattttcactctttgtagcggtttatgatgctggatcagttagttatccatgaatcaagagaagcattcgatcctcactgggacatgagactggacattgatgacatgagctatgaggtagaaagaatcaattttctctttaataccacagcagctttagaatgctatttaaacaaatgcaactttttctatacacaggagctgctggctttggaagaacgcataggccatgtgaacactggcctcgctgatgagaaaatttctggctgtgtgatggaggtagcctgctgcagcagtagtcatttgcaggatgatcaggacaatgaaagatgtgtaatctgcctggtaagatagtggatggtaccaatctacctactatgatagcgattcccgcagcgcattttacgcaatacaagttacttaatccacaacctctttttcactgcaggaggaatacaagcatgaggacacacttgggaggctgaaatgcggccacgggtttcactgcaattgcatcaagaagtggctgcaggtgaagaacacctgcccagtttgcaaagctg

SEQ ID NO: 89780 - DNA, 1580 bp, Oryza sativa
  unsure (1)..(1580): unsure at all n locations
gcctgatgtcaaacccaaggctgcaaccaattttaagaagaaaggcaagggaaagacaaagggagactgctttgtgtgtggcaagtctgggcattgggccaaggactgtcctgagtgcaaagacaggaagtctgccaacatgatcattagcgagggcggaggaacatcggggtatggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcacttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagtggaggcttgttccgcttttctttgaatgacatgtgttataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaactttgaaggaaaatcanacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatagggctgtttggccaaggtaaatgtacctatagccaaaaagcggaaacttgaaccaaaaactgttgattgtgtgtttcttggttatgctatccacagtgcgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacgatgatcaaa

SEQ ID NO: 89781 - DNA, 1725 bp, Oryza sativa
tgcctgcaggtcgactctagaggatccccaagaagatagcatcagttggcgttataacaggccagccgtgcaggcggtgacaccagtcagcggcggatgcagcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcattgcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggcccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacaccagtcggcggcgacgaaggcaggccggcggtgtagatgccgatgcccatcaacggtggtgtgaccaaccgcccgtatagacgaggacaccagtcggcggcgac

SEQ ID NO: 89782 - DNA, 631 bp, Oryza sativa
ttctttcttaactagtgggtgaacagtgattcataatatacttcttatttgcaggcgttctgtgatctggagccaatcttctcgtacgaaggcacctatgacatcaacagcttggtgaccggaagagagatcaccggaatcgccagcttcaaacctgctgcattgacaaaatctcgtctttaattttttttcctttcaaatgtatatagctgcaatagacaaaataatatacgtccaccctatattttgatgaaagcaaatgggcaataaaaggaatagaaaaaccatatttgttcttgaaaagaaaataaaagctctgatatgcttcgttttgctaattctttctgaacagttctgttctactctttctcttctactcaaagcgaagaaagctgggcaatgtattcagtagaaaaccatttaaggtgctcaatctttcaaactatcttaaataacagactcttatacgggagtaaaactaagatatgttttatatttcaaagtatttgaattcttcataagcatttgaccagcctgattttatattttagtgcgacgtttcaattttgcggatttgaacatagattttactttatttattcaaaatgtagcaatgtatgagatgatgttg

SEQ ID NO: 89783 - DNA, 2538 bp, Oryza sativa
  unsure (1)..(2538): unsure at all n locations
ttcgtcgcggccgatcacgcccaaggacaaggcccccgctgtagcgacgtcgcggccgatcacgcccaaagacaaggccaaggcggcggcggcgtcgacgtcgcgatggtccgcggtgtcgccgaggcagctgatgcagaaggcgtccaatgcctttacaagaggcagcagcagcaagtcgcgcgctgccaagaaagacaaggaggcggccaccccggcggcgacctcggccgccgccaaggacgcggccactccggcgtcgacctcggccgtccgcaagaaggccgccacaccggcgacctcggcggctggaaaggcggtggccggtgcttcgcccgggccgacgagagcccagcccacggaggagcaccaccagcaacccactgaagcgccgccggccgaaccgtcacctgccgccgccgcggtgcaagaagaggcggtgacttcgagagcccagctcacggaggagcaccaccagcaaccacctgaagcgcccgccgagccgtcacctgccgccgtcgccgtgcaagaagaagcagcggctgcggagaccgaagcagagcaagaaaaacaaccggatgagacgccgcaagaagtcgtcgcggcagtggaggagaaagttcaagacgagcaggttagcacggaagcagcggaggaagccatcgccgtcgaggaggatgccgccgccgtgaagaccgatgcgccggagccggaagagacgcagacgcaaaccggtgccattgcagagtcggaaacagagtttcagaggagttcagaggatgagccggcatccgacgccattgtcgaagaagcggcgatcgaatctgcaacgcagaatgagccagatgaaccagaatccaccacggttgaagagatgcccgtcgaggaggagatcaagcccgatgagagccaacaagaagagacgccaaaaccagaagagagaatggagaactctgaaacaagcgtgatctctgaagatccaaaagaaatggatgcaatctctgaagaccaaaaggtggaagaacccgtggttgctgaagaacaagaggaactctccgaggttgtaaaaatggctgtcgagccgagcatattgtcagagccagcaacgccgtggaggaagaagatcgcgacgacgtggagacggagcaagcgaactcgtcggagcccgcaacgacgggggaggaagaagaagatcgcgacgacgtggagacggagcaagcgagctcgtcagaccccgcaacgccgttgaacgaagaagctatcaacgaggagggcacgtcgacggagacggtgaagacgaagaaggtggcgttcaaggggagcaaggtgaagacggcgatggagaggcggccggagggggagcagccgaggaagaaggacgtggcgcggagcaacgacgtgatcgaggagaccaagaggacgctgatgatgaaaaggaagagcaaggtgaaggcgctggttggggcgttcgagacggtcatggacacccccagcccgggaaaatcgagctgattttgatttggatttttttttctttttttttggagggaaagcttcagcggagatgcacgtattgagtggtttgaattgaactgcgaggtgtgctttgtggtgtgatgtttcggtttcttgttctctttgttgcattgatcgttgattgattcttctgataactgaaacaaatggaaatgttattgtcgatttgtttgtttgttgatcattcgatctagtgttgtttactaggcttagttgtatgtaactaaaaagggaaatagctgtgtgttcttgagagctgagactggtgtggttgtcaacttgtgctacattgctgagttttgagatttatgcttgtaaacaattattgatgacatgcaatccattttgtacgttttttacatgttcatggatatggatttctttatagtacatgccctcatttcatacatgaaatttgaatatttattgaaaataactaaagaaatgatgatatcatctaccctctctgctccaaaatataaacactagttgaaataccaaaaatataataacttccaatactattgatctcatcaatcacctttcatttaattctttttctgatcttacctctaaccattccgataacaaagtatttttcttgttaggtttactctcagttaatttttttttaataatggaatagaacatcatcctcaacaagctacaaccaattattacatccaaacactcaaagtgagtgtagtctctgttaaataacctagagattattatattttgaaatgaaaggaagtaccattgtatcgtactccctccgtcctacaatataagggattttgagtttttgcagcgtttgaccactcgtcatattcaaaaattttttgcaaatataaaaaacgaaaaagttgtgcttaaagtactgtggataataaaataagtcacaaataataatttaaaatttttttgaataagacaagtggtcaaacgttgcaagcaaaaacttaaaatcccttataatctgngacggagggagtaccaaat

SEQ ID NO: 89784 - DNA, 2665 bp, Oryza sativa
  unsure (1)..(2665): unsure at all n locations
tttcctggaacagaatatttgtataatcacttttagccgtaaaataaatcaatttctgcatattacacgtattactaccggccggtaaccaggctgaacatcttcaattttcagtagtaggcagttttagtcatggtgtcatggtgtccacgattaacatttctaagtttatccaaaaagattcagactaattcgcctgaaggcatatacttggctgatcgaaatacctggatagctagtcatggtgcacacgtcgacatatctgatggttttttctgctcgcattggcaactaattaattaaattaatcaaccaaaccaacgggcgcagatctgcagcggcggcgcgcggcacgacgaggtggacttcgagttcctgggcaacgtgagcggcgagccgtacctgctgcacaccaacatcttcagcgacggcaagggcgagcgtgagcagcagttcgtgctctggttcgaccccaccgccgacttccacacctactccatcctctggaacccacacaacatcatgtaagctctgaaaaatttaaattttatcttttaggagtatcttttcttttttctgggcttatatttatacttatcaatcaaaatttaaatttttaacattaaatttggatttgatttttagagttttttaatcatagtttatttttcagaacttgtttttaaatcgctaagaacatttacataaaagttttatttataaattatttttcgtttgtaaatatgtcgtttggctcggtctcctcgtcaaattcagagagacaaacctgtgtgtaacaaatctgtaaaaaaaaatgttggtggtgcagactgtacattgacgggacgccgatcagggtgttcaagaacaacgaggcgtacggggtgccattcccgacgcggcagccagtgcacgtgttcgccagcatctggaacgcggaggagtgggcgacgcaaggcggccgcgtcaagacggactggtcgcgcgcgccgttcgtcgccacgtaccgccgctacaacgtctccaacgcctgcgtctgggacgccgccggcgccggcgcctcccggtgcgccggcggcggcggcgggtggatgaggcggaggatggactggtggagctggatgacgctcaactgggtgcggatgaactacatggcctacgactactgcgccgacaggaagcgattcccgcaccgtttccccgccgagtgcatcatccccatcggtagaacgtgaggcgtcgtacgcgacgtcgactccatgatgattccatccgtcgtccagcgatctgtaggctcatacttgtgttttgcagtgaggggaactgaatgaataatcgtctcttcttgatcttttaggtttgggttgagttgtgcagggtaatgtggaaagtctcaactcgttccagagatctgtttttttctttctttggtggccacgacgatgtaaatggacttcttgtttgatttttttttctaaagatctattcgtctcgtgatcgtccccggcttttattattgtgagacgacgagctatagaactctgcaaattggatgtttgggccgtaatggcgaagtattagtgctgggcctttatgcttggtgggtatgggcctatctgccaaagtattaagcccaataatttgtggaatgggctgaagcgtacatggggactggacctgctattaatatctgtataactcacagacttttttttacatatatattcgagatgtctagctcctgtgaagaaaacctcaggtgaattcatccatgaacaaaacgagggatttccagtgcgatgtgcaattttaagttttttaatatgcaccaaacatttcttactgttacgcagagagaacactattcctactactttagttgttcacgtccaaaatctcaaattaaaggaaggaattgttctgctttgtgtgtccacagtgcaccgtgctcgcctgtcctcccagtgctcccctctaacttagccgccgcaccgacatttcaccagcaataatcaatggatgcgaccctccgaaaaactggaccttatcttcgatcagctagctagttcatcacccttccgaaaattgaagtcctcacggttcttcttccacctccctttcaggcatcaacatccagcagaggacccgaaatccccgcaaatatcccttcatggagaccacgagctactgcatgagatgtgctactgctgtttgagatcagcagaagagcagagagtctagtcagacagctgcttccaactcggctccagattgctacaaggtgtacgtccttctcttgacaggcctagacgatttgtcatgcagcagtattcgggttttatcttttcgcttatacttatacttataagtcaaaatttaaatttttaactttaaatttaaagctgattttagagtttttttttatcgaagtttatttttaatataaacttttaaatcgctaagaacacgtatataaaaattttattcataaattagttttcgtttacaaattcccttaaaatttatttttttcgtttgcaaatatggccgtttcccttattctacaaataaaccaaacaatgaagctaggagtaagagattttaatattttttngtnntntntnnnngngnnngnncntactgtaccntaatacgatgnagcctt

SEQ ID NO: 89785 - DNA, 647 bp, Oryza sativa
cagccgcagcagcagcagaatcaacaagggactcgtgcgccccgtcctccttcaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttccttattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggcccgaacaacccggttgttttctttgcacccccaacctcagtca

SEQ ID NO: 89786 - DNA, 1035 bp, Oryza sativa
  unsure (1)..(1035): unsure at all n locations
cgactggttttganaatcgactcggcaccctgcaacggccagctcctgacgctgtcgctggacaggtcgtccggctccggcttccagtccaagaaccagtacctgtacggccgtttcgacatgcagatcaagctcgtccccggcaactccgccggcaccgtcgccaccttctacgtacgcatcgcatcgatcatcgccaatcgagtacatatgcgtatgcctgcctgtaagagctaatggtgattgggtgttgcgtggaagcagctgtcgtcgcaggggtcgcagcacgacgagatcgacttcgagttcctggggaacgcgagcggcgagccgtacacggtgcacaccaacgtgtacagccaggggaaaggcggccgcgagcagcagttccgcatgtggttcgaccctaccaaggactttcacacttactccgtcctctggaacccctcccacatcctgtacgtatcacggttatgttcttttcactttttttacaccaatgcacttatacattagtagagtcgtggttatatgactcaactcattagaatataaattctgttgcttacgaatattaagtaattttatcatacttgaaaagtactgggaggtgccatattttttaatttaaaatttagtacatctaactactaattatcttgagttaccaaaatttctagtataaaatcttattacctctagacactttatcaagaattataaaattcctcatgaatattatgcatgtgtagatgggcttttaataagattttagtgatatcgaaaatatatcattggtttgtgttagagtgtatagtggtgtgcgcgtgcgcgcgtttatcgtggtaatcgctaaaatgacaaaaggatcaacttctgttaatctgttttgtttgttcagtttctacgtggacgggacgccgatacgggagtacaggaacacggaggcgacgacgggggtggcgttcccgcgggcgcaggcgatgcgggtgtacgcgagcctgtggacgcggggtccagctgattcaaaccagc

SEQ ID NO: 89787 - DNA, 1552 bp, Oryza sativa
  unsure (1)..(1552): unsure at all n locations
cggcgcgagctcgattccgcggggagacggtgcggcaagggcgngaaacgggcnaaggaggcgcgggaagggtttaaatagggttggaagttggagagaaaggaaaccggccggaaggtccgaccgccatcaaatggcgccggcgagatttgcgggagcaaatccgcccgtttgaatgcaagagagagagggaaaaatgggggaacagggggaggggatcccgggaaatatttccccccacttaattgcacccggggacagcgggatgcgccgaattcgccgtcgacggcggcgcttggcacggacgggaagcgggaaccgccaggagtacaaggatgacaggtgggccccacccgtcagcgagggtggcgggcgggcccgcccgtcagcggcgcgcgcgcgggaaaagcccgagtggcccccggggagagaaaaaaaaggggaagggagatgggccgagccggcccattagaggaaaggggacttttttgggtttttctttttataaaacctttttaactttgtttatttcttcttaattattatttgtgctctgaaaattccactaaaatttatttacgcattttaggcttttaggaaatatacaaaaatcctccaagccttatttgacttttagctttgcacattttaatttttggaggctttcacatggattttacttattctttgcataatttcgaggatgtattttagagtcgatttgggacgcggcaaccctcgagtaaaggacataagtttatattggtagcaaccgattattttaccaagtgggtagaggctattcttttaaagaaagttgattctggggatgctatacagttcgttcaagagcatataatctatcgatttggtatccctcaaactattacgactgatcaaggttcaattttcgtatccgatgagtttgttcagtttgtcgatagtatgggaattaaaatgttgaattcttcaccgtattatgcacaagctaatgggcaggccgaggcatctaataagagtttgatcaagttgattagaaggaagatttctgattatcctcggcaatggcatactcgactggctgaagcattgtggtcttatcagatggcttgtcatggatcgatacaggttcctccttatgaacttgtttatggtcatgaggctgttttaccgtgggaagttcggattagctcgaggagaacagagttgcaaaatactttaacagccgatgagtactataaccttatggccgatgaaagggaagatctggttcaatcacggctacgagcccttgcaaaggttactagggataaggagcgagttgcccggcattataataagaaagtagtacctaaggacttttcggaaggtgaacttgtatggaagttgattctgccgattgggactcgggatagcaaattcggcaagtggtcgccgaattgggaaggactgttccaaattcataaggtggtgtctaagggagcatacatgttgcaaggactagatggagaaagttatggccgagctctaaatggcaaatactttgagaaga

SEQ ID NO: 89788 - DNA, 737 bp, Oryza sativa
  unsure (1)..(737): unsure at all n locations
gtggtttgatatccacttggtacccctactcagatctcccaaaacacaggagtagggtattacgcttctcagcggcccgaacctgtatacatcgcccgtgtcttgtgtgtttcctgtcttgcgagccttccacatacagagagcttagaatctctccctgagtccccggccgaaccggcaaaggggggcctgcgcggtctcccggtgaggagccccacgctccgtcatctggcgcgccaagtaaggggctctgcgagggattttctgagctctcgcactctttcgtgtgcgccaagcttttcctgttcagcccaatggccgagccagcaaaggcgcacgacctctccccgagtatgagcggggacgacggggagccaaacccacgccgtcgagctcgtactccactgccccctccacgccaaagtcctaggtgggagaaggcgctcgagagggccgaaggatccgcgacttcgacacccacaggaggtggagaaaggcggcgagatggggagcatcgcctcctcgtctacggcgacggcagcacgccccagggcgcgcttctacgtcacccgcccgtcgccatgacccggagtcttcagcccaacgttggctggacgatgtggccaaattggtcatgacttgacngcacgcctaaatgctgtgggcngtccttcgcaccaaaggctntgtgctgttaccatggctccgattntaaaattgaggcgcgcaagcgcacc

SEQ ID NO: 89789 - DNA, 2004 bp, Oryza sativa
  unsure (1)..(2004): unsure at all n locations
agtggctttgaaacccattttganatccnagctctgtaccctgaaaagatcgcctccaaggagccccagactaccgcagagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggagaagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggcgacctcaaagtcgcgctcgcttgtctggagcagcgcgcggaccacctcgtcgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccgaaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgattccactgcggggtgcgaccttttgtgttttctagatgcatactctggttaccatcagattcgcatggctagggaggatgaggaaaagactacgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgtgcaactaggaaatgttactctcagatctagcggaa

SEQ ID NO: 89790 - DNA, 726 bp, Oryza sativa
  unsure (1)..(726): unsure at all n locations
atataataatgttagccgcgcaatctgcgtgggccaccacgctagtttacatcattgtaagtgtaccttctatcatatcacatgggtaggggccctgaaaatatatcctaattaatgtatgacactttttatgattataagaatcaagaaaagaattggcgggaacaaatacaacaactgtgcgcggtggacttgtgaacatggacagtgagaatcgaagatcatcatggagaagaagaggaagaagaagaagagagacacagagaagaattcaccaatttaccctctctaccacccaaatgtgagctatactgctctacgttattagttgaccttggtgcagactcgccggatctcggcgtcggagccggcggccgtcttgacgccgacgcggccgagcttggtgatggcggcgacgaaggcgtcgaaaaaggcggtctggttggcggcgaagtagttgacggtggcgcgcgagcggcggtcggcgaagagcacctggtcggaggcgaggaggcccttgagctgctgcagcgtctggaagtagccattgtcgaacttgttgggcgagacggcgtcgagcatggcgacggtggtcgggctgtagctgagcgggcacgtnttgctcatctgccgcaggaacgcccagttcatcggcgggctgtactgcggcgccgccctcttgaactgtaacagccgcccacgaacttgttgcagtgcgtcacccta

SEQ ID NO: 89791 - DNA, 1794 bp, Oryza sativa
  unsure (1)..(1794): unsure at all n locations
gcgcgatganccgaattgccgagnacnnctcnnnnnnnanngnaanaaaaatacaaattttccaccaacattcttttcccaaccaatcacaacccttcaccattcacttttcacacctacctctactattcatccaatcacaaccctccaccattcacttctatctactttcttaataaatatatataacccctaaaacttcttatattctgggatagagggagtatatacaatggtttgcttgtagcatttatgcagacagagtgacacatcatcagactggttggccatgcatgccatctgttgcagcagcaacgttttgtgttctttgagatgctttagggccccaaaaaggtacaaatggacacgagaagcacctttttctgttgcaccaaatcatctattcattaggccatgggcatgatttgcacaggacaagatgctttcctatgagtttggcattgctagatgaagggacaacaattgagaatgaaaataggaggttggtagcaatttttgggagctttcgtacatgtcgttagcactgtctcttcaacagttttaccaaagtaaaaaatgttgttaatctcttgtgcttctgaaagtatggaaagaggtttcaccatgtgacaatttcttgtttatcttaccaagtgaaaactagtcccaacttttttttttcttcagttaagttagttggtaaagcaagcagtttagtgcttatgagttgtgacagctgatttcccttcagaaagcgatggcatgtttgctccaaactaagacattatgatggcaatccaaaaggagttgtacgtgacaatgaattggatatactgtagagtgtagacctagaaagaaaagcagtggtgtgtggaaggcataaggaattgtgttctagagtcacgtttttatcaccattatttttcttgtttgcttattattgacttgtggttccctatttcactctagatagccaagggaccaaactgagaactagtttgtaacctctatacagtactccctccattttaaaaagaacaaatactgcttaaaatttgatagctttttcaaattcatagccaaaaaaatattttttaagggacagagatggatgctgtatgcatctatgggtcagttacaaaattatgcaacaaaagcattgtcgaacttcaggaaggaaagctgtttaggttgggcacacaactgccccccatgaatgacatggccaagaattcaagctgatgtggaagtttgagatattaagtctatcagaaattaagggcccctttgaatcgcaggatagaaaaaacggaggaatagaaaaaacacatgattctgacaggaattgaagtgtaaaacagaggattgcaaaacacaggaaaaacacaggaatggtcgtttgattggtgcacaggaaaaacgcaggaatcggatgagagagatagactcaaaggaaattttccaagaggttggagctcttgctaaatttcctctaaaatccacatgcaatgtgccattccataggaatttcataggatttggaaagcttcaattctttgaatcaaagggccaaataggaaaatttcctataggatttgaatcctattaaattcctacataaatcatttaattcaaaggggccctaaacgctggtttgctaaattttccagccagctagtacatacttctattgctgtggtaaatttaatttgaaggtctggaccatgctgaatctttctgttaaaggaggctagtcatggaaacggcatgttcatcgctttgtcaagaaaatag

SEQ ID NO: 89792 - DNA, 1119 bp, Oryza sativa
ttgctcaaggcacacaagtgcatcggtatgaaataatgtgtgttgataggagcaggcgtggtatctatcacaagaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagatgcatcagaaatgatatggatgagtcagaagcaggtgggaggactttacgttgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacgtatttgatgcaggtatggcgtacgacacaccggtgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgct

SEQ ID NO: 89793 - DNA, 1659 bp, Oryza sativa
  unsure (1)..(1659): unsure at all n locations
ccatccggttttagattgttatattttctagtgtagaatttggcactcagaatacaaaattttggtactgtaaaatttgtcatgtttttgatacctgagagggcgatcatgtcggtctgggtgaggccgttggtggcgaagagcttgttgagctggtcgaggtcgaaggcggcgccggggaggctgtgcttcaccacggcgcgcgtcccgaccttgccgtcaagccgccccagctccacctggtagtagggtcctcctgcctgcatcaacgacaaccaccaccactgtgattaccaccacacatgacacatcatacaacttttgcctttgccttgcagtgaaatccaagcaattttactgctactacagcacgccgttcttgccatcaactgcaactactcacgagtgtgtgtgtgtgtgcgagcagaattttcggcatggcctaataataattggcagatttccgtagctctacgagtccacagcctgcctgtcgactgtcgagagcgtggctggtttggtaggtacgtgttggacgccggcgtctctgcttctgtatcgccgtaccgtacgtacgcgcgcggctcatttcagcgccccaacccataccgcgtaggagtagtagtagatttgaacggtgtgtttagttgacgctaaaattagaggtttgattgaaattgaaataaagtgatgaaaaagttggaagtttgtgtgtagaaaagttttaatgggatggaaaagttggaagtttaaaaaaaaactttggaactaaattcggcctatacttgtttttcacgctggagaaaaaagaattgatggatccaatcggagaagaagaaagaccaaagcaacgacatcgcagtaactctcgctgacgagacgacgaccactatgcagtggtggttacatggacaccctgctctgaattaataggacagctgaattcggacatgctaggggggaccacctccctcgccctcgcgaattttagcgccaaatcccaatttttccgattccattcggttaggtgaatgaattctctgcttggcttgcttctgtggagtattttgggcttctgtttagtgtagcaaagcaccggaccgatcgatataacgaagcgcacagcgagaggcgcataattgccgcacagctaagagcgtggactcgtgccgagccgggaacacgctgcggcgccgtgcggggcggcatggcatgtcaccctcatcatcgctgtcgcgcgcgcacggtgaaaaaacggcaaaaactacgggcgaaagcgaagttttctctcaagcgagcgcactcgaagcggcacgcgcgcgcacgccgagagagagagagagaggggatggtgtgggtgtgtttacctgggagacgacgtcgcgggcggcgagggcgaggatgtcggcgcaggagaccttgttggcgcactgggcgtcggcgtcgacggcggccttggcgcgggtgatgaggtccagcgcgtccggcgacagcgtcgtgtccgcgcccgcgctgtgctcgtcgtccggccccgcgatcagcaccgacgcgtcgcacccctgcacacgcacgagcacgacacggcacgatcagcaacacgaagaacacggagtcgatggcatcgggtaccgagctggaatagcaattcaatnggaccac

SEQ ID NO: 89794 - DNA, 692 bp, Oryza sativa
  unsure (1)..(692): unsure at all n locations
tatcctaattaatgtatgacactttttatgattataagaatcaagaaaagaattggcgggaacaaatacaacaactgtgcgcgggggacttgtgaacatggacagtgagaatcgaagatcatcatggagaagaagaggaagaagaagaagagagacacagagaagaattcaccaatttaccctctctaccacccaaatgtgagctatactgctctacgttattagttgaccttggtgcagactcgccggatctcggcgtcggagccggcggccgtcttgacgccgacgcggccgagcttggtgatggcggcgacgaaggcgtcgaagaaggcggtctggttggcggcgaagtagttgacggtggcgcgcgagcggcggtcggcgaagagcacctggtcggaggcgaggaggcccttgagctgctgcagcgtctggaagtagccattgtcgaacttgttgggcgagacggcgtcgagcatggcgacggtggtcgggctgtagctgagcgggcacgtctgcctcatctgccgcaggaacgccaggttcatcggcgggctgtactggcgcgccgnccctttgacttgtacagncgncgcacgaacttgtcgcagtgcgtcacccctatcgtgtgccttctgcaccacattcgtacgactgataagcntacangcagacgatgaaaacagatttac

SEQ ID NO: 89795 - DNA, 1078 bp, Oryza sativa
atatgccccaagcttgattcccaatggaggtgggccatctccttctgccatcggctacaatgcccgaaagacctcagcacttctccgaggactcatcagagaaccagccgatgccggcgagaagcggagaaccagatcatcggctgcagatccttcagccccggctccgaagaagaaggctaagacaaagaaagctaagccagctgacgatctacccaccctagatccatccatcgaacaagctctggatgaagaagaaattgaggaagacatcgaccaagctgcagccgaaataagcgatactgaaaaaacaccatcggcttcacctaagcaggctcctccattcccttctgctccagctcaattggcaagggtaagcaactttctctgtccacttttgcagtcatctactttatagccgattcctcacaattttaataaatatagagaaagaaaattgtcgtgaggaagaaatcggttactccaacccctaaaccagctccaccagtaagatacttctatcatctcattaactgacttgggctgattatatctaacatttatccctttggcagcctcctcctcctccttcttcccctcttatgcaggcagaatcaggcggccgcactccatcggctgcaggcagtcatcatgttgaagaggaggaacaattagctgcacctactattttagtaagttttattaacataaacttgagatcggccaatcatatcttgatccttaatcatccatgatattgtctcttgcaggtcttagccgatctgttctcctttgacatcaaagattacctcgatgaaacagaagaagacaccaccagtaaagcaacagctctcctgtctgatgatgtgaagaaaacactcgaagacatctcccatcggctaggagaatcactagataacctggtgaccaactgtggctcgatccgggcaaggtttgcagatatccaagcctctcttccggacgaattagtcgatgctcttactccagctgcctacctcgagcagcatcaattcaaactggagaaagccaggcagaggttagccaatcgccgggaacg

SEQ ID NO: 89796 - DNA, 2092 bp, Oryza sativa
ctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgttggtttttccttttgaagaatcttgacttgaaataggtcactcgtgctcaatcctgccctcgggggctcgggtcggctaaaatcgccaaacggggcccagaaccgagccgtgccccgaggcgtggtgaactcccagggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggataagtcgctttcgcccgtggccgccccgccgctgcgcgccctcgcgtccagct

SEQ ID NO: 89797 - DNA, 1079 bp, Oryza sativa
  unsure (1)..(1079): unsure at all n locations
agacagtttgccgacaatttgttgngcagggcctcggcccctttaaaggctggcttccgttccgttaagcgggtcctcccgaagcggaagcgtgaactctttttggcgcaagaagcctcgtgcgccaccagcgttgcttcccgaatggtgacgccgccctcgcggtccgccagatccctctccacgacgcaggcgcgcttttcaagcgccatggcgcgcgcctcaagggcctcttcgcgccgccggaacaccgtttcggtctccgccgccccgctgttctcgggcagcggcagcgtcaagcaccccttgggcggcgtcgagctttttccctagctccgcctcccagctcccgtattaaggcggagggtgtcctgcgcctcgttcatcatggtggtggcaatgagggcagccccccgctcctcttccacttcattggcgatctccgccagcaccttcttacgagtttcaagctccgagacgtgccggcggtgagccttagggcccacctccaccatggcctccaccgagcgtcgccccttttcgacacgcgcccacgcggcgtcgagctccgcccgctctgcctgcaggacctccacctgggcacttaacccatccaacaccgtggtgtttgcggcggccaaggcctgcagaaggggctttgcgttcagtagggcgatagaaggcgtggggaagagccgccttggagaggatgccacgcggctcgggccgccgatggaagtgccggactcggggatgtccccctgacccggttggtcctgagcgtcgcccgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcagcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaa

SEQ ID NO: 89798 - DNA, 1001 bp, Oryza sativa
ctgggagtataaggagaacgaggtaattgagggtgcaagatatgctcataaggatgagatgaaggaggcggggaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacttgttctatgcatagatggaacttttatgacaggtaaataccgaggtcagatattgacagcaattaggtgtgatgggaacaaccaggttctacctatggcttttgcatttgtagagagtgagaacactgaaagctggtactggttcctagagagagtgcacaatgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacaga

SEQ ID NO: 89799 - DNA, 1741 bp, Oryza sativa
gacgctcaagatgggcatcgagacgcgcctccgcgacaagatccccgagatcctcgccgtcgagcagatcgtcgacaccgagaccggcctcgagctcaaccacgacaacgtcgacaaggtcactgaaatgctccagtaatcctgcatttccaaagttcattagacagcaagttcatgttccaatttcagttcagacaaattcagtagcttactcctgtgaactatcacactgtaattctgaaggttttttttttgggtgttgcaggtgctggatgagatcagaccatacctttccggcaccggaggtggaagccttgatcttgttcagattgatgaatccgtcgtcaaagttcggttaactggacctgcagcgggtgtaatgacagtacgtgtagctgtaacacaaaaactgagggaaaagataccatccatcctggctgttcagttgacagagtagaaacatgagttcagttatgcagcaactcaagagaaaacaaaactttgattttcagtgattttgtggtattcagtctcagtcttgtggttttgaatcaaaactgaagtactgaacgtctgaacctatcataccatctttaaatgcaagtgttctgactaggaaaaaccaaaataaatcagaagtctcttgtctgtaagatataatccaacaaaacattcagcatctattaattcaatgaagagaacaacaacccattttacatcaggttatcagagaattgtcagacttccagtgcatttccttggcaatgaggcacaccagggtcttcctgaacccactgttccactatttccgccttcagcttcactaggaatagctgctagtgatctcatggggtaaattatcggcaggaatagtcatgcattagacattagtgcatgacaagtactgttaattcgagttacttttcgatattcggttccagtcgtatacaccgaagtactgagatgatcagtaccaatctttatgcagaagaattctaaccaaaaaaaaaaaggaaaagaaaaaagaccacagcactttgtatgtcagaaagataaataattcaataaaactttaaaccaatgttacttcattgaatagatatgcgttttacatctgtgtatcatagaattgtcggattttcagtgcatttccttggcaagggcaaatgttctgataaaactagaaacatcagcctcttcagtggaacctggcaccacaaaattcctattagggtagtaccaaagctcttcataatttcaaggttagccatatctatgcttctcaaattgaccacaggccaactccttatccccattgttttccttgctgatacgagtttagtcattgcaatatttcaccctttaaaggccttgacatcacagttcatcaaacaattgtattggccttattaagaaattgaggcttgcggtttttatgcaatcaaatttcacaggaaacaattaaaaatgtttccttaaaaataaccaatcatggcttcaggcagcctcttcatcacattgatgttcatccaattgggctgccttcatcatttgcctaatctcctcaagcttttcgaattcccgcttccgcttcaaaaacccttccaaaaccctaaaagctcgttctgtaggagtcatccccatctcaatcatctccctaaaacacctgtatgcttccaaaaccacacctctgcagcataaaccagtgaccagaacatccaatgcatgccggtgaggcaca

SEQ ID NO: 89800 - DNA, 1141 bp, Oryza sativa
tatatcctcgaacctgaaatcggctggcagttcgaaatccattgagtcggcatagaagaaccaaactcgggcatttttttggaatccgtcataaaagctgaagaaccagtccttcagaagttcagccgataattttgctcctgcatcagctggtgtagatgcatactctccgtatgacatacatctgcgatgggtgcgttcttctccatcatcttctacaatcggctccaaccttggaaattcagcttctgtcacagatggccgattgaaaaccttcatgactaccaggttcagccaggattgaaagagccaccatgatccacctgttccaaccactgagccgataattattttggccgatgcgctgtttaacatctggtatagatagccgagaaggattttgcctaagggaaattgtttcttcgttactagggcctcggctaagaaccgccagttggttgtaggaccgcagcttgatccgcagaaaaggaatttttccaaccacatcagcaaaaaagctacgtgttctttaggagtgactggccctttgcccatatatgctgtgatatatcctgaccaacccccaatgctcttagttttgaactcaaaagtgttcttggtgtttaggctcatggggttagccgatgaggttacatctaggccagtgagcatgataatatccagcagcgttggggtcatcggcccttgattgaaaagaaaggcattgagagtgtcggaccagaaataagttgcagccgccaacaggggttcatctttggccgaatttgctactgtgagggctagggcttggctgattccgatctcatcccaatgggcctgcttgctagccgatatccgcttataccatacaggccagcttttctccagagaaggccaggatttgaaggtgtttttccaatggcttgtgtttggattggccgacctaaaaggagttctattggtttcggctatgataaattcagtagggtctagattgccgattggaccgagaaagtattgttggtcatgcaacagactgggaactgcaacaagattggaaagatgctacaagaatagagaaggagaaaacgggataaggcgagcgaaaaccgatctgatgaacggaaaagggatctagccg

SEQ ID NO: 89801 - DNA, 2062 bp, Oryza sativa
aacaagagaacagttcttcaagtcattcacacagactcgcaaggcaacattgttcaaaagtacaaggtaaaggtggttcccgatgagcctgagaccagtacctctaaggagagagaagaaaaaagagttttagatggctcagctcaagagaatcagggtgacggctctcagggggtacatgcagttcaaggtgatggtgctcatgagccacaaagaggaaatcttaatcagaatggtgagacaacacaagattttttcaacaatttccaagatcgagtggactacgccgtacacaatgctctgatcaatcaatctagagtgttagtcaacaccttgtctaacatgatgaagacgatagccgatggatcaatagtcgagcatcaagctgcaggcccggtctacttgcagggaggtgttttcccgaattatcaacctctgatcactgatgttcagccgcctactcaagcagttctttcgagtgcaccatcggctcagccgatggcaccgccattgacttctttgcctgctccatcagcgtcgacactaggccagccgaataatcctcggctattgatgagggagcagccacagcatagcgggcagacggtaaatcggccaacacaggatcaggtgactgctatgtttctacccctccaatctactgtcaattcgattcagcaggcgccgccaaggcaacaggttgtgcagccgattcaacagactccaccaaggcagcaggttgtgcagccagttcagccaacacctccagaacaacaaactgtacagccgattctgcagcaggctttgatgaatcaatcggctgggcaatcggctgggcacgtcctgaatcaggttgttccagaacatttggttcaccatatacagccagatggtacggtgatgcctcagattatgccggagcatttggtgcaaagtatgccggaacatttggtgtaaagtattcagccaaattaccagaattgccaagggggcaatataaattatcaatatcagcctccttcccctcaagttcagtatcagcagggagggctaacccaacctcagtttgcttctcaatataatcagtttgaaccaatacagcaacagtcgcaaggagtagctcaacaacgaccatgggccgatgtaattgccgatgtaatgagagaacaatttgggcttaagccgagagatactggaaaattgtatcggcaaccttaccctgagtggtttgagaaagtccctcttcccaaccgatttaaaatcccagacttctccaaattttcgggacaagatggtgtgtcaacttataaacacattagccgatttttagctcagtgcggcgaagcatcggctgtagacgctctcagagttagattatttcagttgtccttgtctggattggcttttacatggttttcttctttgccgtatggatcagtcaatagttgggccgatttggagaagcagtttcatagctatttctacagtggagttcatgagatgaaattatccgacttgacggcaattaagcaaaggcatgatgaacctgttcatgagtatattcagaggttcagggagatgaggaacaagtgctttagcttaagtttgactgatgcccagttagccgatttggcttttcaaggcatgattcctctgattagggagaaattctcatctgaagattttgatagcctgtcgcatctcgtgcagaaggtaacattgcatgaacaaaggtttgcagaggccaggagaagctctaagagggttaatcatgtctgcccttacgtgtatggatcggatgatgacgacgatgactccgaaatagctgcagccgaatgggtaaggagtaaaaaggttataccttgtcagtgggtaaagaattctggaaaagaggagaaatatgattttgatattaccaaagctgacaagatttttgatctgctactccgggagaagcaaattcaactccccgctggtcatgtaattccatcggccaaggaactaggcaaaaggaggtattgcaaatggcataattctggatctcattctactaatgattgca

SEQ ID NO: 89802 - DNA, 3955 bp, Oryza sativa
cttctctgaatcctatacaaaacagttttggcattatgatgtaccacttgttctggccggccattagctctctactttatcgtcaattttggcttaacaaagaagatcacacgcgtaccacaggtagcaatggatctttctgtttggcaactattacaaagcgggtgcactttgcttactcctgtttctttactttgcctgttattttttgggaaggagagagcacgcctgaattgctgatttggcccaacatttgtccctgactgccactaatttgcatgatctacctaccccatatttggtttcatttttatgtcgtctcatttacagctctcataccaactcacaaatgccttgatcaacttgactcctgttcctgttgatgtcatctcattgccttcgctgctgatttgctttgaactagaagaatatgtgttaggcagtcattccaacagttgaaaagttcaaatcgagatgttgccaatatttaagaaccggtttgcagtttgcagttggtacttcgtagtactaatttttttctgtttcagagtcagaaaaatggaagaaaaaaggagagaaaagagttaagtactctacatcaccagatcagcagttgtccatcaattgagcacacacccctgaagttgaaaattccaagtgagaaagaaaccagcattggtaccatatgaaacactattatttattctgacaagcatagtttaccatgcatggacaaatagattcttaaggaaacattaagggggagattaggatctgtgcaacagtgcaagttatctgtttcacttgagagagaagtagcaactcatctcgtgttaactcctacctaattgcctttccacccaagattaacaggagatatatcccattccctgcatctccaatgaacagtacgatggattagacacaatcaactactactcggaattacacaaatgttcctgaacaagagtagtagtattatatttcacaccctcgcttagtacccatttcttgtggtttaaaagtcactgtagttcaactgctactccccataggattgcttatgttatgtaaaaagagaccatactatgtttaagtgagaaagctgtaagctaagtcgggttacattgctaattcttatttcactggccttaatatataataatctagcattagataaaacacgaaaatctattcaaattcatcgtactaaaatatgtacggatgtgtcctatttagttctagctctaagctatatctaaattattttatgacggagaaagtactaatataaggtgagttctaaatggtagacatccttttcttgctatctctctcaacaatttcttaaggaccaatacattctctgctcgaaattgattcttggataatgatggaccgacatgcaaggccctccaaaacagcgaaaatgacggataaatatgaaagctaaaaccaaattggctctaaaaaattatctcactttcccctctaatcctgctgggattaggagtttggaaggattaaaaaaaaatgcagaaagctccttctagctcctgctgctttgttgtcttcagatggaaacccgcggcgtgagaaagcggcagctgcgccgaaccttccacggcggcggggggcgtttaacacgtggcgccgacgtggacgagtcccacgccgcgcacgaatctcgacgcggcgccaacggccggatctgccttcgtgggggtggacacgtgcgggggatcagcgcgccacgtgtgaagacggggctccgttacgtggtaaacgggtcgggtcacggtgggtagggacccgttaacggcacggaggctgaaataaatcacttgggatctgaccaaatcgtcgtctccatttccgcctcgcgaggaagaagagagagagagagggcaaaggtcgtcgccgccgccgccgccgccttcgccgccgtttggtctcgtcgccttccggaccacccgcactagcccttctccctcctcgcgcgcgcacgcgccacacggccgacgacgacgagcaggtttggagggccgacgccgacgcggccggcctccttacgggtcccgtcgtctctgcggcggctgcgccgatatccatctcacgagcagagcaggagtagggagcaggagcaggggaggggggcgccgtcgtcgggctgagtcccggtgagcatccgcatcctctctttctctcattcatctctccgtgactctgtcccaccacccacttttgtcttgaatttttgcttgcgtgcgttaaccctagctgcttcgcttctagatctgggagaagtttttttctcttaatttcagagccttaaccttaatacaagtaacagtttgtttcccccaaaaaaatttttggggttcaactgaattgaacctccattttatggtgttatgatcagctaaattccgagtcataatatggcaatcgatgctgctatacaatttttggtcagtataactgtgtcattctgtgataattttaattggctggatgatataagtcgcaaggcaattggcactttttttcactgttcctcattgtgggaaacaaaaataatattattataacaagtatacgcgtcacttttttttccctttttgataagctaaaaaagaaagaaagaaatgaaattgtggagacagaccttgtagcaatagcaatgcaatgcaattttagaaattcagaagagggaatgtaactatggctctcatgcatggagtggagtaaaatgttgacaataactaacagtaggtgtgaaggtgatataaccttcttcacattttctcacctcaactgtatcacttctagatacgctgctttcatgtatgtctaggtttccattcttattattttgcggaaacattagttctgtggtgttgttggtttcctaacctttaaaaacttgtggttgcagaactttagcacaagttgtactagagaagatatacatctccttgtgctgtactctgttttggtatggaggaagattctggtagatcaatatcaacaactggttttcttagaagaggctctagtgtctccttaaaagatcaaggcaatgaggagaggccaaacaagacaaaactcaacccaatgaatgccaggtgggctgacagtaaggagaagccaagatatttacgtgagccatttcgttcatcaggcactaaggctgcatgtccaagctcttcaaaagctcccgtcagaaaatatttcgaggaaaaacaaggacggacatttttaggagaggcagataatgcagaaagtagtagcagaagaactgaggccaaccgtctgcagtgtagcaagaaagctgttgttgaggaggatgtgcatccatatggtcagcaggatgagccagaagatttgttgtccacatcaactactgaagatcagcctgcagaacttgatcctgaactattagattcttctgtttcttcaggggtgtctgcacatgcaattggttctgtagtcagaaatgctgctttgagatctaaatcacgtcagcagaagggtaaagaagaattgtgtcagattagacctcaaactgcttctgcttttgttaatcggtccactatacctcgaaattctaccaatggtgtgaaatcatcaaatgctgctggccctggggtacagagacgtactctaaaaaaccttggctgcacatcaatatctgatgttttgccttctggctgttcttcagctaattctattcataataagagggctgaggttatgagaaacagggcatttgacggagagagttcttctagaccaaggggcttaaatggacactctagtttaggccattcacctgccatgtattctggtatcactggtcctagagtcagaactgctgaacaatcagcttctcagcaaacacggactagtagcagaagtattcaggagtctgcagattcttcaaggattaagg

SEQ ID NO: 89803 - DNA, 2134 bp, Oryza sativa
cgcttcataaggtgccatttgtatgctggcttgatagctgttgttgtaggagaactcggcataggggagactcttatcccaggtcttcccgaaatccaggacacatgcgcgaagcatatcttctaggatctgatttagacgctcggtctgcccatctgtctgcgggtgatatgcggtgctgaagtttaatcgggtacccagctcttcttggagcttcttccaaaagtgagaggtgaattggcttcccctatcagatatgattttcttaggaacgccatggagacttacgatcctagcgaagtagagttcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacatcacaaagggccacgaactctgcaatttcccgcttcatactaacccaccagtatttctccctcaagtctaagtacatcttcgtgctgccagggtggatggaataaggactttcgtgagcttcctgaagtatcaactgtttaagttctctgttatctggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaatgccacggacgttaagagtgttgcaatggctttttcgacttagagcgtcggcaaccacgttggccttaccaggatgatagtgaattcccacatcataatccttgatgagttctaaccatctcctttgtcgaagattcaggtccgactgagtgaagatgtatttcaaactcttatgatcagtatatatttcacagcgattcccaatgagatagtgccgccagatttttagagcatgaaccaccgcggctaactccaaatcatgggtagggtagttgccttcatgaggccgtagctggcgtgaggcataggccaccacatgaccatcctgcatgagcacgcaccccaatccttggcgcgaagcatcacaatacaccatgaagtccttgtgagtatccggcaagattaacaccggcgaggaaaccagcttttctttgagagtttggaacgccttctcgcattgcgggctccacacaaatttctcttctttcttcaacaattgtgtcatgggtcgagcgattttggagaagttctcgatgaatctccggtagtatcctgccaaacctaataaactgcgaacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatgttcccgcagctttcccaataccagacggagatggtgctgatggtcttcctctgattgtgagtatatcagaatgtcatcaatgaaaaccaccacaaacttatccaagtattccatgaacactttgttcattaagttcatgaagaaggcaggagcattggttaaaccgaacgacatcaccgtgaattcatacagtccgtatcgcgtggtgaatgcggtcttcggaatatcttcttcgcgaatacgtaattggtgatatccggaacgaagatcaatcttggagaatacagtggcacctttaagctgatcgaacagatcatcgatccggggaagagggtacttgtttttgatggtaacttcattgagagctctgtagtcaacgcacatcctcttcgtcttgtctttcttctccacaaaaatcacaggagcaccccagggggaagtactcggacgtatataccccttttctttcagctcttccaactgtttcttaact

SEQ ID NO: 89804 - DNA, 570 bp, Oryza sativa
attaggattgagtcgactagacgttagacataacaagcaatcatgaggcaagaaagttgtagcccactagtctagctcgcgagccttagccacttcacatcaatctagggccactcacagcgcgccaccaagttttatcgttcttcacatgccacgtagatcaagaacagtataagctgcatgctccacagtgcaagttacatatagcgggttaggtctatatccagctttagctaatatattgacgtgtaatcattttaggtgttaaaaaaaatagttatccatctttagggttgagtgacgcaagaatttggccagagaatcaattgtctccctcctagacaagtccaatggcgactctgttcatcatttggccagaggtgtcgtaatcaacatgcccgtacctaacggcatcatgtcggagtactaaagagcccagctacgattcatctacggacgtcgtccttactaatcccgaactcgatcaatcaaaacgtaacctttcaggtattgaaaacttaccactactccagtaaatcacagcgtgtaatccgctgtcacaaaacacaa

SEQ ID NO: 89805 - DNA, 624 bp, Oryza sativa
atcggtggagctctgtcactgtgccttgtgcatgcgtttacattgtgcgcggacatgcgtggtggcgcctctctccggttaaggtggccgggggctctcgtcgccgtcgtagctgcggcagtaacgccggcgccgccggcggggcatggcgaccacaatttccaccgggactttgacgccgtgtgggggaagggcaatgcgaggttccgggacggcgggcggatggtggagctgacgctggacgagcagacgggggcgcggctgcagtccaaggagcggttcttgtttgggaggttcgatctcgagatcaagctcgtcaggggagagtctgcagggaccatcacttccttctatgtaagttggggcagtcttctgatcgatcttggcttgatttgttcgatttttccccctagtttgtgtgaaatcctaagaattgttcatcccgttaaagtagctcggattgttagtagtagacgacagaggaacaccaggggaattccacgagttgacacttgtcattcttgggatgagctttactttatggggcagaaaataataagaagaagattgtcatcccagattaacaagtttggtcctcgattagcagatgggatggttgagcgc

SEQ ID NO: 89806 - DNA, 997 bp, Oryza sativa
  unsure (1)..(997): unsure at all n locations
atcaagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagttctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaaaaagacgactgataaacttataacgcagcgaagttgcactaaccccacgtcgacaccagtaagtccccatcgtgggacggtcttttggccactgcgcgttgcgaccaaccccgtagggtgcgctgtccaccactggtcgacctatggcaaacctctcggctgcccaaagcggggatcctctaaagtcgacctgcgggcaaacaagcatgtggttattcaaatntacaaaggnntcaaaagcagat

SEQ ID NO: 89807 - DNA, 1186 bp, Oryza sativa
  unsure (1)..(1186): unsure at all n locations
cgtggattgatanatctctatgctcgtttgcctgcaggtcgactctagaggatccccaaatatctttaaatgctgtttactgcaaccctaacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagggtggattaatcataccgatcatatcaattccccaacctctaaaaggccacggtttaataataggattcatagccgatgctggcgccctttggatcgctccaaacttctgacaatcttgacaacctttataatatctgaaacaatcctccagcattgtcggccaaaaatatccagcacgtcggagcaaccacctcattttatgagccgactgatgtgtaccacatatcccttcataaacttcgccgattgcaacttttgcctgatcggcactcaaacatttaagcaacactccatcaatcgtccgataatagaagtcatcatccaataaagtatatttcaaagctttataacgcaatttccgcgaagccgattgagatgtattctgtaaatactgaaacacatcatatctccaatcatcggctgtaattgtagcaatctatatttcgatatcttttatcattggcttatgacggagcgtggggctcctcaccgggagaccgcgcaggcccccttttgcgggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctcnnagttcgggtncggagtcgaaagcaatcaagcccac

SEQ ID NO: 89808 - DNA, 701 bp, Oryza sativa
  unsure (1)..(701): unsure at all n locations
cgagcttataaaactaatggagcatgcttgcgcatgcctttggtcgactttgcagttgcccccaanccctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtc

SEQ ID NO: 89809 - DNA, 762 bp, Oryza sativa
  unsure (1)..(762): unsure at all n locations
ctgcgcnagtagacaacttgttaggaacaacggccaattttattatattcaaagtgtcaataaatagaaattatcatttataattaagatatggcctacttaattgtttttttttttgaaataaataccaataatcagttgtgaataacatattgcctaattaattgtattcaaagtgtaaataaatggaagtaaccatttataaatattatatgggtgaaaaatagtaatacattacaaattaagcaggtgagaataatatattgatccaaattgttcgaccttcaatacaatacaaataatttacatcttccatcaaacaacctaggtcactgttttcctcacgtactttctactcactattgttccttcgctatgatcgttgcatgagtatggcgtgtccttcttgatagtatgagctcgggtccaacgtcacttgaaacggaaggttgccctcaaacagatcgtaattttcgtcagtcttatcctcgattccacgattttcctcctgccgtggagaccaacatggcgtcttggctcatggggccctttcccttctttgggttgctatccatgttcttcacgtaaaaaacttgtgttacatcattggctagaacgaatggttcatctgagtatcctaccttgtttaggtcatctcgctgtcatcctgctgtcatcaatcgttacgcctccaccggtcagcttaacccattggcaccgaaacagagggactttcaggggtccatactttattttccgggg

SEQ ID NO: 89810 - DNA, 756 bp, Oryza sativa
  unsure (1)..(756): unsure at all n locations
cgtggcannagtacgacgtacagccgccgccngcacgncgactctagaggatccccccaacagcgtccatgtgtaatagttgtcccggtgcattcgtcatcacagaaacaatttgatcttgtgaagaagcaaccatcttagcatgatgacatggggtacaaaccaaatgaagatctttcttaagtttaggcaaaccacgaacaagatccaaaccacttaacctagtgagatgatcaaaaccaacatgtgcaagtctacgatgccaaaacatcacatctttatcaaacttagcaaccaaacatgttatcacaggtgaaccaagattttcaaaatcagctttaaacactcttccatagcgagaaatattcaacacagaatcaccacaagaatcaaaaactttacttccagttttcttaaagtgaacctcaaaattttcatcaacaatttgtgaaaccgaaagcaaattgtactttaagtcctcaaccaaatctacattctttaattcaaatttttcatttaccttaaccaaacctatagcgagaacgacacttgtagaagcatcaccaaagataatcgattcagtcttggatgccttcttgagtgaggagaaccaatttttatcaccggtcatgtgccgcgaacaaccggaatccacgatccacacgttctcctttcttgccaccaaagcctacacacaagcagaagtcgaagccttagtactgggattagatgataataaaaatttaggatccagtc

SEQ ID NO: 89811 - DNA, 764 bp, Oryza sativa
  unsure (1)..(764): unsure at all n locations
catactttacttttactttcaatacaagcacgaaaaaaccttttctaaaccgccggccgcaaattaaggccgaggcggttggaaaaggaagactcctcacccccacgaaacgtaaccgggggctccgggccgggtccggggatatggaaggggtaacgtcgagcgtgcaagcaaaaatgctttcttccccccaacgccgccatcgtacgcgctggtgaatgaccacctggcgggggtgaccaccatgacgggccaaccacacagggagaacatcgaggtgctccacctccggacgcggcggtggaacaccgtggtggcggtgtacgtccgccacctgaatgccaccaccacgttgctctactcccacggcaacgttgctgacctcgggcacttctaccagctcttcctccatctctctttcaacctccgtgtcaacgtcctcaggtcagtcaactcactcatgctcgctcacttccttgcttgcttccttccctctcctacttcatttgcttccttctcctcctgcgccacgcggcgcgtgcgttggggggggggggggtgggcgtgatctgtgtggtggggtttgggcgccccagtacgtggcttctggggctcctccatgactgcggctttctcgattcgttatgtccggatgggaaatttcatgttctactctgaaattttctgaaattttccctctttttagatggggatacctctagagtcgacgtgcaggcatacngaatgagttatatcaatctccg

SEQ ID NO: 89812 - DNA, 1857 bp, Oryza sativa
  unsure (1)..(1857): unsure at all n locations
taaacaaaaaatnccactgaaaatgaaaggggtagtanaatgaaatgactttcattcccttcncccttttccataaagaatcttgcctccttantctcctgtttctttctagtggctaaaagaatcaatccactttagtttggtatcgtagtccgtctgttattcttgtacattcttttgccaaaaaaaagtctgcactctggttcaacctttattctattgtaatatgttatctccaatttccaatcattgaccactgtctgattttatttgtaacctgtgcagtgagattaacatccaagaatggtcttgtcggtcagtcaattgaaaaggttgacctaaaccatgttgatgatgagccctttgagttgaccgaggaaattgaggcccaaataattggaaatcttcttcctgatgatgatgacctgttatcaggtgttgttgatgaagttgggtatccaaccaacgctaacaaccgggatgatgctgatgatgatatattctacactggaggcgggatggaactcgaaactgatgaaaataaaaaactgcaagaatttaatggcagtgctaatgatggaattggtttgttaaatggtgtgttgaatggtgaacatctataccgggaacagccttcgagaactctttttgttcgaaacattaatagtaatgttgaggactctgaattgaagctcctatttgaggttagttacttatttcttcttctttgaatcactcttctgttacaacagatttgacatctgagaagccatctgttcttctatgcagcatttcggagatatccgtgccctttatactgcctgtaaacatcgtggttttgtgatgatatcttactatgatataaggtcagcgctgaatgccaagatggagcttcaaaacaaggcactgaggcgtaggaaacttgacatacattattccattccgaaggtaaccatcaaatcatcaattgccacttaactgaaaatgcttatctgcattttctgttgcctgtgcttgtgcttagaatgttattattctagatattcactaaaattgagcacatttgcttttctttgcccacaggacaatccttcatagaaagatattccccactgaactattgccctttgtgacgctgacctatctttaacaaatgatgatctacataagatctttggtgactatggtgaaataaaggaggtacgatatttcatttgctgactactattatagctagaaagtatgactcactagttctatttgcagattcgtgacactccacagaagggtcatcacaaaataatacaattttatgatgtcagagcagctgaagctgcacttcgtgcattaaacaggaatgatattgcaggcaagaaaatcaaattggagaccagccgtctgggtgctgctaggctgtaagtcatttgggtcttgtcaacagtgataatactctgtttgctgttttctttttagttcttactactactttcttcatcacttttataacatacatattcaccattttaacatttttgacatactagctgaatgcccatacattgcaatgggaattaattattagagaaccacactgcacactctaaagcctcaaaaattaatataaaactatcctcaatgtaaatcttagggtcatattttttgtcggtcattttcacctccaatttgttttccctgttagacggcttgaggttaggaaagggacaaaagtccaccaaccacactgtttgggggactcacataccagtgttggtgggtggtgggtggtgccagtggtagagggggatcctctagagtcgncgtgcnggcntgcaagtagaagatgttcatcctncacag

SEQ ID NO: 89813 - DNA, 2206 bp, Oryza sativa
aaatgcatttctctgagtattttaattgtagctattgctttgactgatttcaatgctctctatcacagcttgtcgcagcatatgtcttcagaattgtgtcaggaagagtttggtgtatgcaaactgggaggtccaagcacaagtagccctccaattgcttcgtttggtatgctgttttcctttttcatctcaatgtatgttttgctgataggtgcattttctgacacggatggttatattgcaaggttctactaatttggcaacaataacttcaactggtcatgaaaatggaagtatccagggtatgcattctggacttcagacatcaataagccagttcagagaaacatcttttccaggcctatcttctaccataccacaaagtttgtccactccaattggaatttcatccggtgcaactcatagtaaccaggctgcccttggtgagatcagccaatctctaggtcggatgaatgggcatatgaactatagttttcagggtatgagtgctcttcatcctcattctctgcctgaagtccacaatggagtgaacaatggtgtcccttacaacttaaacagcatggcacaagttgtcaatggaaccaactcgaggacagctgaagctgtggacaacagacatctccataaagtgggttccggcaacctcaatggacattcatttgatcgtgcggaaggaggtaatttgtatatcctaatctcctttggttgaaaaatctgttatgttaagaggaactgaactatcctaggatatgttggttccatcatgggtcatgccatgattttggtgggatgaaatcctcgttttctataataacatgcttttgtgggatgaggtggtgatcgaccaaacacattttgtttctcaaaccaatgaaagttgtgtaatgtttggatgaaagaaaatacatttggatcaatctacaggccttatatgttatctaatcattccttgaatgtgtattttttttttcacttgcagctcttggattttcaagaagtggaagttcttctgtccgtggtcaccagttaatgtggaataattcaagtaacttccatcatcacccaaattctcctgttctatggccaagccctggatcatttgtaaacaatgttccatctcgctcccctgcacaaatgcatggagttccaagagcaccatcgtcgcacatgattgacaatgtgcttcccatgcaccatctccatgtaggatcggcaccagcgatcaacccatcactttgggataggcggcatggctatgcaggggaattgacagaagcaccaaatttccatcctggtagtgtgggaagcatgggatttcctggtagtcctcagcttcactcgatggagcttaataacatataccctcaaactggagggaattgcatggacccaactgtgtctcctgcacagattggtggtccatctcctcagcagagaggttcgatgttccatggaaggaatcctatggttccccttccatcctttgattcacctggtgaacggatgaggagccgaagaaatgattcaaatggtaatcagtcttgataataaaaagcaatatgagcttgatgttgaccgcattgttcgtggtgatgactcccggactacgctgatgataaagaatatcccaaacaagaatgtgtaacaactggtaatttaggttcatttttttttcttgcctttgccttcttttctgtcattttcatggatttctaaatgacttgggattccaggtacaccttaaagatgcttctagctgctattgatgaaaatcataaagggacttatgattttatttacctaccaattgacttcaaggtgatctagatttatttagtatgcaactaatacatcatatttgttcagatagtcttgcctaatcgaattactgaatgggatgtgtcctacttttcagaacaagtgcaatgtaggctatgctttcatcaatatgaccaatcctcagcatatcattccattttatcaggtgagagatactatctatagggcctgcccagctgagctggctgcaactgcatcacagccagctgctgcccgaagcagcaatgccagtggcttgctcctgcagccagctcagccaagagaaaccattatcaagtgctagtcgcatgaaggcaatagcttacgttctgcatgcggcttgtcaactttggacattgtacattat

SEQ ID NO: 89814 - DNA, 2780 bp, Oryza sativa
  unsure (1)..(2780): unsure at all n locations
cctggactgaaatgacattcgacttggcacccanncntgtatccgtgcttaggagagctttggcttggttaattgtaatccaattggaccaattctcgtgtggattcatgtggatcaatgtttttaagcttataattggtcaggtactatcgagtgctgccgatgcggattaatggttacgtctcatggaatttagattcattactttgctgtagagcatgcatttctttgtaaagacattttggtctcaggtaggcactaccatattggacaattgatgccttacaacttacttagctatccttcaaaagtggggaaggctcaattaaagcgagcgggggattatgttttttcaggagttagtgattccatatgaacgttatgctatctagtataaatagtggaaataacaatggggtcatgaagatagtgaccccatttgacatagcatgttgcagtctcaaccaagttctgttcccttagaagccattttgtgttcttcattagttcaattgattctcaaattcactgttgagtgttgacaatgtctgctatgagcatgctcattgattacatcattttgctaataaaaatatccattgattggtatttttttttcataaatattattgaagtgttgccttactagtttccaatatacccatttggaaagtaatttttacaacgcaactcatactttgcagtctcggtggttccagctatcagagaatatgttgatacttcccaaaaggtaaaatgtttacataacgtaattcaaatcagatttcagtttttcgataaacatttgtgtatgttgctcttgattttttatgaaacttacattcaattttcttatgaatctggaatatgtccaggtagttggattcagaatctctagagaagagaatgatgattcatatacccaagaagttggcaatttttctgaatgccactcttctgaacatgggaattcaggtttttcagccaataatggcacctcaggccaggcaactcctcaaagacctgaattgatggaatccctgaagattgatcaatccactacaaattctagtgggaatggtactcaggtgactgctagaaagaatcagtctgtaaatgccaattatctgctgaatttccactatgatccaatttctcggccacagcctagaggccccagaacatatcctacaagaagacagaggaagatcagaccatacaacaaagatttgttcctacaagcaaattttaagtttgttgtgttggatactggaagctatgaaatagaattaatggatccagataagatgctccagtgggaagatattgtatgtgtaagatattatagcccttgtgaggtgcaatgccctatttgcttggagagcccattgtgcccacagattacatcatgtggtcatatatattgctttccatgcattttacgttatttacttatgggaaaagaagattacaaaggtgaaagctggaagaagtgcccactgtgtttcatgatgatctcaacaaaggagttgtatacaatctatattactcaagtccagcattttcatgttggtgacaatgtgacatttacacttttgagccgctcaaaaaattcactcactccttctattaagaacctcactgatgaatctactatagacgaagatccttgcagtgcattctccaagttcattttgacgtctgatgtggaactttctgttagagaggcaaaaacagatcttgttaattggttgcatatggcagatttaggccttgtggatgacttggagaaacttccatacgtttctaccgctttggagcagctagaagaacggatgaaatattggagtgagtacagaaattttagtgtcagccctcccctaaaagacagcttctcacctgtaactagttccaaatcaaggaaccctaataatgcacaatcttcacgccagaacagtgaacacaagctatctcctctatcagatgaagatatgattgctggtgtttcggagctctgtatttcacctgaatcaaataaaatctttaataaaggaatgccatcgaaaacagaagagagatgtatggctcccatagattcaaatgagaatgatacttataatttttaccaggtctgaagtatgtctggctgtgattgtttaccttgtgcacatggtttttcattctcagagttttgatatgtcaaatcttgttgcaggtatctgatggccaacacctaattcttcatccgctaaacatgaaatgccttataaaccattatggaagttctgatatgctcccaccaaggtatagtgtttgtttacaccttaaaagtcatcgctctcatattgacacattattttgtgtattgtattagtattgggtagattgcatcctgattatgattatggaaaattggatttttcactatgtaagcagagataatttgtttagtttgatctgataaccaattttactcaatttgctcgagcaatgtatttcttgtgtgcatgagatactacattctggttggagtgcttatctcttctcctttttttttgtatctggttgttgctcgtggtgtttgcttgatacttatccagcttacttgcacgcagaatacatggaaaaatcttggagctagaaactgtaacacaatccgaagctacaagaaagcgctatcgttatctaagtcacttctcattgacaacaacgttccaggtaaaccagttgtggataactaacttttacttncgggtaccgaggtagcntaacttcagcat

SEQ ID NO: 89815 - DNA, 1460 bp, Oryza sativa
aaaaatatgccagcttttgtatgcatctttgttgaaagctatatataatctcacttatgaaatgcttccattctgcattactgcacatgtttccaaaactttaatgccatcaatatcgaccagaagaaggctattttgtgtctattacacccttttgttgaaaaacaactattcttttggaactctgggatgtagccaaagtcaaattaatgcctgaaggctcaacttgttactgaactatgtaaatgcccttttcaggttctctaactgttgattgggctgaagatgtagaatttcctaactgggtagatcaagacattttagaggatgaggaatttcaggaaagtaaaagatggtggtcacagtcacacactctggtgcagcaaggggatgccaaaccattgagccgaacatcttcctatcctcagcaaccactgcagcaccgggcaagtgaacctatcattccaccaaaatctccttcatttacgtcctttccaccgccaggtggtagatcaccttatacttctcaaggccttacacgccatgggagcattccatcacttggtgctggcctgcaaatgggttctccaagcatgtcccttccaagttctccatatcatatagctggactatctcatggactaccgtatggagggagcatgtccttcggcacttcaaatctgcctgtaaacaatccaatgcaaaatgattggccaagccaagccaatctttatgctggggagcaatttaatctactgccgaacatgttacagaaacaaatatcacttccaaatagcccgatgtcatcactgttattttctcaacagcagcagagattggcacaagttcaagtccaaccatcccatcagaattacctaaatttaccacctcacatattttaccaacatcactccccagaattaacaggaagatttgattctgttagcagtgttccttcatcaagagacaagagatcaaggtcaggaagaggaaaacacaacatacgtttttctcaaccattgcctgatactggtaatcaaaatggtgatagtggaggaataaaattcagatctaagtacatgtcatctgaagagatcgaatctatcttaagaatgcaacattcagcaagtcacagcagtgatccttatgtggttgattattaccaccaagcttgcatcgcgaaaaggggtgccaattttaggccaaaggccaattttgccccaacgtcaatgaaagacttgccttccaagtcccgatccagtggtgaccatcatgcatatcttcaggttgatgctgtaggaagagtttccttctttttcatacgtaggcctcgttctcttcttgaagttgaccttccttcatcaagtgatggttctcatgatcagaagtcttctctgagaccattggagaaagaaccaatgctggccgctagagtcactgttgaagatgccctctgcctt

SEQ ID NO: 89816 - DNA, 584 bp, Oryza sativa
atgatccaggtgaagttgacggacaacctttgaagaagagaattcctgctaaggtgatgtggtattttcctataataccaaggctgaagcggtttttcaggaacaaatcacaagctagaatgatacggtggcacgcagaagaacgtaaacaggatgggatgctgagacaccccgctgacgggtcgcagtggcgaaatatcgacagaacatttaaagacttcggcgaggatgcacaaaacatgaggtttggtttaagcactgatggaatgaatccgtttggagagatgagcagtggccatagcacctggccagtcaccatgtgcatctacaatcttcccccttggctatgcatgaagcggaagtacatcatgatgccgattattattcaaggcccgaagcaacctggtaacgacattgatgtgtacctaagaccattggttgaagatctgaaagtgctgtggaggaaagagggcgtccccgtgtgggatgaggacaagcaggagcaatttaacatacgagcgttgctattcgttacaattaacgattggcctgcacttagtaacctatccagacaatcaaacaag

SEQ ID NO: 89817 - DNA, 2133 bp, Oryza sativa
  unsure (1)..(2133): unsure at all n locations
agcatgcaacgagggcgcgggctatccgccatcgtccgagaggcccgcgccgcccgcagccccatgatgtgcggcggcctcgccgtggcgcacgggctcggggcggtctccacggggaggcgagcgttgttcgtgncggcgtccgcggtgcaccgcgccgacgcgatggaggcgtgccgctacgtcatcgacgagtcaaggcgtccgtgcccatctggaagaaggaggtgtacgacgacggtgaggtctggaaggagaaccgcgagctcctcaaccgcaccaccaccgacggcgctgccgcggcgccggcgaggggcgcgcttgctgcggcagcaaggtgagagtcaacgagagctgatgcccaacctcccccaaaatactgtagattgtcaatgcttaaatgtgcttgtctgcggatggtaattcttttatatcttggagacatgcataaccccttcaatagagcaagtttaatagcccactactagtttcaattcatctatagccgatctaatagccaattcatacaatagttgcttactatactattaatatatggtcccacctgtcatacacacattgtgttttaaagtccatgctgcaggtggctatagatctgtagtccgcgactcttctctcttattttttatctcattaaaatatgtttatagctggttaatagcttgctattgtatctgctctaagtccattgtaatctatcttccactgccattgacaacgagggatcctaggtaaacgaagattcctagtttgtaaacttaaaaagaagaatggacaactacatagcatcctggtctaattagaatttagcatgtgtgacttatgataactatgtgcgtatgtttactatcaccttgctagtttagtaagagtggaaccgacatattagaattcatcccttcaaccatatgactcccgggttgatccttttatacgaagcgatgatggaagtataagtgaggtggtatgtgtaagtgggtccacctgtcaaatagactggttacgcagttctgaagggaaggctattacaatctattcagcataattgtactaatataggccaaagagaaaaatggtcatagacctaaaggacccagagcaggggaaagggaatttaaaccagtgtggtagcttcttctagaatcggctgtctcattaaaatgcaatgtccaatttgcagtatccaatttgcaagtggtccttgttgttttagcaactaaactgaagcacatgctgcctccaaccccagagcaatgcatggggtggcaactggcaactatctctaccaagagacaaaaaagaagtatgattaagtgtgggtaactagagacataaaccacaggaataggataaacaacaccaagacaaacattccagtcccagtagtgcttatagctaggctagaatggtgctaagcacaaactgcatcacgtgaacctaactaggaaaatactatatgctcatactatcatagtagtaagaaagcaagaggaatttaattctctcttggaagaacaagaatccaactaccaaatctctctctcccttatcccctttaacctcttcacaaggatttcttctttctttcttttctttttctcttttgttcttgtgggaacatgcatgacaggtgcaggcgtcagaatacggatgggcacaatggggaaggaggatgctaaacaacaaaaccagcgtcaggccagccagcatagaccacggtttgtatacacacacacacacacacacacacacacacacacacacacacacacatatatatatatatatatatatatatatatatatatatatctatatatatctatctactatatctctctatctagagccacataaagtacacacacctacacagagccacatatatatagcatatacataaatatacatccctctacataccaactaaatattcttcctatatatataggttggagatacacttaagtacttatagatacccagcggcctccctctagatgcatattttggatctcatttgttaccccctttgtccttttccaggttcctagtcagttttattcttaataaaagctggccctatataaatttgtacgttcttattatgct

SEQ ID NO: 89818 - DNA, 1550 bp, Oryza sativa
  unsure (1)..(1550): unsure at all n locations
acggtttgatttcaatgaaaacacntcgnacccnacccaaaatagcgccacaaagaccgacatgagggatctggcgctacctccaatcttgttgagttgatatcgaggatggaggctttattatgttattccacatattatactcggatgatactaatatataaagacaacatcgtctttggtcaacaggagttgggatattacctatcatataagggggcacaaacctgtgtaaattttttttgtctcccaacactttaacattaatctcgtgtgtaccttagcatcatcgtaccctgatacttcctaatattgtagtcacggtataacccgtcaacatctaggcatatccatatttttcatgatgtcctatatgaaaaatactactgtgccatctttaggatcatgccttactttcaagccgcttttattttttttttttgtccactgtttataagccgagtcacacgatattaatagaagcagcataaaatactccttccatatcaaaatataagcattttatttgaaggaaaaagtacgaattaccccctgaactatcgcggtcgtccgaattaccccctgaaccacaaaaccggacattcttcacccccccaactatgtaaaccggacgaattacccccctcgaccaatccgcggtggttttgatctatgtagtgtacacgtggcagtccagtcagtattttagtttttttaatggtgagacccacatgtcaaactccactttctctcttcctctatctctctctttctctctcttcatcggtcagcggcagcggcgcgcacgcatggcgcggcgcggggaagggcaatgggcagcgacgcgggggcaggctggcggtcagcgcgcacgcagcgcgcggggaggtggaggggatgggggagaggcgggcgccggcggccatggcggagaggcaagccatggccggaagcgtcgggaggaggacgagggacggcggacggaggcgcgcgtcgggagctggagcggcgtcgggaggaggacggggaggaggagcaagagaggcggaagagggagacagcggcggcggaggaggaggccattcccgcgaccgccgctcgccatttcctccgcgcccaccttctgtcccggtggcctcccgcctcagcgtcgcggctgtcgcagcctaccggttgcccgctgcacggaggggcgggcggcggacggtggatggcggcgcgtgggagcgggcggtgggcatcggacggcgacgcgcgggggcgggcggtcccgcgccttgagacactcaaccagggcgtccaccacgtccccgatgctgaccacctgctggtgcctggcggcggcggcgccattgttggcatggtggagcagctgagtgggtgacgcggacgccgccatcaccagggaggcggggactgggaacggcgtggcgcggttgacgccgtggcgggcgtggcgttcgttgatggcgacggcgaggcagcggcgcggaaaaagcatggcgagcaggtggggtacgaagctcgtntcgcaatgcaatcaaaccgct

SEQ ID NO: 89819 - DNA, 654 bp, Oryza sativa
ttttaatatctgtgccattcgtgggaagaaatcagttgggggtagaaaggcttaggaaccctctgctcatcaccacccctggaggggttatgacagcaaagtatagaaattcaggggcttccttttccctcggatctgattctgctagacaccaagaacttggatgtgatccttgggatgaattggttggctcaattccaaggagtagtggattgcgcgagacgcactgtcactctgtaccgagggccggaacaaccggttgtcttctttgcacccccaacctctgtcaaaagttcagaacttcatgagataggactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttctccctggggtgctcctgtgatttttgtagagaagaaagacaagacgaagaggatgtgcgttgactacagagctctcaatgaagtcaccatcaagaacaagtatcctcttccccggatcgat

SEQ ID NO: 89820 - DNA, 591 bp, Oryza sativa
gtgtccctttgttgtctacctggtacccttcatgttcctaaagctaaaaagaaccttatctctgctcatcgtttagccgttgataatcatgcctttgttgaagttcatcctcgtttctttgccattaaggatcaggtcacgaagaatcttcttcttagaggaccgtgccgcaatggactgtacccgttgccaacatcttcattcgccacatccaagcaagtccttggagccatcaagcccacaatgtcaaggtggcatagccgtctaggtcatccttctctagctattgttcaaaaagttgttagtaggaataatctcccatgtttaggagatgtcaatgagtcaggagtctgtaatgcctgtcaacaggccaagagtcaccagctaccctatccaaaatcctttagtgtgtcaaataatcctctagaacttgtgttttcagatgtgtggggacctgctcctacttctattgggggcagaaagtactatgtcagttttatagatgatttcagtaaatttacttggatctatttgcttaagagtaaagctgaagtttttcttaagtttcaagaatttcaacaacgagttgag

SEQ ID NO: 89821 - DNA, 587 bp, Oryza sativa
gataaccgtcgctgtgacctggaattcgcagtgggtgactttgtgtatcttcgagtcacgccattgcgaggtgtacacaggtttcagacaaagggaaagctcgcacctcggtatgtgggtcctttccgtatcattgcccggcgcggagaagtcgcttaccagctggagctgcccgccttcttgggcaacgtgcacgatgtgtttcatgcgtcgcaactcaagaaatgtctccgagtgccatccgagcaggccgactcagagcaaattgaagttcgcgaagacttgacctacgtggagagggcagtgaaaatcctggacaccatggagcgcaggaccaggaaccgggtaatccggttttgcaagggccagtggagcaaccccgccgaagaagaagcttcctgggagcgtgaagattgactgaaagcaacccataccgatctcttcgccaagtcctccgaattttgggggccagatttcgtttaaagggggtagggtttgtcccgttccaaaaccaattttaaatatatcctctaaaatgtggccagaattattaaaaaccctgtggaaaggcttccacacatttaaag

SEQ ID NO: 89822 - DNA, 572 bp, Oryza sativa
aatttattcatcactcagtctgaaaagaatttcctataaatatttgcatatgcgcatgcgaagaatatttaactgtgcgacacttaaaacccaagttccaataagtttttgtgtatgtctccactctccataataaagtagagcagtgccatctaagcccaacaaactacacacaaactccagaatataatcaaatataaattggagccgggcctgacctttggaatcatgtctacattgtagtctctgctagccccaatttgcgccgggggagtaccttcacctttgaaccttttccatagctggcatacataaacaatgagcttgatcagataatttcatctgataggtaaccaacctcacacaaatttgtctgaaactaatattgatgaggaaatttctaacatcccttagcacgtcaggaaaacagaagttggcagacaggtaggtaagataatgttggcaaatttttgctacggagggtgaagccttgtcacctgattcaggttgagcgatgtggagtctccaccgtagtaatcattcctgtccatatgcagcacctggtgacaaaa

SEQ ID NO: 89823 - DNA, 6209 bp, Oryza sativa
  unsure (1)..(6209): unsure at all n locations
catcaaaagggaagttcatcgcgttcgtgtcagcacaagcagagagtgaaaatccagcggcggaattgaaaccagggatagaccttcttgggccagtggatgaactatttattgatacatacgacagatttgaacctactaatgacccatcttcagacaattgtttcatctcaacagtaagtcatcgcagaaatatcaagtgtatgtaggttagacatatgaccaaaaaactgcatttgaaataaacatttaattcgatttgcttttcagagttatgatgccacaacacactttgagtctactgtgatggatgttctttccatctatacaaagatcaccggaaaggtacatttgttttctgttcaacttttaatggctgcactagagtacaaccccaaccttctgaattgaaccttaccagcactaattgaaccttaccagcactatgagttcaacattgtttgcacttgtgctattctaatcttgtattccacgtggcaactataatcaatctattctatcatgagaaggaaatgggcttttcaattccacagatacagtgctttataaaaaggcagctagttgagtagcaaccttgtaagaatatcagtatataactcttagcatcatattcagactgtatcaatcagagtaacttacattccaggatcgcaaagtgataattgaactaatattgcatttttcatgatcttgtatcaacctaaaaaaacgtgtgtttaatgttttaaatttcctttgtctcgatagtgatttcctagttgcttatgctaatcgacatgccattttatccagacggttgatctcagtgtggatttaagtgctgcgagtgctgctgaagatgatctctaatagttattggactgtcctttggtgcacagaggaaaagatttgtgcgttgtttttccattcatattaggtttatatatgattttttttcttttattccaaactatagtggctgagttttattaataatttgataatgctgtatattctaggttcatagcaatttagcctgtgagtaaacagctgtttttgttgttcagtttacttaatttcacctttaaatgttgtggatagtgctaatgaacaccgaactggtacctccaattattttgaagaataccttgtaagatttctataaaatatctttgcaaaacatgttttgagatgcaaattgtcacgtaagagctatgagatacgcgaccatggcatcaattgatcattactatttgtgtcatgcatgtgctcaactgctcaggaaaatcataattactcattccatattgtgaaatatcaggaatttagcatgtgcggtataaattgcgacttgatttccaaaaaaaaaaaaaaatagggcttcagctgaatccccataccccttgtttggtcctcctcagtacgtactgatgagctttatttacagtttactatcttgctttttctccattccatttatctaacatcaggctacatttttatttttgaaatttcatattttcagcgtagttgcaatagagaaactggggttcagctgaaccccatacggtcataccccattattttttttatttatcgtcgacatgactatggtctgatgtccaatctaagccgatttattgaaaggtcaaatgttcactgaggctgtgctcctacgtggagcgttgcttcgttgcgctagcgggaagattcattgacacgtcggcaccatgtgcgtcccaactgagccgctcgggccttcgatgggggacgagttcctcgctcgcgctcaaggacgtgcggcgaagaaacgaggatgcgctaggcagaaataacttggccatccgtattgtagaggtcctgccctggcatcatgtttccatcacatcgtgcgtcagactatgcagaggaggtcacatgcactgtgaagtgcatggcatacggatgcttttggtttgatttcattgcacataccagctagagacacgcgatgcatagtttgcactgctactgccctaagagcaccacgcaacaaaggtgaaacatactggaaacagtaagatacaaatatagtgaagatatgttccaccaaatgtgatataaaaaaatatcgtgcgacttaaaaaaacgtaaaatatctcaaaagcaattggtgatgagcatcgatgtcgtcactacataccacattattgtgattgtgctggtcaaatcatttccattatggtggttttgcaattgtgttgtggtcttcatggaatacatcatcgtcaacacgaacatgaacataggtcgttgcattaccaaaggtcgttacatcacccttgttatttagccttagttgtgtgattactcttcaccatcgtgaatgctacctagcaacatgctctagtcttatatgacttataacaagagagcagttcttttctccaacaaaaactaggtaaacttttagataaaagtggcacgctttttaaactgctaaacggtgtgtttcgtatgaaaactttctatatgaaaattattctaaaatatgatatatatatatatatatatatatatatatccatttttcaagtttgtaataattaaaactcaattaattacacgttattaccaccttttttgcgtgaaacacttacaaacaccacctaaaggtgtgttggagaatactacctccgtttcaggttataagactttctagcattgcccatatttatatagatgttatatgtctagattcattaatatctatatgaatgtgggtaatagtagaaagtcttataatatgaaaaggaggaagtagcagtaatgggcatggaggattgcgctctagtttgtcttcgtcgagaagaaatatcacttcagcgaggaagtgagtgtgaacataacttttgttcgactcaactaaaaattgtctgatcggcttaagtaaaagtaaaaaacacttggttaaagatagcaaatatattattatattctgacatgtttaacttataggtctatctttatcttgcgacttatacattatgatactatctccgtcccataatataaggatttttagaatagtgctaaatcaaacattttttttaactttgactattactagtgaaaacataaaaaaatcaatcatataaaattgataaaattgatgttactagatttatcattgaacaaactagattccgtaattctatttcaaaaaagagtgagactcaatctccttatgccatcccaaaattgatgctactagatttatcattgaacaaactatcataatatgcaactctttttatttaaaacatctcacttttatatatattgttagttaaagtatacctcgaaaatcgtttcaaaatttaaaaatacttatattttgagacgaactaagtacatttcaaatttttacgatcacccggaagatttccctactccaaaatcttacaaaattttaaccatcagattggaatccaacgtcccacatccatccgccgccactcgtctcgtccgtctctctctctctctctacgaaccacgcagctcgactcgcgagctctcgccgccgccgccgcctcttcccccaccgcacgcgcttccactccgccgccgccgccgccgccgccgaggctccagcactgccgttctccgcctccagttcttccctcccccgtcatcttcgtcgtctcgggtgtccggtgccaccgcgccgccctcctgctccatctccggcggctcctgctgcccgccgcctccaccgactaccccctcctccgccctcccgatctccgttccccgcgccaccgcccaccgcggggcctccgccgccccggccgcttccgtctaaccctggatccccaccacgaaacctaactagtaagcgccggagccgccgcctcctccgcctaagttcgctacactcgctggagatggagaatgttactggagaaggaatctcggatcagatagagaggttagcgattattaagattttgccaccattttttttcagtcgaatgttgtgtagcaaaccgattgattttcctcttttttctttcagatttcaaacacagctacaaatggatgggcgagggagaaagcacaggattttgatggtgtcagatttcttctttccaaactttggcggcgtggaaagccacatctattatctgtcgcagtgtctccttaagcttggccataaggtccctaatctcctgaatggtctatttactgccttgttcttttcatgcataattttagggactatattagggtctagatcaactcatggatatgcttttgattctgccccagctcacttgttatatgtagtttaaatattggatttaatatctttctgctataatgagttgatgccaataatggttagaggatttttgttacatatcttatccaatcgttaaatgataggcagagccacacaacggactaaattagtgctactgattttgttgcgaatgtttagacaacttttttgtttgattcccaggtgattgtcatgacgcatgcatatgggaatcgttctggagtacgatatgttacaggtggcttgaaggtttattatgttccatggaagccattcctgatgcagaatacattgcctacattattcttgacatttccgattgtgaggaccattcttattcgtgagaagatctctgtggtgcatggacatcaggctttctcaacattgtgccatgaagcactgatgcatgctaggacgatggggtacaaagttgtcttcacagatcactcgctttacggttttgctgatgctggaagcattcacatgaataaggtgctgcagtttactcttgcagatattgatcaggccatatgtgtctctcacacaagcaaagagaatactgtcttgagatcagggatatctccagagaaggttttcatggttcctaatgcagttgatactgcaatgtttactccctctccagatcgcttgagctgtgatgaaattgttattgttgtgataagtagattagtgtatcgaaagggtgcagaccttcttgtggaagttattccagaagtatgccgtctttttcctaaggtgagtcacaaccatagcactctttggagtcatgcatgaaataaaaagggtgaactatgggtatggtagaatcatttcgttatatgacatatcaacataaagcaaaatgcatacacaatagttgaactctccttatattccatcataactttcccatcctttttaatgttcacaatgttttggatttagtaaatggtcatatttgatcaagtaagcaactgtacgaactgtcaggttcgctttattgttggaggtgatggtccaaaacgtgtgcgaattgaagaaatgagggagaagttttcccttcaggatagagttgagatgttaggagctgtgcctcatgctcaagtgcgatctgttctgatatctggtcatatttttttgaacaggtagctatttaatattttcattgctttatgttgaaacttttttatttccttagttcctttttttcatcagggattgttgatacacgtaagactgctttctgtctatccctttaaattaaatatcatctttcataatacataatgttaactagaccctaatatcattacaaacatagaagaggacatatcccggggaaanttttttaggttttaagcccgggctcaaatttaatgtttgtttggggggttcttttaaaaactcccttgcggccttgtaagtttgagattcttttattgcccccccaaagagcttgagatttatttgggcattggtgatcactgtgtgaaatggttttcgtttcaatttcccccgtaatacgattcggggccttatgtgtaaattcttgggggcctaatgagtaacttactccccattaattggggttgtgtttaatgcccccctttccacattggtaaacctggtcagcccacttcattaatggatttgcccaattccctgggggaggctgtttgcgttttgggcgctctttcgtttcttttttatctattttgtgtcgctctgatcttttggttgttggcaatcgtattactttcacttaaaggttgttatttcgtttttccccaaaatctctgtcatacctcttggtaggaatatttttacctaaacgccctgtcaaggggtctgaaaccttttcaatggtcctgctgtcctgggttct

SEQ ID NO: 89824 - DNA, 1034 bp, Oryza sativa
atgttgttgtttcactctatccttgtcttagtttctctctctctctctcataaaatgtgtcctgttgaaaatgtttaactgagtttttgtttatttgccttgtacaactgtacttgtcttgtagagcatcatacctggtattcttcaaggagacaagtccgattcccttctgtatggttccgttgataatggcaagaaaatatcttggaatgagtcattccattcaaaggttggccaatatgttccttttagcatgcaaaatattctctgtacaggagtaatgaattttcttcagtatatgggctctcaaaacttatgttctttagttgatggtggtgttatcttgttgctagacgtcgtacagttcacaactaacgagaatttgcaagttaatataaactggttgttatgttaattaagatgatgttgcttaataatgatcatgatgggtgcctgtttgatatattttgataataagtggtgatgctaaaactgcatgttgtaccaagtatggtgactaaagaactattcttgatatttgaattcttcgatacttatatacttttacttttgtttccctgtcaagtttttcacaagcttatcatgtggcttgttagatgaaaatttaatggtttgcctgacttgtgcacaatttgattttctatcaaacggtaatgcaatttttgatgttagccttacttagtggcacttaatttccactgaagatcattatggaaattggaatagcaagtcaagaaagattttttttttgtagccatacttgattcttggtggtagtgattaaccactctgatcatgttatacagcagtggatgtactctgtgccttgtggtattcaaagactatccttatttcttgatgatatctattattttaggtggttgaggctgcaaagcgactccatgtgaaggagcatgtggttttggatggttctggtaatcctgtaaaattagctgctacggttgaatgcaagggaattgttggaagtgatgacaggtcaaaatctatatcta

SEQ ID NO: 89825 - DNA, 1885 bp, Oryza sativa
agaaagttgcagatgctcctggagaatctaatgggcaattggtaagtacttctgatgctacggttggtgcagaaatttattatggaatactttgtgtttgttcaaaagcattcattcctaaattagtgttacagtcaagtcaaactggatatgctattttcctttataacctaaaacacattgccacgtttttatttctcactttcatatcttcccttattcagttgcatggtaatgatttgtttgtctaaactctaaagttctaacttatccaatatcatgaagcaaaatgattttcccatttttatttaacagtttatgggtgttcaatttcccttgtggtactcatatgcctaaaattctttaaaaaaaatgtggttattcttgtttcaaatatgcaaactggaaacttagtccacctatttcaggctacaactgcggaaggacctgccaaatctgatgaaaactctgttcctagacctgataagtttgatgaagactctggtcctagacctggcacatctgatgacagctctgctactaaaccagctgaacataacgagtcaactgcagaaatcctttttaatccaaatgtgtttacagagtacaaacttgctggtagtccagaagttagtcttagaactactccctgcttgatatccctgctctaatttattgacagcctactctttgctttcttaggagattgcagcagatgaagcattggttaaaaaggttggttcgtatcttctagacacggtgataccaaagtttgttcaggatctctgctccctagatgtctcccccatggatgggcagactttgactgatgtgctgcatagcaatgggataaatgttaggtatcttggcaaagtgagtctctgaactgatccagctggatgtgagttcattgcattttatgtatagtatgttcattatctaattcttttctcaggtagttgacatgatcaagcatttgccacatttacggggtttgttgttttttgagataattgttaggtcggcaaagcatgtggtcaaggtgatagatctatcttaccagctgtctgttcccatgatggaaattctccgcatttatttctttaataatttctaaaggatgagtcatactgtcacccagactcatcctgctgtccattcaaacaaatgttatatggataagattattcatcaaaatgcataactttcctgttttaccacgtttaataagaagtcattggaaaaactatgccaatttgttgaccgtactgtttgttgttcccatcccaggaaatacttaggcaaagcgcagatcatgatattggaccagccattgctcatttcttaaattgttttattggcaatgttttggcaccttccacaaaaggtagtgttgacagtacggatacaaaaacccaaaaggtatgctattccacgtgtaagaaactcatgtcatcacttgtattctaactgcaactaatggctattcttttggattttcaaattggtagggtcatgagaagactcaaaatcaaaaatctgccgagggacagaaatcaagcctttctgcttcttcaaagaacattgtgccaacattttcccatctaacatctgatgggatttggtctaacattaaggagtttgcgaaacataaatatctggtagtggctattgcttcttttgtttccgtagttttctatagatgccatcaatataacactccttttatttagtttgaagtgaccgatgatgctaagactggtgctaaaagagttgcagtactccgcaatctttgccaaaaggtttgctttgttcagctctatattcattgagtttgctattctctttcagagaaatgtttaatagtttggctgcaagtagttcc

SEQ ID NO: 89826 - DNA, 2034 bp, Oryza sativa
ttgaacaccaagggacaagtctcactggttgctgtacatatgtatacttcgatggggtggctttgtgctcatacagactgtggagtgcattgtagtgtgatggagcttacatagagtataatttttggccggtgaatagtcttgctgtttcagcgatacttagttcgaacactgttgattgtgttgggaggagaataacagtttcatgtttgatttcaagtatgaaattcattgccatggattgcaaagcccatatctttcaaacacctggtttggaagttcaacgatactacgtatatactttatttgcacgattactaataccaatttggcacattcaataaaaacaacctatcttcattcaaatattccatttggaagttcttttcttcccaaatgcactggagaaatggggcttcaatttcactaagaagaaaatttttacaaattacaaaagaagggattcctttgatcaaagaatccctcctactaagaacacattcccaaaacggatcacccacaggtgaagcccgtccaaacaccccgttcggaagttaaagagtaaatattttatttgcacaattgataccagtttagtacatttgaagagagacaatctatcttaacaagaggtttgaagcatggacatgtacgggctgtgcagggaacaacccaacagtttcagcatgtgagcctccagcaatgaagatacatatcagcctggactgttgttccgtttgctgatcatatgaattgtaaggttaacgagaaatctgcataacgtctagaatccattctttcctttcagattgattactgatagttcctgttcgacgtagtcgccagcacagattggtggataactatgagcatcggatgcttcagcaaagtggcccaatggcttaagggttgcatcagaagcaatgtgtgcaaacagctatttacataaataggcaaatgggtaagtcaatagttcaccagagcaagtaagattaaattgatggaagtgcctcatgaagtaaatcacatcgagaaggagtggttagcacttacggttgatgaaaccctccacaagcttctattttgctctcttgctaatgctattgcctctagtgttctcttggttaccactacctcatgcattccagctaaacactccccaccagtaagccattccagctgcagttaaagaacaaactatcctctcaacaaatgatgtgaaccaatgaagccgatggtagcagaaaaggatgtgagcaaattcaagcaaaaaatcaataccagcatctaacagacatttttttaagcttaagagtgatccttgttcacagcacgatagcatggagtatatatcccaaaaggttgacaaacatgtcaaaattccaagcgcttaagaaaatgcagtcttgaatcatcaacagtagataacaaaacgctaaagcaagacttccaaatttgctctcagcatagtgactggaatcatggaaatatgcactaagcgctaactgacagataacaatgaaaagtttactcctcatcctcaacaaccttggttcccaaacccttgagaccctctgcagggatctcagcaactgtgaccagagagtagagctcctccttggcgtcctcctcatcgtttctcttgcgagagattctaacacggactcgccttgggacactccggataccattggtccagatggccttgttaagcttcacgtcgatgcgtatatccgttgtgcccatggccttctgtgcaaacttcctgatctccttgatggcattcggcgccttcttcttgaaggtgctgtttatcagaaagaattatttcattatagggtttatttcaacaaatcaagacttttcaagattgcaaaacttgtaaacaagaatctgcatttatctaaaaggtcaaatgtaatatgaactgtgaagttggctgctttataaagaaaatatgtgcaacaacaattagttatgcagtgctaaaaagtatgaaccacaatagatgaatgaccagaattgattagcaga

SEQ ID NO: 89827 - DNA, 999 bp, Oryza sativa
taagagtagtcatttgacataattaggaaatatttgagagcaattgaaaacctttcttgaacttggcactgattttttgtagcagaccgactagggtgctgtcctccagagcctgtttgctaggccttggatccagaatacttccattgctagagttcacataaaatgatttggagtttcctgtgatacagtacttgtttccttctaaggtcataacatcaatataaatgagatctccatgcaatctgaagaaaggatcaacgactgtgaattccatggagaatcaaaatactaagcaatagccttatatttgaccaatctttctaaggtatccaaataaatgacacaagtgcggaatatgcggtcattagagttacctcctataacttggcggaggattaaatgaagaaaaaactatgctacccacgcatttgatctctgctggtacagatggcaacaaattaatgacagcaccagtactgtcctccatgaaattcaacccatcaagctcttgattagccgtttttcccagaatctcctaagtaaagaaaagacagaacatcaaaacttgcgtgtaaattagtaaactaatcagtgacatgcaaaaaattcctaataatatagaatgtcatcaataaactacacagcatagggcaaaaccaagggttgtacctgcagtatctgcagatttttcctgtgcagattcttgctgaagagcaagggatgtggaaagtgatacatgaagactagagagggatagcaattccctgacacgacggagatgtgacctaatagatctctcatcatatatcgctagaacaaaacccaaatcgttgcgtcaaattttaaaaggaacaactgaagagaatgatccaaaaaagataattttgaattgcataccagcaacaatctccaatgaacagccaccagcagttatatcagcaatctcagcaatttcattatagtcctcaagctcatgagttgagccatctttagtgt

SEQ ID NO: 89828 - DNA, 716 bp, Oryza sativa
tcttatttggcttagaccccggatctgaggagcctatcacacttctgccagatccattttgaccatttggcttctggtcctttgggagttgctcatagtcggagtcaacagcgaaactaaagaaaatattgttgtgtacatacctgaaatataataagagcataggtaagcatctctaaatgggaattaaaacatcattaaaaaacagttaagccagatgactcaaaccaaacctgatgagcaagtgcaaaagagaagttcctaacagtcacatgcaacacacacccttccgagagagaaatttcacataacactagtccaaaattccatacaaaaaccaaacaacactcacagacataagaattgtttcgctaacagttcagatagtattatatttgagcttactcacatatgaaaacattccggatcagttggatttattgggggtatacacctattaatgacaccaactgcccctttaactgcagcatcaacgaaatcacatgtcaccttataaagtgctctgccacgcaatatcctacaatagccagaaatatttattgtagatgatataaataggcaatccaagaatgcaaaggtaggtaacaacctttcttgaggattgctatgaggaaactcctggcaagactgtaattcttcattccagtctctttgcatgccaatcaattcggttccatatgacagcacaacagaat

SEQ ID NO: 89829 - DNA, 2174 bp, Oryza sativa
tcaaggacgagttaacaagatgcaatgaatggcatgacggtaaaggtgtactacctcctcggtgcggctaatggcgaagccgagcttggtgtcgccggcctcgagggtgatctccactggcatctcaccggcggcggcggtgtaccagacgcgcaccggcttcaccacgccgatgtccacgccgtggtagtcctcgaacccgtaaaggctggcgttggcaaggttcgggaggtcggccagtgaccccgagttgaccgtcgcggaggccgtctcgccggagatctgcccaacatgcaagatatgcatgtcacgcacaacacctactagctactaaaacatttactctaggcaagtttgatcgctgttgaggaaccttggtgaggagggcctcggtctggacgttgaggaaggagatgggcacaccggacgactgcgaggagaggatccaggcgttggcgcgggcgagggtgtcctcgacggagttgtagcgggaggcggcgcggtcgagcgccgtggggaggacgagcatggagaggaagctgctggagttagggatcgggagcgcctccctcatcttcttctcccacgggtaggccacgtagccgtcctgcagctgcgccttgctcagggcacacaccaccctcgaactcctcgaccctggacgtcaccgtaaaaaaacagaaaaaagaaaaatgccgatcaattctcaggttcagatcagaaactcaaaaagaaaaaaagaagatgctgcattctatgcagttctgcatgatctttgctcactgttttacgagcggcaataagaaatttgaagaagaaaaaaactctatggaagatgactgaggaagtaaagtcaaccagggaatctgaatcgcattggaatttagcgacaagttttttccgagtcaggggagggaagattcaattatcatcaccgccaagtggcgttctgtataaagaaatcaaaatgcagattccaaacaacgtgcaccgccgtgtctgttgcctggaagtatgcaacttgagcttagactacagcaacttggtgtttttcttatctgaaactgacgtgtttgttttacttgtggaagcagaacacccatcaaatgcaaactacccaggtttttaactcgcttaataaatatcttatcttatgatttttttttctccgagctatcttatgattttgttattgctgtagttgcgtggtttgcagtaccagtaatctgccataggctactgtggattcttccatgatagctcaaaagtgttcaaccgtgactttcgcagcttgcacacggaagaagcaattaggatcgttaaatagagtagtgttctagtaaagcctttgttcaacaaacaatcaaacaaacattgtagccatgaataacctaatggaattcgttcaaaaaacctggactaatggatggccatattattaatttgtgcaagccaagctactctagaaacttcaaatttcccagacaaaccagctgccctccaccccccaacaccaacaacaatgttatcaccagctcttgcaatcctgactctgtcatacatcaaacctaggatattctgatcatatccccagactgagcaatcacaccatgtattgcaaccacaagatggcaaatttctgattatcaatcagcattgatccaagtatatgccaatcgaaaacgataccgtgatcgatcacgccaaaaagatctcctctcgcgagagagagaacgataaagaaggtgtcacctatcaagctaccaccatctacttgttaacttgtgcacaaaagtcgtatgcagaaggcacacgagccctatcctccttctttgtctgtttttaattaaagtccaacatggcatgtaacgaaagctcagtcgcggacttttacttttcttggttggtctagagcttgcacaaaccgaaggaaagtggctgtacggacggacatggatcaaaaaattcagcgaaaaaaaaaatctaattctccgtagtagtttgcatcgtgatgaggaggaacgacatggcgtatgaacgtacctcgaatggcgatgcactcgctctccatgcggtcgacgaagccgacggcgtagtttgggtcacggatcgagcggagcacgtactggcggctgcggcccacgacgggcattatcgcgccgccgcccccgaca

SEQ ID NO: 89830 - DNA, 838 bp, Oryza sativa
gaggtagaacatgctctacatttaatttctgttttttgttgttttattatatacaagcggccgtgtaatttcataggttgttgctgagatggctgcagttggatttggattgccaaaggatgcatttacctttttgatgaagaaagtaatgctgtaacaatctgtaatatcctgctgtaatttgttaatctactcaggatgcaagtaaacagtaccaggtcccagcattatgttttacttagctaaaaatatttctgttggttcacagaaattgagttgtttttttttttgtaattatgtaatgaacgctgcattttaatgcattattcagatccattctgcattcatcctgttgacattggtcgattatttgtgtgtttttcatagggaccacacctcctagcaccaactggaagtgaccttgagcggcatggttctgagggcactgtttttgctgggttccattatgatctcaatttcctgaccatacatggtcgaagtagatttccaggcctgaacatctggctaaggaacggcaaaaagatggaagttaaggtccctgttggctgtcttctaattcaatcagggaaacaggttagctttgcccgttttactgcaagtatcttaattagttcatattcgcgcatcaatagaaggtcatatgtatgcatattggtttctgttctgatctctaaattctggttttccatgaaattgatactgttgtcaatcatagaatcaaactttgtatttgtattttgagccttttctgaaacacaaacactaaaaaactgggagtgtaagctagtgaaagatggggcttatttttgacaacttg

SEQ ID NO: 89831 - DNA, 2309 bp, Oryza sativa
  unsure (1)..(2309): unsure at all n locations
aagatcttgatacgtcttgttgccnagagcactcatggaagaggcttcaagtcccaaagttcagtgtgtgttatttgtgtctgtaaagaacactgaaactttcagtatatgattagtcaaaagaaaccattatagaactncagcaagacatcgtcgaattcactgtggcaaaggtaaggttatgaaagaaccagtaaccagtgactctgctcctanccagaaatctgatatggnccgtatgtagtactgtggtggatgaggttcaaagatcggtacattaaaagaaatctttgtaggtgctcctcttgccttcttcattagtgtgaacaactctgaatgataaatagtatcattttcagaatcctggaaaataaaactgaatgttaccaacgcattttcctaaatcacttggtggtaaatacattaatgcatgacataaatatagatagagttctacaggatcaaattaaaaacatataaaagggaatatacatgcttcgtatatcctctaccacttaaaaacaagagttggtggtgataatactagcctctagcactctatactatcacccttctgtgaatttgtaggatcttttgcggggaaaaaggattgcattatctgtagatcctaagtgactacatctatagcgttttagtttctttcaaaataataattttgcatttcttacactcagaatttatgatacatttatttgatatttgtcgtggcccacaacactgtgttagcttttagtataaccgcatgagtgatacagttgatggacaaggttgctgaggaagatggtgagatttataactgtctctggagttactaatttgctatccacgaatcaatatcactgtccaatatagttggaatcctcaaaacattcatactaaaaaaagaggtgcattatccatagttccatacttcatacagtactgaacagagtcaacaaaaaaagcgatctctaacaagactataagagaatatttcatcgaagcaataagacaatcaaaatggtggaagatatgttatgctacaactctaaaatgatgtagcggcaggagcatcaaaataatatatgcaaagtaataaacctcaacaataatccaccatcgtagcgacatgccatgatgacgatctctccacaaaaattcaggagttataagaaggtccacctacaaagcaagagatgaaggcataaataatcaactaatttggtatttctttcagattaatcaattagcattagcccttacttattttgttaccaagaccacagtagaggaggcccccacagctagaaattttattaagaaaagaaataattacaggtcacagtagcccttactttaagaacagtcctggtgattgggctcacagtagcagataagttgacatatggaaagtatccaacatattgtttaaccaccttcagcaaaagaatgtaaatttcattagtcagtactcttcagcgattgcggtattcaaatcaaccttgcaagttacaggtaccacttcttaagtaagggcatacctttcctagatgagaaaaccgaataagagctccgatatcattttcttccatctcataaagacgatccagatcaacatgtttttcctcaagtcttttacatatctaattcagagaacacataaaaaatattagcaaacacataaaaatgtaaattattggtcagctgtagcagataacaaacctcatgagaaaggtctctgtcaaactgcctaagtggatgttgttcgggccatattttgcggtcaacacccttgcagaactctaataataaggatgtcatctgagaccaccctcggcgcagacaaatctcaaataatgccctcataatgcgagccaagctttgactaatgtattgagcatcagagtgcaaagaggagctatcaattggagcacgcgatatgtaaacctgcaaaattgataccagtgattggttaaagaaagttgttaggctcaagacattggaaaaacagtagttatccaatagatacctgtatgagaattgaaattttcccatgtttgtcagttggcccccccttaatatcatgtgggcatgcattcttaaaaagggattctaattcatcctgttcttcttctcttactacaatattctcaaactcagaggaatgggccaccatattaatcacctgaggcagtatccagaatgattagtacaacctcacaagcatcacccaaacaaaaagagataaaaccttacctcactctcattcatgggtaccgagctcgaatntcaatttgcattcatgccca

SEQ ID NO: 89832 - DNA, 1925 bp, Oryza sativa
  unsure (1)..(1925): unsure at all n locations
ccgcgtgttgactnctgcttgacgcctgcaggncgactctagaggatcccccctggaattcgcacaaagttaaactaaagcctagaatttacacgaaggtgaatcaaagttactgtgggattggcaaaattacctccttcctaatccgatcaagctcatctgcactgcagccaacaatcctctctgcctgatcattgaacagagaaagccaggcctcaccagtagggtcggagaccttgatgaccatgatgtacctgaagaaaggaaccagtgtagcattagctttggctttgtatcatctcaaattcaagcatgcacggtgtaattcagcccaaagttttacctcagtgagcactcagcatcattcttctggcacccttcacaccagtatcctgatccaattgcctcagtcaccttcttgttgcaggtcttgcaagctcggtaccacatggtttggtcaggcttgataaggctaatataggcattcagactgaagaacacaggctgcaaaacataacaagtaaatttaggacaatcacaactagaaagtgctaataaactaaacatcaagaacaattccattttctttcaaagattccaagattttaccttatcctgacccaagttggggtcacttgtgatgtgagacagaaaaactctatcactgtacatggatctcgcgccaccaacccttgatgcgcccatatctgaaccaattgatgccattgaagtacccttgccttcagagtcatacctgtttgccaaaataacgtcaaggaccaaagtagatagtttgaaagataataaaaggagtgtttgagattaggacaataccaagctctgagctgttctgcctcaggcaagtcaggattcactacaattgtacttctccccacagttgacagagacaaacctgtcgacattatagtagtaatgctgttagcacataatcgccaattcagatcctaccacatgcaggaaggtaacacaaacataccttggaagtcagatacttttaggctctttatcgcaatgataggcgcagagtctaccatgtccaagagctcctgaccagtagttgtggcaagatcattccaaagagatatggttacagttttgctcctgccatcagattaaatgtaagttatcagcacataaaacataaagagcattcacatcatcaaaagaaaggagttaacaagccaaatgatgcttacgagtcatccgctacaacgatgtcacgctttggaatcgtctcgttgtcaatcttcctcctaacactaagagtaggagatacgctctgaacaaccccaataacatctgcaagtagggtaaaactagtcagaacactacattcacaaagtaggaacaagaacacatcactgaactgaaagcactattgccttacctactagctccctgccaccaacatatggccctagctgatcaatcttgacaaagttgtactgaatctgtgggataaaagtttcgccctcagcttcctcaacaacagcattctcattcagggtcatctcgtagtcattatggacagtcttgaactgcttgttggcgactctgagagatcctttggagatgtagtacaccttccccagctcaaacatcggatagaacttcttggcagcctcgttgaacatggttgcctggatctgggtgccctgtacacagatccaacaaaattaactcatcaatcaacatacaagaattcagaattgctcatgaactgcaattacatcctacggaataaacatttcacggtaggttgcacttacatccacatcagtgagctccacattgaagacgcagccttcaccacgagcattcttgtcgtcctcaggttgcccttgcttgtgacacgcaccttgatgatccagttgccttgtaggggtcagggagaatcaaagatg

SEQ ID NO: 89833 - DNA, 3061 bp, Oryza sativa
  unsure (1)..(3061): unsure at all n locations
ctcgataagtggtcacatgtatgagtggtacgccttaaaatatccagggttcgtatagtatttcacaaaattcaggggaaaaaatgtcctaccagaattgctcacggttctctgctggcacgtagaacatattctgagctggtacaccgcattcaccacctgaatccaaattcccatagaaggaacctgatccaggccaatctctttcatggttgccgctgcaagcacaaaacaatatcatcagaaacattgtttgaaatttccaccttgtctttggtttgtttctgtcgtcaagtcggagtaccttccaaccatgtaaggcacactggatgcaatgggttcaacttgtgcggtaaattgatcccattgtgacagataaccattggcatagcagatgtccccaatatgtattaccatatcaatattcttcaaatctttaattagctggtaggtcgtgttcagtgaaccaggctcgaagtcattgaactcatttgaaccatcggcctcagcctgtgcaaggagttcaaatgccaattaaggccagaggagaaaagcgaatttgtagcaaataatctctcttgttttagcatgagtagcaggtacttaagtatcttattctttgttagtttgactcgagatgatagaactcataaagagtacaaccttttctaacttgcataattgtcattaccaatttactactactaactaaagataaagacacactttggtggccttctgctaattgttccctatctaatcttttttatataattgagagattttatttaaagcacaagttgtactacatctcccatattaactttgaatagctatggagttccatatcgattcagtgatcagttacctaataatttattgcacttttgggagataaacgtggaaaaacaggcacattgtaagtggtatcatattcacaccttccccatatctccaaaaatgactacacgctgcaaagagtcttcccctggataaggaggtgcttggaagctatactcatgtccccaaataatagagccatctgatagccgatgcccaattctgtatgtatacctgaaatacaaactcacttgtaagacttgttggcacttgcatttgtacaaatgaatagttacaggaccacagagggcacagatgcagacaaagcaaggttgtgtaacactcatttacttgaaattaggccacagatccttgaggaaacttgtatgtatgaaaccaggatcgcgccatccaactgtcctagcaggaggacctgtggtaaaatcatcataaagcatgacaatgttatcatcttattaggttcgtcaaaagttacatgtcaatggttatttgatctacaactgctctgccattataccattattctaagatgtgtttcttttttagttgtcacttgtcagcactaatgggggattattactctgagcaagtaaaaacataatgaaaatttactcaccgcacatagtgctgcgactgaacgtaagggtgcctgcaggaaaaaggctttggatttgcccttgtaggccccatttgacaaatggtgtagcctcattggtgccatatccacttgtccaagtcactgtcatctagaatcacttaacatcagtcattattctgtaaacatggtatgatctgatttgcagaagcactttggtgcccatttgtttcataagcaacgcagacaagcaaacactatttcggaagaaaaaaatatcacttaaatggaacaatctgagatgtcttacattcctgtttttgttgctttgacattcgagctcataaacatattccattaaaaaaataggttacttgcattgaaaagtgctaaaggaccataaacgaaattttatttctgtccgcaatgatattttcttttgcagatcacaggctaggatgctcaattgagactcacttcattacttatggaatacttaacaagatgatacttacttcattccaggattttccttgcgctaggcgtgggtacacaggggcctttgggttcgtgaaggttactctctttgagtgtgcaatgagctttggctgtgaggttatataagacatggcataggcaagttagaccatataatagttcagtcacattgtattttaactagaaaagacaaaatatacaagaaatacccccatggtaactgaatcgttcaacaataagttttcacactaaataaatgaggagaatttggcacatacatttgagaggcctccagaaaacaatgcaaatgaaaaatcctccctctgattgattagctgaagcttcatggatccctttcctgtcttctcatagtcaagattcttgtagtttgcaaatataaactgccaaaaaattgtgcctccttcagcatatgttattggcaagttttctgaagtctcatctacagttcacatggaataaggctaactggatgtaacactaacctttatgggagctgtacatagaagtggtggttcaacccattggctctctgatggacaagtagaatcactggtaaattgccaaaaaggcaaaatataaataagatctcaacttctttcttgctgtcttaattaagcattcaattcaggcatccagcatcaggatgattggattgcaagtacctgaaattagcaggagagaacaccccaatccaatcatccttcgatggcttggggttgttataggtaagagtcacccattctctgtcctgtccctgcaacagataaggtagccaataatttgaatacagtgggtctatggaagttcaaaaaaaaaatcatgattgattctcctataaatcctaatgctgcaaaatgcaaatatatgcctcgaccgactaaattaaggcactattaactgggatcagaactctcgagctttggtaagtggtaatggctgactacatcgaactatataggtccgtacaagaacaaaaaacagcagcgagtgcttaattgaccagctagtagatacagtaggttgctgagaaagcttgagtacctcnaagcccangaggaagcgcnaggcgtctaccgaggcacccgg

SEQ ID NO: 89834 - DNA, 1731 bp, Oryza sativa
ccaaaattttaaaaaaaaaaggggtttgaaaatgaatcaggggaaatgaattcatgggtggatggtttttttagtggtgaaaacataaagatgtccgagataggcaaatgaagtaacactggtgctcatttcaatcgaatattaattttgggcaatagcagtggtgcctattaaagtaaatgctacctgaacttctgtggttgcgccctgtgaaactggtaattcctggaatttcttcatttgtgagcgtttatatgattatgcgtgtgaaaaagggttaaccattgccacagtgattgttgatgtagacgtcgataaaacaacgtgggttgatgatgatgaagcatgcttaagtgttaatgcaacttgctgaaatggagttgcttggggataaatgccccaatagcaaccataaaatgtccaaccatttgatggttgactaggacatatcaggttactaggtggtgaaaccacagaataagacggggccccagattgagatgtcactgaaggagcaactaaggaagcattagctccagtagatgcaaaggaatgtgatgctccggttaacacattagggcctaaagtagggtgtacatctggtattgttcctgacgtttgtaaaaaatccaataattgctgcggaggtggaaaagaaccatatacttttgaagaagaaattctgccatacaaaagaaaatgaaaatatacttagaactttgtggtacgatacaatctctaagaacagaatcaatccatgttttactgatcaggcgagtgcaaatgggttagaaatgtctggatataagaccctctcaccctaatattcagcaagatagataatgcatttactagtactaatattcagcaagataaataaagcatttactggtacaactataatgataccaacaaaaaaggaatagttcgaggcaaatacgaaaagagaagatgaattagtgactaatcatagcataactgaagcatggtatttgtataactaaaatccaactgatcatgtaaaatttcaatttatatttttttataagggcagttataatgaacgatactaaagcaaaagaatccataatttcacaaaacaaaaattccaaacttacagacctggaagcaccaaattcagctgctatagtatctagaaggttttctgctaaaacttttgcagcttctaggttcttcacatgcatacttgagatgtagaggtgtagaggttgttgtgatgctgtagtatagcaatagacattacacaaaggaacagaagtaatatgcttcccaactcacgagtttccaagagctaccaaaataaactacagaccttcagcatgacaattgaccggagtccctgaaccttttcctctgagtacaacagtgacccctgtttcattcatgatgtgatttatgtactgatcctgcataaagaaatcagaagcaccagcagcacaaaaacagtttctcccatcccaattgggatgccagagaaagcttcaagattagttttcttttcttttccacgggtaaacagaactggactgaattcataaaacaatactgacagtaatagcaacaatggcatggttgaattatccaataacgcttaatattttacaaaatacgagaacatacatttggaccacgaacccaagctgcaacgttaagtgatggatctgcatgaaaacccaaaaatattgaggcactaaaaggatgaacggcctg

SEQ ID NO: 89835 - DNA, 5282 bp, Oryza sativa
atgaagctcatcaaattctgcagaagctgacagtatgtgcacaaatgcctagaaagcaatttaggctgttagttatataggcattccaaatcaactagcactacaagcaggttgaactaataatgttgcaaacaaatggggcagcacttttacttacctctaatgatgtgttggggcctatatttgtcccgaacattgagactgtaaggtaactaaggtaatactgtgacgctatctttcccaaaatcaagtactttacagagtgatcatccacttttatgcatccactgtcctcaagatcttcaaatgttgtttccactagcctgtttagataaatgtgagaagtaattggtctcatgtgatgttatagctagtggcagatgagatctaagacaacagaagtcatcatcatcaccttgagaggtagcaattcaaggtgtacgtttcagtatcttccaatccatagtaagctgggttaacaacctgccatgcagaaaccaaatgttggtaacgaaccaaaaggaaatacaatagattcatatgaacatataagaagttacactgaattaaagtctttagtcatttttagctgaaaacttcaaatagccacagatttaaccagtgtaataagaatgtcgacagttcactgcatcaattgtcaactactagccatatgatttatagtaatgattctgttttcaactttacaagagtaggaacggtttccacccaaataattgagttgagatagaacacaaagcatgctgaaaccagattgactaaatacttttgtttcttcaatgtaagttacaaggacataaagagtaaagaaatggattgcacgagataaataccagtcttcggtacaggtatgtccaagtaagataaatgatcgcctcctctttattactgatagtgccggaaacaatctccgcatttatgtgatcatgcaagtgctcccttagattactttcaacagggaatggttcatacaggaactgagaatattacaatattcattgttaaacttcagataaatatgcattagaatgtttgttaggcagacaaagtgaaaaagtaatatgaaaccttcttataaaagcttttttttggttcatgaacaagaataacagctttgccatgttggtcatattgtggtcgacctgcccgacccatcatttgcagaatatccgtgatatcataatcgatgtatctttttgttttgccatcgtagtattcggttccctataacaaacgattaaatgagttctcaggaaaatgacaattgaagacaaacaaaatatatagcattgtgttaccttaattatgaccaggtgagctggaagattaacaccccaagccagtgtgctagtacataccagtacctggaaaaacatcaagcaacaagaaatgatgtttaaattagcccaggtatgtaattagcttgggttgcaagagaaatcgcaataatcttacttaaatgtaaagaatagcatgtttacaggaaaaaaaaaacactacttgacgccaaacaaacctgaatcttgttgtttgaaaagagttcctcgaccaaggatctatctctatcatttagacctgcatgatgcagacctattccaaattgcagagtatgtctcaaattggtgtcagagacttgtgaaagaatcatgtcgagagagttatctgccatgcttaggaactgccttggtttttcatctgatgcagcaagctgtaataagagtacagtaaatgtataagatagcagttatctatatatccattaaataaaagaatccaaaacagcatccacctggatgagatcaagagcagtaagtctagtctgccgacgagatgatacaaaaatcagaactggtttgtctggtgaatgagtacatattgctgcatatgctggtttattcatgctattcattcttggacagtagaacttcccaggatatccctgttggtataaaacaaaggcactatgaattgatgatagagatgtttacacagagtaggaaactgaaagtaacaaaaggtggcccatcaagcaaatactcttaaaaatagatttctcaaatgcttgctaatgcatttcttaaagaataaaatgaacggaagcaccaaacttgcaaagtggatggtggaataagtcacacatcttgcattttgatcaaacaagtcacccaaaatttgatttgttgatgcaaactttgtcactgatcatgaaatgtgggctaatatagctgagttggatggctacacaggctgaggggcactaatttcgcaaagtaagcacactcataccatacccatcaatgagataataacatgcattctgcattttactttcctgcagtcaaagtatgttggttcatgtacatgtttatctcgcatccgttaagcaactagaagaggtgcaaagcattacttacgacttacaagcatttcacaccaccctcattaggtttgctcactaaaaatcaaatgtagtgacctgcttgagcaaaatgcaacatggacctagttgtaccctctttttagtcttttctcttttcttaagaaccattcaagaatacatcaaaacaaatactaatccattgtaagagaaatgtgcatgtgtgtgtgtgtacatatattgaaaacaacagcttgatgcattttccaggtaaagttagcaatacaatggggcaaatggctgtgctaaaaaaaagtctgtgttagctctttttgagccagaataggagcttcagttaatgtgaaaatcctacttacctggatatgcacttcaagaggtacaggcctcacgctgggcttgaaattgaatagaccatcatctctcacgcccaaccaatcagctaaatcactgaagtaccatgacaaatggaaagatgtcagccaaaggaaaatagtgcacaagtgcacagtcaatacaacctttttggagttctgcacgggtattaaggaagtaggtgaaattaaatgaggagagggctgtgattggttgagatgaggatggtggggaaatttaattagagatcggttgtgattgcatgagatgagggagtaggtggagaagttgctatattttgaggcaaattttgaacgctagaaattatatttttggatggaggcactaataaaattttcaagagcttaaaattcacaccaatctaacacaaaaatcaaaatcaaaatcaaaatcaatgtaacattgatcatgatcaggactccaacaaccagggttaacaataccatcaaccacaagtaaggcagtaaccactcataacagttgatgtgactagacttctgcaatccatggagcaaaaatacatgtatagaaggttgtggacagcatacagatctatatagaactagtcatgtagaaggtattcctatgtgataggggataagaggattgcatgccaaagtttcccttagtaacataccgagcattggctaatgctgttgataaaccaacaaaccgaattgaacgttctgtttgtgatgatatgtatcgcattcttgatacaatgacctgaaaaaaaatcatcatggtaaacaattggcaaaaagataactttgaaaaacaagcacagcatgaatagatgggattaagatgaatgcagaagacaataaattatgttgccctgagatagagttaaagtaaatgaagttacttatggaccataacatgtgttgcatgtctttgacttccagaaatgatacctcgagaatagggccacggtcagctccaaaaaggtgtatctcatctaatatcatgagcccaacctattaacaggcttaacaagatatacttaatagaagtgttatttatcacaaagtaaagcaaaattacaaatcagcaaatagttaaagctaatgtagaaagtgaaaaactcataccttcataacataacttctactatgccaactacgactaatcccatcccccttttcaggggtagaaattatgatgtccgctgataatagggccatcatatctggagtgaagtcgccagtcatctcaacctgccaaagcacattacttgagataagttatatatatattggtgtattggaaaattagaagaacagattgccctttaccatcttcttcccaagctgagtaacaagacgttgtctccaatcattcattctttcccgtactatagcctttaatggagcaatgtaaactacctgaaagggtgttgaaaatcaattccagaaacaatcttagctcattgtaagtatttaatgaactaaccttcatgtctggttgtgtgttgaaaagatgaagcattgctagttctgcagaaatcgtcttgccactcccagttggagctcccaagagtacgttattgtcgctgtgatagaggacgtgaaaagcctgaaaaaaagataacatcagattataaaaagcaaacatataaaaaagaaaattcaagtggagtctgcatgcattaacagatatatgcattggccattatatagtaaaagaaattcacagcatgagcttctggttgttttttcttgattctttttttaatcaaagttttttcttgattcttgattttatgagcctttcataatgaagtcttccacttccagccaaatagaaaggttatgcagtgtaattacagtcatttttataacatgcagatgtaacatggacaactaaaacgcaagataatttgattttcaatcgaacctgtgtttgtatcgggttgaaatgggaaaatctgtatagatcttgatacgtcttgttgccaagagcactcaatggaagaggcttcaggtccaaaagttcagtgtgtgttatttgtgtctgtaaagaacacctgaaaacttcagtatatgataagtcaaaagaaaacattatagaactacagcaagacatcgtcgaattcacctgtggcaaggtaaggttatgaaaagaaacagtaaacagtgactctgctcctaaccaggaatctgatatggcccgtatgtagtactgtggtggatgaggttcaaagatcggtacattaaaagaaatctttgtaggtgctcctcttgccttcttcattagtgtgaacaactctgaatgataaatagtatcattttcagaatcctggaaaataaaactgaatgttaccaacgcattttcctaaatcacttggtggtaaatacattaatgcatgacataaatatagatagagttctacaggatcaaattaaaaacatataaaagggaatatacatgcttcgtatatcctctaccacttaaaaacaagagttgg

SEQ ID NO: 89836 - DNA, 1520 bp, Oryza sativa
  unsure (1)..(1520): unsure at all n locations
gcgtgcattganatgcagctcggacccacatgatagaaacgatcgttagtaaaatacagataatacgtcacatttccacaagtgctaatgcataaaaagttagtatacagcactgcattcaattcacactgcaaaatacatactttccagaataagcttatgcaacatcatttgcatcgaatatgtaaacaagggaagaaaaggatacctcttcccaagctattccatacaccagaggattagtcttcatccttataaataagtatgtgtagccaagccaggcacaggcctccctgacatttgtaacagtgcccaaggcaacctcagcattcaaattatctttcaaagatccaaggaactgcacgatgaacatggccacaattagtcaaattcaaatcaaaccgaatgaacatgcaacatcaaccaactgaccaccagccaagaccaagaagcaaagggaggaaagaaaactacaagatgtatttccaaatgtatctatgggccttactagtgtatgcattatcctacccatctaaagcgctatgtatttgtgccgaagacattacaatgaatctggtttttgaatatctgattggtttggatattagaaattcacagtagtcttaaagcccgtttgtcaatgacagtagtgcaggtacccacatgtacatgtggaaaaggcattccacataactatgcaattttttcaaggcttcataaataatcttaagaagatactgacatggtaaacaaaaataggtttatgtgaaaattagtcaaccacctaggggttaatatagacaaatgggaagtgtgactgatttatgtttggccatggcatattcattttctcaacaattcaatgttagggccatatcccctgaatcttttcttcgccccataactgaactaagataaaggctgactgatattttccgcatccttatttcaatactctccgaatcaaaaagtaatttgctaacctggctttctatcggaagctgacttgttaataatcttaagtagtaagccaatttgtcgtgtgtcgtgataataattccttcgccacttttgtcaaactgcggtcgtccagcacgcccgaagatctaataaaaaataaaattaacattagaaacatagactttagctagctagaaatgaatatagcacgtcagaatcaaggcaagttcaaagcggtacctgcatcacatcaagcatccccaaatctcgccatccaccagctttaggatcatatagttgtgttccctgtttgtgggaagtcaccgtatttattagtgtttcgtttactaaactggaggaaatgaattctaacacttgacatattaacagtatattacaatttaccaatacagtcacaaaagtaatcataatagatgccaggaaactgggtgttgccgtcacacgtctgttttggacccaaaaagcagatactgacctttataacgactgtatgagccggtaagttcactccccaagccaaatgtgcagtacaaacaagg

SEQ ID NO: 89837 - DNA, 859 bp, Oryza sativa
  unsure (1)..(859): unsure at all n locations
ttttgccatcattaagcataaggaccctttccacatcaaaaggaaaaggagaaggggctcctttaaaaagactgacctggcgaagagtccgagcaactagcgcctcaatgactgaacctctatcatcatttagcaagtgcacctcatcaatgattataagcttcaccaacattgacagtgacatgtcactgcttttccgtgtaataacatcccacttctcaggagtagtcactatcatctatggaaagcaccaaatattacagctcagacctgcaactgaaaataatgaaacaaagttgcatacctgtgtttcttcaatctcatttttggtcagctgcatgtctcctgtaagttctctaacaaccaggttcaacggagataatcggcgactgaatgtggatgttacctctgcagccaaagcctaaatggcacaattttgcaaaaatgccacaacaatcagaacattgaacaataacatagatcaggtgacctggtaaaaaaaacatagaataggaaagaagaaataccttcataggggcaacatagactattttgaattcgtttttatgcaaaatgccatctctgaagtgttgtttgacctgcaaaagaagtgcccaacccaatatttaaggttcccaactagatgtttaacgagcagataaaacagggggataatggtagaaatcagcagcttgtagaattgggtagcttttcaaggttccgccaatgaatacctcatgaagaacagcaatcattgcaatatttgttttgccagcacctgttggagcacaaacctgaaaatcgatggggatcctctagagtcgacctgcggcnatgcacaattgcgcactcaatcacc

SEQ ID NO: 89838 - DNA, 1187 bp, Oryza sativa
  unsure (1)..(1187): unsure at all n locations
gcgccctttgattacctgactgncaccctaacnnnnnnanaggataaatttataatattgtgaaagtgcttctcacgagaaatctcgcataacatttccatgttctcaagctaaggattttaattaaaattgcatttatagtcgaagtttctgaagtttgaccagatcttttcgaaaacgccatatattaataatcacagagagttagttcattttcaaactggtagttacttctgcaaacactatcatccattggacataaaacaatatgtaggcaaatttaatattttgattaatgttccctgtcctttcatctaccaatttacaagattaatgtgtatatctcgatggaaagaaattgctattcaaccagtttgtaaatgcattatgatcttagtcgggcctgaatttagttgttatcatggtgcaatcttttgttgtattcaatgctctttgctgattcaggataacttgaaccgaaccctgtgtggaaaagtcccgtactcagttgatcagcaacaccttgatgacccacatgttaaagcaaacttactctttcaggtaagtagatttgagcttatgattggaaatttggagtatcatcttatttttgtactggcatttttatgataacatctgaatgcacaatgaatggttattaccccctttttttcccgagtgaaagcgtgctggcacaacattttccacacagaattcccaactagtgcctatgtcactgattcgaaatcggctcttgatcaaagcatacgtattatacaggctatgattgacatatgtgccaatagtggatggctttcaagcgcattgacttgtatgcatcttctacaaatgatcatacaggtcaatttcattgtctcagatttctctctctcccccccactccccccctgtcttaatttgttgttagtgctgcgagcagaatcaaattacttataggcggtagaactgtactccataaactatgggaatacctcatgaaagacagagagacaaaatgtctcgatacatggcatccatcaatgaaaaaggctctataccatccgaagggcataggattttcaacaattccagacttactaggaattctctcgtgaagaattacataggttgcttcaaccagttttttgtttttgagttgtaccaagtactgattgagagtttggaca

SEQ ID NO: 89839 - DNA, 718 bp, Oryza sativa
atctatatatccattaaataaaagaatccaaaacagcatccacctggatgagatcaagagcagtaagtctagtctgccgacgagatgatacaaaaatcagaactggtttgtctggtgaatgagtacatattgctgcatatgctggtttattcatgctattcattcttggacagtagaacttcccaggatatccctgttggtataaaacaaaggcactatgaattgatgatagagatgtttacacagagtaggaaactgaaagtaacaaaaggtggcccatcaagcaaatactcttaaaaatagatttctcaaatgcttgctaatgcatttcttaaagaataaaatgaacggaagcaccaaacttgcaaagtggatggtggaataagtcacacatcttgcattttgatcaaacaagtcaaccaaaatttgatttgttgatgcaaactttgtcactgatcatgaaatgtgggctaatatagctgagttggatggctacacaggctgaggggcactaatttcgccaagtaagcacactcataccatacccatcaatgagataataacatgcattctgcattttactttcctgcagtcaaagtatgttggttcatgtacatgtttatctcgcatccgttaagcaactagaagaggtgcaaagcattacttacgacttacaagcatgtcacaccaccctcagaggtttgctcactaacaatca

SEQ ID NO: 89840 - DNA, 3881 bp, Oryza sativa
  unsure (1)..(3881): unsure at all n locations
gctgtcccttgaattcgagatgcgagctcggnaccctcccccctaattttcttcttttatgggcttagtttcaatttcctcatcatctttaattacatgctattcttgcagtggtttctcagggatttgacaggaatgctcggtgggatactgttcactttttatcaggtgtcaaattctcttgctaactcgaataggcaatgccatcttattgccattgatagtttgtttactgatgagataacttgcttggtcagtattttatttgtctatagggtgtactaattctttgtgctttcacttttcccagggatctaaccttgatagcaatgctaaaatgtggcgcctagttgcagactttatgaatgaccttggtaatatagtctatatcagtaatcgctgtattaattctttgaatgcgggcgtctaatttaaaggtcctgcaatcgtttggtatttatattcaagactaagcattcatttttcttttgaggtattctgctatagtaggtgaatattaaatagcatatgtgtcacatgcccctgcaaatgcatttcacatggaatctggatttaaaaaatcctttgtttaatgcgaattccttgtagtatcaaagtatgctagcagagtttgtttgttggttttgcagggatgttgatggatctcttaagccctctgtttccttcatcattgattgttataatgtgtttaggcagcctatctcgatccttcagtaagcggatttacatgatgaatttcataaccttttaaattttcttttaaaatgtttgttcgttaactaattatttgactatctgtatagctggtgttgctagtggagcaactagagcagcgttaacccagcattttgcacttgccaataatgcagctgatatatctgcaaaggtaactttgcattatcttgtaacatcctaaatgccaattagatggtaaatttctctaaactgtagctgcagaagcatactcaacttttcaggagggcagtcaggagacacttgcaacaatgttaggaatgggactgggaatgcttcttgcccatgttaccagagggcatgctttgggtgtatgggtttcattcctttctctaacgatattccatatgtatggtgagtgcatcattccaatatttatttatttattttttgtaagaaggcctttataattgaagaatattattcaattatgaggtcagaggaatatgaacaaaaggtgtgtagataagtttttccatcaggacactgccacaaaaacacaaatgaattgtgaaacaaatatggtacacatgaataacatgaagaaagcagttataccaagaatgctgcatacatggatttcctatcgaaattttctatggattctggcagtttaaggtatccaaagattcagacgtggcactaatctggatttagctaaactagataatttttatttggatcccgagtcctaacctcctttctggtccataccaacttttcactaaataagttttgttcttttcctactttgttcttaggaataggttagtttgaaacctcatttttctactttgtactagataatttgaagcaccaccgagtatttgcaggaactcttctatttacatcttgttttatttgggactattcagcaaattacaaggcagtgcagtcactttcactcacaacactaaattatgagagaagttccatcctgctgcagtacttcatggacaatggtgaaggtgagtacactattttccttttcatggtatcatgaaattcatgctcttgcgatcactattgcatgcgaaaaaagctaatgagccctggaaagtgttagtagcttgaagaggatgtaaatatattttactgtaatagtgtttgtatatcatcagcggcttaatgctatgtgctttgtgcccattattttcttctatatcaataaaagcccaagcttggtcagcttgtggttagcaggccattactagatgcacctaacatattgtaacaaatttcaagtataatgtgtactgcactctgaaaacgtcctgcttctctattttatcatgaattcatgtgttgatgttgaactattcacggcatatgaaatcatttccttaacaatagcttttgctgcttcatctgtgtgaataaaaattccatggcaagccattacattatttaatcatcaaaatttcttgggtggaattttcctagtcctcacaccacaacaggtttccaagcaagagcatattcttccatattggtcaagctggcggaaatttcttagaattaaactgccacatgagcatgtacatttaggtgctaaagcctcaaggcttacacaccctgatttgtaagtactaagttttgagttatgcttttatgtgtttatcactctatgggggaagaaacatttactctgtttgtcaaatttgataggctgcagattgcaaaaacaaggccctactatagaaatggtataactcgtctcttggttaatgtaacactaaactaactgttgctgacttttcttttacttcacaaatctattcagagaactatttcttgctggataaggaagccagtgttcacattttcatccacaagcaggcagcggcaacagatattttgatgtccttcatacatggactcgtgttagcacatttgatgcagaagagcaaatctgggcatgcggaggctcgccaatggattgatgagaaatataacacttttatctcaaaggtaaagccctataccatagaatatagatgttcatgttgcgtttgacttgctacgacattaactgatgttagtttatcctttaactgatgttagtttatcctctcagcgtttcttaatttgtattcacatacaattggtggtaattcatgcaaggccaaaatctttaaagaaccatctctctgagctctgagcttatattcgtagaatgaacacacagttgtaaatgccttcttctatatcattaatggtagggttgtggagatgtactatactccctgactgtctgttacagctaatgaaaaatgaggattccacgcatttgcctgttgtatatgacaccaaactgcggtgggagaagtcagatccataaagttaaggaatgctctattttgggtatgtcaaaaaccaaaagctgagtcatcgtaacactggttttcgccttagcatggctaccccaaaatggcgtatatccccatcgcagatagcagtatagcaccatcttatgcacgtgtgctggagtacattcaggtctcttagtagcctggtccttgtactttgtcaaagggtggatttaggtctggtaacattttatgatataaatgtgaatttcaacgtttttgcagttgtcttctactgatgatgattaattttctcccctttgcgcagttgcaagttgaaggttactcaacagagcgacttctttcacactcgatcgggtggagggcacattgggttcatggtccctctgaagagaagctcgagtaggaggaagcaggcgaaggtagcactatctgttcaacgcgatattattagagcaattcgacatactgcataggatgctttgcatatctcgtttgtttccgttccgaattgccacttttcaccatggagttgcactgcatcttgtaatcgcatgggatatactttaaaagctatacttgataataatactattaaatgatatagcaaatgggttcgttgatatttgggggtaccaggttactcgttagctacacctcgcaagaaacccaaagctgcgcacttttggtaacaagtgttgcttaaaacgaaaaggtgccgcttcctgttgcttaaaacaaatgatatggagcgccacaaatcaccccgttggaact

SEQ ID NO: 89841 - DNA, 735 bp, Oryza sativa
  unsure (1)..(735): unsure at all n locations
ctatggnccaggnatgcanngcaaaaccncacnnnnannntannagatccccacctaaattaaagcaattcaacgtanaaacacaattttcacaaaaactagtgataatttttaacaactaaagacaanctaaaccggtaaaattttttaaattacctcatgtttctcaaattttggggtgctcaatgaatttatgccaaaaaacaaaatcagattcttcaaatttgcgcttcttttgcctcctttgcattatactggaaaggactgaaacttccatctttttcgatgaaatgtaatgcccaggcttaacagattggccagaatcgattcttttctcagcaaaattattgtccatgttccaaaaaagtttttggacattatatggcggaacaagtgtcttctgcaaattgaacatggaaagattctgaccatttctgtggtttccatatcgctcaaaccaaaaaagtgccatttgaaggtttatcctgggcctctcacttctttcaattaaatctgatgatgcattttctggctgaacttgagtttgctgctcaatttgtgctgcaactgccatacccttaaagggaggttctctttaaaggaatttagaaagtatgcttggacctctatcttcattgttcctttgaacaaagcttaccatctttatttcaacaaggaatggccctgtgacattttcatttccaattttatctacagaccatcttacccaattat

SEQ ID NO: 89842 - DNA, 724 bp, Oryza sativa
  unsure (1)..(724): unsure at all n locations
caccttaccaggttcagtgcatgnncccnncnnnnnnnnnannntanagatcccctatatttatgtcatgcattaatgtgtttaccaccaaatcattcangaaaatgctcgtttacattcacatncattttccattgttgtgtaaattatactatttatcattcaaacttcttcacactaatgaataaagcaaaatgagcacctacaaaaatttcttttaatgtacccatctttgaacctcatccaccacattactacataccgtccatattacattcctttttaagaacagagtcactgtttactgtttcttttcataaccttacctttccacaggtgaattcaaccatttcttacttcacttctataactttttccttttgacttatcatatacttaaaatttcaagttttctttacatacacaaataacacacacttaacttttttaccttaaacctcttccatttaatgctcttggcaacaagacgtattaaaatctatacaaattttcccatttcaaacctatacaaacacaagttccatgaaaaacaaaatatcttcctttttaattgtcattttaacatttcattttataaacaaaactgaaattacctccaaaaccttctattttctccaaatcgaacacttattataaaagctcataaaatcaaaattcaaaaaaaactttttttaaaaaaaattcaaaaaaatcacccaaattc

SEQ ID NO: 89843 - DNA, 725 bp, Oryza sativa
  unsure (1)..(725): unsure at all n locations
atatgcaatttcatgtagcatacatgaattttaaggtaacagacctccaagtaagtgggcagggtagcagataggccaacaatgcgaatcattgattgcatagactcaccctgtaagattcagattattcataaatataaatcaagggtaaaagacaagatctaaacaagagcattcatgatctaaagacttagtcatatggatgcgtaataaatttcaagcatgtccatcttaacagccacaagttttttacagatcattcaagtttaatttttgccatcattaagcataaggaccctttccacatcaaaaggaaaaggagaaggggctcctttaaaaagactgacctggcgaagagtccgagcaactagcgcctcaatgactgaacctctatcatcatttagcaagtgcacctcatcaatgattataagcttcaccaacattgacagtgacatgtcactgcttttccgtgtaataacatcccacttctcaggagtagtcactatcatctatggaaagcaccaaatattacagctcagacctgcaactgaaaataatgaaacaaagttgcatacctgtgtttcttcaatctcatttttggtcagctgcatgtctcctgtaagttctctaacaaccaggttcaacggagataatcggcgactgaatgtggatgttacctctgcagccaaagccgggtnccgaggtaagtcgcttaccnggcacca

SEQ ID NO: 89844 - DNA, 605 bp, Oryza sativa
  unsure (1)..(605): unsure at all n locations
tgggggncnnnnattgtagatcgtgcttggtacccgcgtgcttttttaaacctcaaaataaactgacacccataccattctctcgagcttcagaactctgtgatttgtttgaaagaagtaataaaaaaaagggaaaggttggtataaaaagcattaagataatgagtgtacaagcaaagcagtgaaaacctgaacaagtggaggaagctgataatgatctcctactagaacaaactttgttgcaagcatcaaaggtcccagagatacctagtgagtaaaatattacaatgtgagaaattataaatggtataggatgcaagactctttagaaaacaattttacagatcattctggtttagcagctttgaccaactaatgtagtcttgaagttaaatgaggaccatcgcgtggatttttgtggcttccttcaagacttgtaccaagcattcctagtttggagcctaccggtaatgtgatctggcctgcctcatccatgatacatgtgtcaaacttcttatgtgctagtaaagggtgataaattcccaaacaagtgactccaacaacttgcacttgcttcattctagctttgacggcatctactgatt

SEQ ID NO: 89845 - DNA, 1229 bp, Oryza sativa
  unsure (1)..(1229): unsure at all n locations
aggccccaatcccggggttaattccattggagatttaaaggttagggcaattctttgaaacattttccagtctttggtttaaaccttgcccaaaaaggattttaagttaatagcccctggtggaatttgggggtcccccaagcttggcccaatttttcgatttggacccaccgtattggtatgggccgccctcaccatgaacaaggtgaaacttctaatgggcaagtaaaggttaataatcccaaccaagtgattccaccaattggccttggtccattagagcttggacggcatcaccgatgggaaatcggtngtggtcaaaaaattaaatatcgaaccacatttcttcattttaaaagcacaagtagaataatgagaaattctaacttgacaagcagtggcctttgacatcaggatgtacagcttcatgccttccaattcgaagaaaatctacaccctatataaatggcattagagcatgttcatattttgatgatttgatttgttgcgctacaatgctcaagccaaacgttgctcattggaacaatgcgataggggaaaagagtttgttcatttgaatagtacagtgagacagggagttatgactgaatttatgaaaggaagtattgcgaacacaaacctcagccttcaacttcataagcaaattatctatagctgaattggtatatgaggttagcaaaatagattcccctctcatcaataatgacttcacggcatgcaccatcgtatatgttttgcctgttccaggcattcctaggataagcgcataatcttttgctgctagaatctgaaagcaacatagtgtacgctttacatagtgacattgaattttcagaagaaaaaaaataatgaactaaagaccaaagatttactttatgcagcgatctctgttggtcattgttcaaatttggcaatgattgtatatatgatagtgccggatcttgacttaggagtcctccactatcaaatctgggagcctatcaacatccaaataaggaaattacagacaacaaaaacagtatggagaaacatagcacgaataggctagtggacgaacagacctcgaggtcaacaatcaacttccttaggtgagagttttgtggattctcagcaaatagttggacaaggttgagtctggcaacagttcaaatacaaactttatttagggtgtacttagagtgactgcggcaacagattgtatcaagcct

SEQ ID NO: 89846 - DNA, 655 bp, Oryza sativa
  unsure (1)..(655): unsure at all n locations
cccgttgttgggggcataggtcttcaacgaccggctcgctttcgtcgccgcagactggtgtcctcgcntgcacggctggcatattatgcccccgttgttgggcgcatacgtcttcaccgaccggctcgcattcgtcgccccgactggttgtcctcgcttgcacggctggcatattatgccgccgttgttgggcgcatacgtcttcacagaccggctcgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctattatgccgccgttgttgggcgcctacgtcttcaccgaccggcttgccttcgctgccgccgactggtgtcctcgcctgcacggctggcctattatgccgccgttgttgggcgcctacgtcttcaccgaccggcttgcctttgccgccgccgactggtgtttccgcctgcacggctggcctttatgccgccgttgttgggcgtctacgtcttcaccgaccggcttgccttcgccgctgccgattggtgcttccgcctgcacggctggcctattatgctgccattgttgggcgtctacgtcttca

SEQ ID NO: 89847 - DNA, 1153 bp, Oryza sativa
  unsure (1)..(1153): unsure at all n locations
tttgttatcgatattcgtactcggnacccccgtgctcgccgcgctcttcggagcccatcggcaacacgggtcggaggaaaagcgcagtatcaaggagcggaagcaccgttcttggctcgcggcgatcatggcaccctggggcccccggaagaaggatccggccgtcgcgtcgccgccgcggcactcttgccacgtgatcagcaaccgcgggctctcgccggcgatgaggtacgccgacgaaggcggcgaggaggggagctcgccggcggagtcgccatggcgaccttcgccgatgcggaaaaccccctgccggcgcagaccgggaggcgcgactggggccggcggcgtctcgggcttcgccgtctgcatcagcccgctcgttcgtcccagcccggcgcggcaccaccgcgggggaggccacccgccggacgccgccgccttctccggcgagctggggccgtcaccgctccaccgcctttcctccggctcctcgctcccccactgccggtcatggaagctcgccgacggcggccgcttccggtgatcctatcctttattaatttttttcccgcgctccgacattatttatcccttttgggaggcttttcttttttcctttttacctttacgtgtaaactggaaaagaagaattcatcctggccaaccacgagctggcaagctgtcccactgacatgtaggcaccgacgtttgtcaaaggttactgtttgtcagttgaacatgttgcaagccactgtaaaaaaaaaagcttcttgcattatctatgtacaggattactcctagcttttaaattattttcaagatattatttctttcttgtgtttgagattcccaagccaatagatttagttgtgtgtctggcatggagggaatgaagccatgtgagcggaattgaatgtgagcgttatgaattgaagatctgaactctgagaactaagtactcctacttactccctccgtcccaaaaaaaaaaaacaaaccttgggttttcatatccaattttgactgttcgtcttatatgaaatttttttataattcgtatttttaccgctgttagatgataaaatatgattaatattttatgcgtgacttatctttttaatttttttcataatttttttaaataagacggacg

SEQ ID NO: 89848 - DNA, 562 bp, Oryza sativa
cgcctcctttgtgggggcatacttaatcaaggacttcgtgggctatctaagtggagataatggatttgaaagaggctactctcttgttcttgtatttgtaggtgcgaaggctattgaaactcttgcttacagacaatggttctttggaagtctacaggtttatttgcgcctaagaacatctctgatatctcaggtataccaaaaggtcctttatttatcaagccagtcaaggcagaaacatacctcaggggagataattaactatgtgagtgttgacatcgagaggattgttaatgttgcatggtatgtgaacatggtcttcatgatgcctatacagattacactagcaacttatattctttggaaaaatcttggtctgggttctttagctggaatagcaacaacagccataataatgctttgcaatattccttttacaagaatccagaaaagattgcacgcaggaattatgaaagcaaaagatgacagaatggacatgacatctgaagttataagaagcatgaagatcttaaaacttcaagcttgggatatccaaaacctt

SEQ ID NO: 89849 - DNA, 565 bp, Oryza sativa
aacctggccgggtgactgcagagatgataaatggcccttcccatagaggagataacttgtgccgatctcgtgtagtttgaattttcctcaaaacgaggtcgccgactagaaaggcacgggatcgaacattgcgattataataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcaacttcactcggcaacattgcttctgccccatagacaaggaaaaaaggtgactggcctgtggtccgactgggtgtagtacgcaaagaccaaagtactgatggtagctgttccacccatttgccggcatagggttttagccggtcaaaaactcgcgctttaatcccttgaagtatcatgccattggctcactccacctgtccattgctcatgggatgtgccactgaggcatagcaaatcttaattccaaagtcttcacaaaagtctttaaaaactccgccagtgag

SEQ ID NO: 89850 - DNA, 2259 bp, Oryza sativa
taaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaagggcttttcttgtacaactcagcttcatgcataacataaagtttgcttcgtcttgaaatccgctcggcttcatctttgtcttgggggagttcttgagaagtcaagaatcgtatgaggggctctcgccagtcggctgaaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactctttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcaaaatgcatggtccagtgctccatcttctccgcgggggtatcctcctggcactcggtctattcggtgacaaaatcagctaacgcttgggacttgattgaaattcggggcttgaatgatatgtccaaagacatcaactccaaagcccacttagcaatccgtccgtttgctccgcggttatgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattggaaatcatctgttttcttcagtagcttaaagaagggcatcccccgctcgccaagtctcgaaacaaatcggctgagcgccgccatgcatccagtcagcttctgaacatctttctgggtacttggcggtttcatgttgaggatagcagtaactttctccgggttggcttggatacccctgtgagacaccataaaaccaagcagcttccctgacggtactccgaaggtgcacttttcagggtttaatttcatcctgaaagcgcggatgctcgcgaaggttcttctagatccgagaataaatcatccctttgttgggcttgacgactacattattcacatatggcttcaccgtgcgggccgatctggttgagaagcatctcttgatcatacgtggataagtgcgtcctgcgtttttagttccgacggcatggggaataacatttcttccaaaggccggaagaaggagattcaacaagcggattcctttatcggattgaggtataccgggtggcatcccaaaaagtggaaatttaaccccggggggagttcttcctcctgttattggggggcccccaagaagttctttggggaaaaatttttgagtaaataaaaaaaaaaaagggccgatggccgttttttcaaaaaaaaaacggtttgccccacccggatgaaggctcttttagaaaccggcccccaacctggtttattccctttgaaggttcttctttttgggaaaaaggggaggtgttaaaggcgggcctctcttcaattgaggggggcaaccctctcttgaaaaccgccctttatagttcccccccaa

SEQ ID NO: 89851 - DNA, 667 bp, Oryza sativa
cctctctaggaatacggggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcaaaatcggtgacttcaaagctgatattctctgtgcggaagttttcccgagtgccaaaagtgaccgggagggtgatctggccgagtggagttgcggataatcctggaattactccgtgaaaaggcgcattgcttggttttagcttggagcgaggaatctgcatatcatccaaggtcttggcgaagaggatattgagtgcactgcctccgtcgatgagggttctgcg

SEQ ID NO: 89852 - DNA, 1258 bp, Oryza sativa
  unsure (1)..(1258): unsure at all n locations
ccgttactcttctctctcttcctttatctctttaaaatattactcttctctctcttcctttatctctttaaaatatgtttatagttggcttatagcctgctattgtacctactctaaagggtcaaattgccaaaatttgtgcacaaagttaagcactgaaccaaccactggctcacttggcacgccagttttttttaagagagaaaattgtcagataggcaatgtggtgcaagcggttagatcaacgatggacgatcccgattagcccgcctcgcggttcatccggagaatcccaatattctgaccgccaccgtgtccctctacccgccgtcacccctgggcttcgccgccggcgagcgaaccccgccgctccccttccgaatcccgggccgacattgcaagccggtgggcatcgccagttcgccaccgccatctggcttctgccctgaccctcccgctcggatcagcgcgtgttaccgcggcgccggatgaaccgcgaacgccgcctgcctgctcgacggaatgcctgagtggagtgaggcacgctggcgcgtaagtcccctcgctgaaaatctcgctccgttgtattacctttatttgtttttcaagcaattacattcggactatgagtagcttcgctgcattgcatgagttgggggaaaggttcccccacttcagcttgagctcatacttacagtactctacataaattgtgtttcttttctttacttggggatcatcctgaacctaagagctagccaacatcaacggtaggccccttagttggtgtatatttctgtgggttttgtgcgttctttgtcatttgggatcgtgtggagtgcggcccctttctacccaagtgtgttgttgtagtgcgcttggttggcttcatgctgttctcctcgcttttcaaattgtagtgtgccgcactgctaaaagccctttgatctccgtgaatactcctttatgagcctagagaattcagagttctcgttctccagtaatttcaatggtgtgtcgtactctatgattcttcctgctcgtcagataagagcgcacaatttagtggcatgtaaaaaactggcatgtgtttgtcaagggtgtggcttaccttcactgaagacaagaatgagatcactgtcaataactgtgtgaattctatgtgctattgtcagcacggtgcaatccctgaattcatcgcggattgtttcttggataattggggtaccgagatcgatnntcaatnnnnaancgccat

SEQ ID NO: 89853 - DNA, 1023 bp, Oryza sativa
tctgtcataaatgccgaaagttctagcagagtgacattcactgagaacagtaaaccagcagatactgatgatgagtttgaagcagaaaatgaaacagatgatcaaattcagggtataacaaagcaagagtctgcacatgatgtatcacaggacatcaatgagaaagggaggttaacacaagatgaagagcgagaaaagggaggtattggcaagaaggtttactgggcatacctgagggcagtttatggaggtgccttagtgccagtcacaatcgcagcacagtccttcttccaaatatttcaggtagcaagcaactattggatggcatgggcatctccttcaacatcagcaaccaggccaactgtcggattagggctcatgtttgccgtatacatagcattgtcaattggaagtgccttgtgtgtctttgctcggtccatgcttgtttcactaattgggctactaacatcagaaaagttcttcaagaacatgctccactgcatcatgcgagccccaatgtccttctttgactccacgcctactggaagaattctgaacagggttaagactgacttagtttgtaaaccattttatactgcatcacgtactctctccacccctaaactaataggtgtgtatttatgctttaacaggcctccaatgaccaaagtgttctagatctggaaatagcaaacaagcttggttggtgcgtattttcagtcatacaaattctggggaccattggtgttatgtcccaggttgcctggccagtttttgccatcttcgttccagtaacggtggtctgtttcatgtgtcaggtatgaactcccaacaagaaaaaaaaactttattactagccttttgtactaccatagcaccatgtgcaaaagtcactctgtgcaccacgatgagttccaagaagctataggtacaccttttctccataaattatagcgttcattcacaaaatactgaaaccatatactctgtgtaatgtgcagcgatactacataccaacagcaa

SEQ ID NO: 89854 - DNA, 969 bp, Oryza sativa
  unsure (1)..(969): unsure at all n locations
attgatatccgtctcggtacccctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgctgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacagctggcctattatgccgccgctgttgggcgtctacgacttcaccgccggcctgcctccgtcgccgccgagtggtgcctccgcctacacggctggcctattatgccgccgctgttgggcgtctacaacttcaccaccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgacttcaccaccggcctgcctccgtcgccgccgactggtgtcctcgcctatacggtcggttgatcccaccaccgttaatgggaatagtcatgtacacccccggcctgcctctgatcaccgcggatgggtgcgagcacgataatgatttcaaannaacccacc

SEQ ID NO: 89855 - DNA, 1093 bp, Oryza sativa
tttatcttaaaattcgaagctcccaccttaaatttgaaaatgttcatgttaataagacagctacagctttggaaaaaaaaaaaaaaagccgccccgatgacagcggtaggtattcatgttaatcacgccagagagggcgttaaccccacactaactgtatattgtgccacgcagaagcggatttaaaaatcaagcaggtctggtgccccaaaaaggaccatttctagaataagtttttttaggggtctatttgcgaaataagttttttaaaaggaccaaaatatgaaaaatccagggccctgtgccgcgcccctggccaccgcgtgcttggccaccaccgcgtccgcgcagcgctcccctgccgctgccgccgttgaagttgttgtgggcgccgtttttgttgccgcgcccgccgccgcgattagcgacgaaagcagcccctccctgaccggtgttgcggtagagatcaaggagagtttcaaagttgaggagttgagagtacagctccccaaccgtgatgggatcggacttggtgcagagagcagagacgatcgggctgaagtcttcatctaaccctgagatgatgtactgcaccatatcctcttcatcaagaggacgaccggcggcagccatctcatcaccaagagctcgcatcttggcaacgtattcagcgaccttcattgttcccttcttcgtgttggtgagggcgagcctggtattcaccgatcttgcacgggtgcggctggagtagagttcctcgatggctcaccaagcttcagccgccgtcttgcacatggcgacttgaatcagaacatccctcgaaagagatgacaggagatagccaagaacaagttgatcattggcttcctaatcttcgaatgccgggttcggctttgtcacagtcttcccatcgacggtgactgaaatctcggcgtctagagctttcacagcgccggtgaggtagccctggagacgggctccgcgcactgcagcgctaacttgcgctttccacagtgcatgattgcctttccgagtttctctgtaacggaatggccctgagcgaggtttacagctgccgcgcctgaggaagaca

SEQ ID NO: 89856 - DNA, 1456 bp, Oryza sativa
  unsure (1)..(1456): unsure at all n locations
agccggcgggcgagccatgatggcggcggcggggcctccttcatggcggtgacccctctcagcgcgggagaggcggcgaccgatcccggcgaggagacggcggatccagcgtcaccttcgccggatttggccatcccctggccagatccggccggagtgggtgctggtggcggaggagaccgcggagcggcgacaccggcgcgacgaggcggcggcgacggcgacggttacggcgcggcgacgcgacgacgacgacttgcacggcagccagcggcggccgccgcgacggtgagatgcgcgcgggcggcggtgctcgcaccgccgggggcgagcgacgcctgcagcgccgccagccctggtggcagcagcccgagcgactgcggcgcgaggctcgcggacggcggtgactggcagcgcggctggtgatgggcaacggtggcggtgccagtggcagccgcggctgcggcctgaggcagcagcggcaacgcctgtcggtgcagaggcagaggcctcagagctcgtcgcatcggcggcgtcagcggctgctgtggcacggtggtgcgttcggcagcagcggctgcggtggcggtgaccacggtcgcaggaggcatgacggcctcggacgactagctgaggacatggcagacggctacatcggaccggcgtggcatcgtttggaagaagggtcggagaccggcttggcatagagtggcgcagccgatgacagcggaggccggctcggcgcgagaggcgcggccgatgaagggaggccagattggcgcaagaggcgcgtcccgtggagaagactggcttggcgcaaaaggcgcggccggcggtgaagaagccaacctcggtgcgagaagaagctaccggtgaatgtggcgcggtctccggcgcatgaagactggccggcgggggacaccggtgcaggggtcccgcatgtcggcatagctgaagaggtggtggagcatcggtgcgtcagccaaggattcgcaggtggtgatcggcaggtgaaaatctagtccggccttggccgggcggacaacgatggttcattccccctcctgagggcgttgtcgtgatgtctcacccttcaagggcggttgccggacgaaagcctagtctcggcttctttgaaccccgacggacggcggcggcggttttttccgtcgcttctcttcttgaagacgtcgtttttggcatcccttagagggcgatcttgtctgtgttcctttgttagtcaagcagcggtcggtcacgcttagcggtggccggtccggtgctagccttctcccgggttgtgtgttggcgccgtcggtgtgcgggtggtggtatatttttttcctttttcctggttacaaccctatagagttgtaatcttgtaattttttcatgatgtggggatccttaaagtaaacctgcaggcatggacgaatacgatntgcaatcaagacat

SEQ ID NO: 89857 - DNA, 578 bp, Oryza sativa
  unsure (1)..(578): unsure at all n locations
tgcgtgntnnnatttgaaatcggatgcggtaccccattctccacttcttcgagcgccagtcccaggcctcctcccagaacgccaagcgccagaaggccgacggcccctcgcagcctcccgcgccgtcgccgcctccgccgccaccgccgctcatcgaggaggagccatcggaggtgtcgccggaggtcaccaagactctggcgccgaagcgggtcaggttttctcctgggatggtaagtattggtcttgcgcttggtccgatttggaatgcattagttggcgtttggatcgactcttaggttcgggggtttcttgtttggtgcggtccagctgattaagcagagccaggacgatgggggtggggaggttgtgacttggaagatctcgccggtgaatgatcgcctgcgcatggtcacttcaaggcagatgactggtatggcgcttcatccgtgctcaaacaatgaggtatatactggagtttctttatgttcttgcgaggtatataccggcgtgcaatgcacgtatgtatgtgcattggagccggtggagacacaacactttcttgagtgatgaaatta

SEQ ID NO: 89858 - DNA, 1188 bp, Oryza sativa
tctttcttcaccctgcagcaatttcccttcttcagtgttatctctaaatacttcttgtctgcaatttatcatatttgtgttttgccatttgctgctgatttccttttctgcatcggactcattgatgcttggtaccttttctgattctgcatgatgctttgacaaatatatgcttgtgccttttgcgttacaaacttgttcgacggcacaaaagtgagccccaaagataactccaaaagccatgttctgttggagttcttgaaatttccctgcttgtgctatccttccattttgcatcacctgcaatattgcttcaaccagtcaagttaaacatactagtttcttttctgggatccttatgagttattgagaggtagtagtatctcctagtgtggatcatgagaactgataggtgtagctactgaaagttatacaaaactaacactaggagatacctctacacctcaagcctgcaaagggctgtaaattctctaaaaggattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtagggtaccgagctccaaatcgccctataatgagtcggattacaatttactggccggcggtttacaacgcgtgaacttgaaaaacctgggttaccacaattattggcttgaaaaccatccccttttgccaatttggtaataacaaaaggcccgaaccgaccgccttcccaaccattgccaacttgatggcgatggacccccccttaatcgggcatttaaacccgcggtgtggtggtaaccccaagtgacacgttaccttgcaggcccttacgcccggtcttttgtttttttccctcttttttgccacagtgcgggtttccccgtaagatttaaatgggggttcctttaggttccaataaggcttacggcccccgacccaaaaaaactgttgggggatgggcccgagggcgctctccctttacacgttttctcccttgacctgggaccactttttaataggctcttgtccaacgggaaaccctaacctatttgttttt

SEQ ID NO: 89859 - DNA, 1256 bp, Oryza sativa
  unsure (1)..(1256): unsure at all n locations
catgtggcttgaattagactaatctcgtatgcctgcaggtcgactctagaagatncccttctgaaaattccctgcttgggctatcctttcattttgcatcacctgcaatattgcttcaaccagtcaagttaaacatactaatttgttttgtgggatccttatgagttattgagaggtagtaatatctcctagggggatcatgaaaactgataggggtagctactgaaaggtatacaaaactacactaggagataccttacacctaagcctgcaagggctgtaaaattctctaaaagattcccatatgcacagcatgtttttagcagtcatcattatttatcctaatgttcagtacaatcatgtctttagtttttttttcaggggcttaccataataaggtctgcatcaactagaaattcaacttggtgcgtgacgtataacacagttttatcccttaggacccccatcaggcatttctgcaaaaaatgtatagagccaatgttaatggttatgtaacagggcttctccttgccagtaaaaatatagatatgagcaatttattttagcgagagaaataaatatcaataataatatggacaagattattgaataatcacaagatctcaaatatacgatgcccattgtttgtcctagagaacatgatgacttcttttaactatggaaaatttgaaaccatcaaagcattatatttttgtgaccctggggttaatttcttttgttggctcttaaggggaaaaggaccttgtatagatgccttccagtttgagggtctacagcactgaaaggatcatcaaacaggtagacatcagcatccttgtaaactgctcttgctatttgaatccgttgcttttgtcccccactcatagtcgttccccgttctcctatatctgtcatatcaccatccgagaaaacttcgatgtctttaaccaaggcacatgcttcaattgtccgctcatacctatcagtttcaaagggcgtccacaaaagaagtttctcttatagtcccgaaaggttcctttaccatgggaactatatgcttgtttcaaaaagactaaacggtcttggacctttgggattnttcacaacaacagagacagggtttaattttcattccaaaaaatcaaaaaagggcctttataaaccttgggggcttcacccgtataattgagagtggtattttgaaattttcaacagaagagcctggaaaatctgggaaaaaatatttccctttgtgt

SEQ ID NO: 89860 - DNA, 1503 bp, Oryza sativa
  unsure (1)..(1503): unsure at all n locations
gagccccccntttganatcatttganatctcgtagctcggtacccagcagagaaatgatgcaggcttacccaaagcatctagctgtttttttttcccggatcctgggggtcgccctctgcgcttcccgtcagggttcgagttcgatcctgcaccacctgaaggtccgccggcctccgtccctgctgcagccgcgggcttcagtcccaacccgatgttcccgtcaggaccatacttcctcggcctccccctcttcttcttcacgagctcccctccgccgaccgccgtgccgccaccgccggaaccgggctgctgctgcatgccctgcacgacgggatcggtgcggtacatggtccccgacatatccgcgggcttcataggcgacgaggcggtcggcgacgccatggggttgaacgagagcggcaccccgtgcataacattcgccgaccccggcggcatcgccggcgcggcgccgtaggggtgctgaggcatcatcacgccgccgccggccggcggcggcgagctcacgcgcggctgctgctgctgctcccggccatccatcccggcagcgaaaccctagggcacccacccccacctgaatcgaagccgccgccgccgccgcagcagccgctcctcgcgacctctcctcacctgcgcgtttcgccgaacagttcacatgcaccgttcggcgcggcggttgtacgtgagctctatgcaccggaaaacaaatctcgaaatcgaataaaatacatcggaaatggaggaggaggaggaggggacagaatttctgcggatgcggagaaaaaaattgggaggagaaatggagaaaacagggggggaggtggcgaggcgagaggggttacctcactgtgaggggtcagatcagatcagatctgagtgacgagaaaacgcgagatatcgagtaaaataactcgctgcctcctggctcgccgcggcgtcaggacgagaataggaaacttactactgtactgtatttgaacctttttcgtgatgaaaattgttgttttttctacaaatctatctattttcgtttagattattttttttaagtcaagagagaactttattaatgactaaatagagggttacattcttgatttaacaagtctaggattatgcgggggcggcgcacagcctctactccccacacgacctagtactcattgccatttgtgctaacacatgagcaaccctattagcttctctcttaatcttgtgcacttgcacccgttggatacattgtatcacacctttgatttctgcaaccgtcgtcgcccaggaggatcttgaagctacctgctgtgttagagccttaacaacatcagcattgtctagctccagaataatcggcatatgaatccacttcattgcttctttgagcccttctaaacatgctagcacttctgcttcagccgctgaggtacactgatgcaaagttttatatgcagccaggagtactagcccctgcaatctctgatgataat

SEQ ID NO: 89861 - DNA, 1185 bp, Oryza sativa
  unsure (1)..(1185): unsure at all n locations
caaaattttgcgttaaaatagccgggttcccaagccggagcccccctggccaagggtgtggggcagtggaaacccaattttcaaattaaaggcaggggtcattttccctttcttttagccgtccaacgtccaaaagggcgggtgaatggaggccaattacccggtggggcctaattttcgactacctttccaggtgggcccttaatttgggacaatcatccgtggggtaaattgagttttgtgactgatatgcccaaatttcacttcccgcggaacatttggaccgttcaaaattggaanatccttcgcaaaaaagaaaaaaaaaagaggtgcaccattgaaacgttcttggttggtccaaattgacaacccaaaccttctcggtcccgaaaataaaaattttaaacccatgggcccatggtttaagaaaattccttatccattttaaaataataaatttgggttaaaacccaacccgttttaggtattaatatttaaggccgagggagtataacgcaaattgccaacggaggtggccatggccgtgcaagttgtttggccttcttgtgacccacccaagatcagccccattcaataattggccgttggtaagcccccaccaacagggccagtaaattgtttggcccctagctgcaccttaccatgggttgaataaaggaaaaagtacaccgaaggtcctcaaccttgccaccggaatcaaaacccgtcctcgacccgcaaaaccagatatataggatcccttacctatataaaactggtcacaataggtcccttggcggtttcgatccgggttttatcctacgtgtctaatgagtcagcgtgggacccacgtgcgccccacatgtcagcttgtccagtcagcctctatttctttcctctcttctctcccttccccttctgtctctcgctcttctctctggtgactctgggtagcccggcgccgccggccgacaggtggggaggagatcgacggtgcgaggtgggagaggaggtccggcggccggcgacgtggcggcggagacgacgcgggagcaggggagcaaggcggcagcggcggcgagatgtccacggtgaggcactggaggcggagctccgtcggggcggggagcgggtccacggcggcggacggcaggcacgggattgcgtcgcggccccacgctggcg

SEQ ID NO: 89862 - DNA, 1180 bp, Oryza sativa
  unsure (1)..(1180): unsure at all n locations
taattttcatttaggcatttattgttctttttcaaacttatattgttttctggtgaactcatcctgatgataaaatttattttatttctgctaaataaaattatatttgcattataaactttcttgtctagattcacagctcatagcaccattgcacttacctccaagcatcttatattgatatttccatcaagtggccagttgtttggggggcggcgataatcaactactagaggagcctcactagggatccttgagtactgcaaaattctttcaactgatatcattttgttctctgtgttgcagatgttccaaataatagatgccaactgtgagttgaggttcaatgcataggtcaccgcaagtccagcaatgcctgcatgtacaatatataagtttgaaaacagccaacatagagtgacttaatgcttccataatcaccaagagcctaagttcttcttagagcttacttggatttataaaaccttcaggaaggctcactagcagggtcaaagagaaagcaaagaccaagttggataacatgtttagccttgaagaaagccattccattgaagaaatgttatggaaccatggcccggagtgattgtcgacaagtcccaagtttgatttcttgaacgaccttttggccatatgctcctatacctgatgcctcctgaaaccaatcttgccaaatggtggaagatgggagccccttggnattgtgattaaacgagcccaattctctgctggtgggatgtaaaatcgctgcacattacaccnaatatattgcttcaagattttgggaatgacgctattatttattgagaaaaagtgtccctatagctcttgggactcatctggggcccanaaggacttttggcatgtggctttggagtcacaaagcttttaataaagtttttttcttgtgtggagttatacccgcacatgaaacaaacaacgtactgtgaacaaaatggaaaattggccggcaaccggggcataacaccatggtccccaaattttgtgaccttaaaccccccacccaactgttgggttttccaaatataaacaccttggctttgggccctgaaaacaaaaccacaccctttttttggggtggaagaaccggtgcctttaaagttcaaactcagacggtttaactcttaaaaattttcaaggg

SEQ ID NO: 89863 - DNA, 606 bp, Oryza sativa
  unsure (1)..(606): unsure at all n locations
tggggggntgnntttgttatcggtattcgttctcggtacccnnnnnnnnnnnnnnnnnnnnnnnnnnnnnnnnnnnnnnnnnnnnnnnnnnnnnnnnnnnnaacttctactcgttgacggtatcgaatgaactgatgcccatccgagggagacgattgccagtgcagtactgatttgtttcggttagctgcaataactcttttcagtgaaagcttgacaagaaactgcataagttctgaatccttatattagattatgacaacaatttgtctttgggttctcgttggttttgcttgtgcgtcttccacaaggttttgttaatccaagtaagttttgacttgttcggacccatgaatttaattgaacgtaaactcatgctgttctaccgtcattcaaacttgaaggataaatatcttttttctggtataagggttgatgttctcttgctgcaaaacaggcattggtgggctggtagtgatgtatgcatggaatttgaatacacaattatcagaagccacccggaatataagtcgtgcagaagcaaacatgatatcagttgaaagaatattacagtacacaaagcttccaagtgaagccccaaccata

SEQ ID NO: 89864 - DNA, 1211 bp, Oryza sativa
  unsure (1)..(1211): unsure at all n locations
ctttgtctttttccttttggggaagaaggaaactctccccctctctctaagaaaaaaaagcggttggttgttatcaccaaaaaaaacctaatttttttccccgcccagttgnggcaaccccaccttaaaacaatttttttggtgtttttccaccaaaaggacgcccccaaattcggccccctcccctccccccnnngtttcttcttctgtgagcaaaatatattttcttcccccagaaccggcgttttttttttggtgcaaccaaaaggaatatttgatcccttcaaaaaagtacccccaataatagtattatgcgggtgatgagcccaaaacttccttggtttcacctacatagaaaaaaatgacaaactttttcttttttgataaacaatggttgccctaatagcccacatcttatatagcacaaaaattgggtaagcgtgaatatacggcaccactatgaagtgaaaatgggccaaattgcggaccctatcccccaggtaaataataaaggcctcaaaagcgggcataccactaaaagtatttttagggtagatcaacagtagttttcattctgaagtaattaactacccatgtcaggtagtagacaagtgtcagcttgcaaatgtggtgcgctcgactgagaaaaacttggatgaaataggtaccgctcagcataaccttttgaggaagacaaaaaaactgccatgagtcctttaggaaaagaacatgttaatatgtagtttttctgaaatacttatgctactatgaatttatatttcattcgcagtaattgaaaatggggacaactggagcatgggacagcgacaactattttgtttaggcagaattctcctgaggaagagcaagatactagtccttgatgaggcaactgcttcagttgactctgctacagaccggattattcaagagataattcgtcaagaattcaaagattgcacagtgcttgcaattgcccataggatgaacactgttattgatagtgaccttattcttgttcttggtgaaggtaggtataccactacaatactaaaacaacctcagaatatcatgttgcacagctacgtcactctttaaatctgatatctctatgcaggtagtattttagaatacgacacccccaccaaactgctccagagagaggactctacattctctaagctaaccaaagagtactcacaacaatcgca

SEQ ID NO: 89865 - DNA, 2141 bp, Oryza sativa
  unsure (1)..(2141): unsure at all n locations
agtggctttgaaataacttattctcgtattcctgcaggncgactctagaggtattcccgatgctctaggacagttaggacagcagtttgttgagatgctctaggacagnttgntgggttgctctgctctaagacagtttgttgggatgcgttgctctaagacagtttgttgggatgctctacgacagcaccctcttagacttgcatggctgcatggctgctacaagcagctataaatatgtatccaatcctctttgggaggacatggcttttgtgtttagtaaatgaagaaaaccagaaaattgctccatctcgagtgccatcctcttctcaatgagagtaaccattgaaattctaacagcatcagcgacaggttccacatgagaaaggctctccactctctgttagcccaagctttgctcctcaaacaacggccctctctaatgatcaaacctgtaacatatggtgatcgttaatactgcagaaaagaaaagcaattgtggctacagaatgaatcaactatatgaagagcttctcaccatgtgatgtctggtctgcctttcttcatttctcttccatgttcacagtcacacttggttgagaggtgtaccattatcccatggtcaggtagcgcagtgcctagacgcgccaaaccaattgcggtctgatttgcctcctcttcgacccgccaagctatgtactccctttgagcccatccaggagggatcacaaactcagaagatgaagaacatccgtcctcatcctgaccattttcattgttacagacttcagatagctcagaagacgaagcatcttgtaaagaaccatttccattgttactgacttcagatagctcagcaggcgaagcatcctgtaaagaaccatttccattgtaacagacttcagatagctcagcgggtgaagcatcttgtagagagtcactgttctcatatttaccactctcgcagttactgtcattcggtggttcactaggtgatgcatcctgcaaagaaccgtcatactcatctttatcattctcactgctacagtcattgagtggcttaacaggtgatgcgtcttgtgaagaactatcactctcattgttagtctctttggatgacccagcaagcacaccagccccctcacacggcatcaaatccatgtaccagtagctatgtaagaatgaatcatgagctcttgcaggtgggcaagagattttgttgcaccaacgtatcaccgtgagatcgtccccctcaacgatcagctttttaactggttcatgatgctcaagcatgatttctagcccatgttcaagtgcttgaatactagccacagtctgatccacgttacctaaggaaccgatgaagtaggagagtgcaccttcatcattgtggaatacaccacccatgccagcagaacgatttttggagcagccagtgccatggaagttgagcttgatccaacccttgggtggaggggaccaagtattccgatggattgctgggattcggtgctggaactcctgtccccagaattgaggttcatcatccttgcagtcgccttgatcttgtttaaatggacgcaacattctttctttcaggtgcatatggaaataagacacgactgaaaacacaaacacaagaacattacataattagtcttattgacctaaattttgattcagcatgtacaaacactaatcaaatgaagaatgttaagtagcaagatattgcccttaagtctcaagaggtcttactcaaaagcaaagaaggaattatattccagttccaattcaaagttaaggaaaaacttttccttaagagacaaccctgcaaagttagctccaccatcaaacaagagtaccgaaaaaaaaaatgagttcagaagaaaaacacacatacttggcacatttgagttcatgtccacatcagcggcaacatcaagaaactcaaccctcagttcagagactccccagaattcctcatcaaagttttccaaaacaattacttcatcaatataattaatacttgcccaaagaaacctgtctctttccaaagctaaggaacccttgataccagtaaatccacagctcctgttttcaagtgcagcagaaatacttttcccactattcttgaacccata

SEQ ID NO: 89866 - DNA, 3540 bp, Oryza sativa
  unsure (1)..(3540): unsure at all n locations
agagcgtttatattgacccattcgcgttggtccagcagccncgactcttttangttgtctccatcacagacggcagaatgcanctacctaagcctcaaggtcaaaactagtgattttatgtattttcttacatgtgctactatatttatgtgttggggttctacaatagatgctgacttatcagaatatgactatcatttttttccacaattgcaatgtggctttttttgacgcaattcacaatcgggctgttggcaacttttttgacaagttgacaagcacgatcacagcagcttaaaccttgcggtgatcctagagtcgtcaaccacctcgatctagcaaaaggctaaacctaaatgggttttgataactaaaccgtctagcggagccgatttctagataactacccgtctcgtgggcaaaacggaagattttcaggacaaacctacaaagagatgtcgcactctcgcaacggcgacggacggtttacagcgcaaaccagtaaagatggacaaactaagagaaaaactaaaagcaatatgaaaacacgattcgattgattgatagtagattatttttttacaatgaaccggccatgtcccttatataggggttggtcttgccctctacaggccctcctccatgtccaactcggggtagaaaccaaaggaaacccgaaacatgtcttcccgagcaaggaaaccccaagacccgacgaaacacaatcggactcggtcctgccggtcagaccggccgcataccgccggtctgaccagccctcaaccggcggtctgaccgcctaacacacggcggtcagaccggcccactcggaggaaaccggtagacttccaaattttggcaatctttcctactttaatcctaggtgccaaatttgggtgtaaacacatgcccccctgcctttttgatgaacaacgtgaatctaaaagcatagaacatgtttttggtcttaggacgataatccaattaccggccatagtacctcctaagcgtcttgccaaacgctcaggaattatttcttcaagtatttcccgttgattgctcgctgaaaacactccccttgaagagtctccaaaaaatatgcgtttcctcgaacaatgccgcatactcgataaggaccctcccaactaggagaccacttaccgaactccttggatcgagtacccaaaggcaaaattgtcttccaatccaaatctccaacttgaaacaactttgcttttacccttttgttgtacgccttggccaccttcttcttctctttctctatttcttccaatgccttcaagcgcttgtcgatgacttcatcaagattgtctcccatcaacgccttgtaatcctcacttgacaaatcatcttgcttgatataacgaagagaaccaagatttacctccaccggtaaaacgacttcttgaccataaaccaactcaaaaggagtgactttagtagcaccatgtttagatatcctatgcgcccacaatgcttcagaaagcacctcatgccacctctttgggtattcctcaatcttctttttcactaacttcaaaaacgttttattactcgactcggcttgtccattagcctgagcgtagtaaggagaagaactcaacaatttaacaccataagattcggcaaaactcttcacttccttagacataaaagaagcaccttgatccgtagttaatgtttgtggaataccgaatctatgaataatatgcttcaaaataaagtcaattacctccatatgagtcatattcttcaacggcacggcttcggcccacttggtgaagtaatccgtagcaactagcacgaacctatgcccctttgatgacgaaggataaatttgaccaatgaaatctaaagcccaccctcggaacggccatggtttgattatagggttcaacacggcggcgggcgccaattgaacattgccgaaccgttgacaagcctcgcatcctctataatatttgaagcaatcatcaatcatcttcggccaatagaaccccgctctcctaagcaaccaattcatcttgtgggccgattgatgagttctacaaatttcttcatgtacctctcccatagccactctagattaatcttcatctaagcactttaacaagacatcatctatatttcggcgatacaaatctccatcaagcaatgtatatttgaacgcttgccgccgaattttccgaacaaccttaagtgtaggatctttcaaatatcgaatcaaaggaattctccaatcctcttctgtttcctgggcacaaatgtctgaattcacaattaattcggcctccaaattgatcgaaacgtgccccccagcgctctgcccagaaccggttgttgccggtcagaccgctcggggtcgccggtcagaccggcggcatgcggccggtcggaccgcccctggtcactggtcagaccggccgtgcaatgccagtcagaccgcccctggtctccagttttgccaatttcacataaagatttaaaaccaagcaccggctcttctaatattagaaataatcccttcttcatattatagccagatgcttgttgtgccaagtcatttgctctagaattatcatgcctagtaatatgtctgatagcaaaattatcaaaattggcaataatatctaaacatgaatcgaagtacctatttagtgatccgtccaagcatttgtagactccgacgacttgttgcaccaccaattccgaatcaccaaaagcctccacgtatttagctccaaccatctccataacttgtaagccgaataataaagcattgtattcggcttgattatttgtacaataatactccaaacgaaccgatgcctcataacacatgccattaggtgaaaataaaactacccctatgccttgaccttctttccaagaagaaccatcaaaataaattctccaaggtataacttcaactaagcaaacctccccctcataagcaatatctatatgatggtctactataaaatcacatacaatttggcctttcatagatttcaatggttcataagtcaaataatattctatcagagcatatgcccacttgccaattctcccacttagaattggcctttgcaacatgtgtttaataacatcggcttgacaagtaactatgcatgtactagataacaaataatgcctcaatttggtacaagcatagtataagcatagacaaagtctctctataaagacatacctcgtttcggcatccaaaagacggcggctcaaatatgtaatgatatattccttgccatcttcctgttgcgtcaaaacggcaccaatgactttgtcttcggaggcaatatataaccgaaacggctttccggctttaggcgctcacacaacgagtggagtagacaaatantctcttcaactcttcanaatgccnccttccttttttgggttttttgggggttttttttttttttgggggcccccccccccccagtaaaatcggcttttttttcaaacaaagtataggaacaaaagcatcgattttacccg

SEQ ID NO: 89867 - DNA, 2234 bp, Oryza sativa
  unsure (1)..(2234): unsure at all n locations
gtgggtcaataaanattgagtatcgctctcggtaccctgatgaaatatttttcaacaagtaatgaatatctgaaataatttttgttaaaatagttttttaataagtaatgaaacatctaaacatttcctgggtagtgaggaaatatttctcaacaagtgatgaatatctgagataatttttgttaaaatatttgtaacaagtaatgaaacatctgaaacatttatttacacatgacgaaacaccattcgatatttggcaaatatcagacattcgagccgtagcgctccctatagcgtattggttaactatacaacatgcctatgatttgacccccttcccatccactactgccacccatgcggctacaccctcactatggtaccacatgtagttattttgttataggtcatgacattctacgttaaggagctagggatgacactatagcaatgggtgacatgctcaagtcggtgatgagatgcaaacgagcggagtggtcaggatggagtgttccagatctacgatgccatcatcaccttcttgaggtcaccgacttgagatatggtggagtgcggctacccaatcgggtctttttgtccaaacttcaggaggacattggcccccatacttcattttccgcagcataaaaaatgctagttgtatagttgcttcatttttcggtgcatgtatttcatatatgttcagtggatattctcaacctatggatttttccttgattgtgtgggtgttcttgatctacgtggatgttgattctgatgtgttaggttgtcggtgttcttgactatctcattggagggtgacggtgggggtagggggtttgaaagcaatcagcttgaatcgagctgattcattgagcggcatccccttttgttctggctagtgtaaagctatgagtgtcggttcccagtccatcattgctgctggacttagtgccgctaatttggtaccggcgcagcatcatattcggcattgatggtccgtcacaaaccaagacctatgattatttctatagcagtgcttagagctagcagttggctatattggttaaacttgctagaaggccctactaaggggactgagttttctccagtaattttagtgggaatggcatatgctagcttcgatatattctaagttacatactagtacatatacgtaacaacagtaactttgcccctgcaacttactgtgcaaggatggttgttggactgctcacataactactaattgttcaacgcacccttgcattgttgtttcggagataaatactaagcacccttcacctttttctccattcttcatcgaggctacaaccaaagccacctagttgctagttccatgaactctggataacacaaaaaaaaacgtgaaatataaaatcaatggtcggaatctgagaggctacgaccttttgtgacgaatttcttatgacattagagctattcgtcactatgccatttcggtttatgatgttcaataggggtggtgctgattactgatgaaaataaggtgcttgtcactagaccaaatacagatagtcataaactagtccaacgatgtattgtgacgaatatttttttttgtcgtaagagaccaaccagcaaacatcataagttcctaacaatgctggttgattgtgcaagctaccaactccacctacatgctctcttagcctatcctttctataatagccattccaaccaacgttaacaaatgctttgtatccttcctcctttttattccggtccctaaacaagaagcaaaagaaataatatgctctatctttttattccggtccctaaacaagaagcaaaagaaataatatgctctatctttggacttgttgtactcaagccatccaccaaactcatcaaaccatgccggattgaattttctatctttgttagaaataactgatatgggaaaagcatgatcaccaggttggcaaggcccattctctgagtactttcttctcaccttggctctttggttgggatgataatcatcaattcctttccttgagcctggatcatattcgatcgtcttttcccaactggcatcatctagtcgaagggatatgaactccccacattgcttgtacaatctggtgctttccgcttaagaaatttctccatagaaacctattagagacaataaaaattttcaagcttgggtnccgngcacgatatcaaaggcattcaaggggagcgcg

SEQ ID NO: 89868 - DNA, 1473 bp, Oryza sativa
ggtgcattgatagacatcctggtaccccaacctggtaacgacatcgatgtgtacctaagaccactgatcgaagatcttaagttgttgtggaagaaggaaggtgtccccatgtgggacgaggacaaacaggaggagtttaacatacgagcgctgctgttcataaccatcaacgattggactgcacttagcaacctatccggacaatccaacaagggatacaaggcttgcactcactgtatggatgaaacagaaagtacgtatcttaagcattgtaggaaggttgtatacatgggtcatcgtcgattccttgcagcaaaccacccggtatggaagaaagacaagcacttcgaacataaggctgaccaccgtacgaagcctaaacatcgcaacgggaaaacagtgtttgctatggttaaagatcttaaagtagtgttcagaaaggggcctggaagccagcctatagagagcgaagatggtcacgcggcgatgtggaaaaagaactctatattttgtgagttaccctattgggaattcttggacgtacgccacgcaatcgacgtgatgcacctcactaagaacctttgcgtaaacctttttggctttctaggtgtatacggaaagtcgaaagatacactggaagcacgtagtgatctgaagcatatggaacaacgcggcgaccttcacccagaaccaaaggagaaaggaagccattacttgagtccagccagctacacacttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttgtaaccgtgctcgtccagaggcaagcatcgccaagggttatggaacagaggaggtcattgaattttgcgtagaatttatcgaagatcttcgcccaatcggggtacctgaatcacgccatgaagggagactacggggaaagagaactctcggaaggaaagcaataatgacggtagacaacaatttattccgtaaggcccatttcacggttctgcaacactcttcattggtagctccttacatcgaggagcacttggctctagttcgcgccaggaacatcggtaagt

SEQ ID NO: 89869 - DNA, 1365 bp, Oryza sativa
  unsure (1)..(1365): unsure at all n locations
gtggctcccttgattgcnatcggttctcggtacccgaactaactaaacttgtattatttttttcgcaattaattaattaatgcatagatggtggacagggcatggatggataaagagagatatcgtgcgtcatacattgaaggagtcgacatattcatgaaagcagctaataagaatgttgcatctaagaagaccaaagatattagatgtccatgcgtgcactgtaaaaatcagaaaagttggaacgatccatctgaaatcgagcaacacttggtgacgcttggatttgttgagggatacacaaactggtcacatcatggagagatcccaagcaagcaagttccgaaccaggctacagtacacgacgaagtgttgagctgggacgaggatgtcattgtagtagctgaagaagaagaagaagaagtgcatgcagtaaaacccgttgatgatgatgatgttggtggcaatggttagcatagtatagatgatgatgctgatgatggtaatgtcagtgtagatgatggtaaatttgcagatttggaagagatgttgcgtcatgctgaacctaaggttgttgctgggtccgctcatgggttggacaactttgatgcattgaaaaagacagcgaatgatcttttgtacaatgaggcaaagggctgtgagaaggatttcacattgttgcggatggtgcttgagcttatgagattgaaggacagaaatggttggtccgacagtagttttaatgacttgttgcttctgttgaagaaactttttccgcaacccaactccctgccaacaagcacctatgaagcgaagaagcttatatgccctttgtcactgggtgtgcgaaagatacacgcgtgtgttaaccactatatcctattccgtaaagagtacgaggatttggacagatgtccaacatgcaagagtagtcgatacaaaacaagccgtagccagtccgagggtctagattttgcccttgacgatgaagaagagtccgatccatgcaaagacagtaacaaaaagaagatttcccagcttgtcatgtggtaccttccggtgaaagatcgtttgaagcgtttgttctcaaacccgagggatgccgaatagatgcgctggcatcatgaaaagcgaaaaaaggatgggatgatcgacatcctgcagatgtaagacagtgaaaggaatttgacagaaattatataagttttcggaggacccaagaaaagtaaggttcgcattttccacttattgaatgaatccatccgtgacttggcaactaacacatcacggggcagaacttcttactatttcaacctcccaacgtggttgtttcaaaaagaaagattttctgttaccattcttgtt

SEQ ID NO: 89870 - DNA, 3311 bp, Oryza sativa
gcaataaatttttttgtctttcttcacttcaaagcccaagggcgaaaatatccccttcttcgggcgggtgaaaccaggaatgcgtagttgattctttttctactgactcttgttgttaaaaccggactcagtgtgtatgaaaatccaacatttttttctctaagtgaagaaatgtttttttaagggctcatatcacaaaaattgaacttgattaatggttattattattttttcccgttgcaacgtgtaggatcgaatcacaagaactaagctaaccagaggggggtgaatggttggtataccaaaaaccgaaaacttttagcggaaataaaagttaccctcgaaatcgacggaagtcgggctgaccgagattaatctaccggtctgaccgagtagatgccgccggtctgaccacccgtatgccgcaggtctgactgccgcgtgccgccggtttgaccgacgatagattgccggttagactgccgaaacctggtaaacacaaattgaagaactcttaaagtggatgacgactttattgattctctctgtgtttacaaagtacaccaacaacactccttacaaaaatttcgactaaactcgaaaccctaactcaaaactcaactcaattgctctccaaagcgatacagggaagcctcacgctccccctctatttatacatgaggtagcaagcctaaagcccggaaccaaactcatactaggagtcataaacaccttaggaaacccactagtacaagaaagaaactttacataaccaatcataccaaatttggactccttccaaattcgactccgcatcccatatgcacacaatacctctatcgtatgccatatggaatctccatcaaccacgtgcatcaactctagccttagtataccgcatgatctctgaccaccacgaacgtcgtcttatccccaagccgactcccggtccatcaccgcaaatactctcccgagacatcgagtcacctacacatgaaataaacaaagaaaccatattccgagaccaagctatctccaacttgactcattagtagcaaacaacagtattacaaacgtatagtatccatttagaagccataatcatgaaataaactcggatatccaaacaaacaactcgaaaccgaaaccgacagtgtgtcggccggtcagaccgcgggctgcgccgttctgactacgcattacacgccggtctgaccggctaccagagtccggtctgaccggtcacatgaaataatgaatcctgcgatcacctgtgaatccaatcatctccaaaaccacttcaggaataaattccaaataacaaaaccaataatctccaatgcccaattgttcatcgcagaataataatcaaaagcacctttgattgtacaatctcccccttgatgaacacatttgcaaacccattaaaaatgttttgatgtttggaaaaatataaacaaaagtggtaaaaagcacacttcgtacaaatatacacatcgtgctcaaaaaatccaaaagaaaacttctccccctttttaaaagaaagaaattccctcatgaaccaaaaacatgctcttctcaataacaaaattcaccttgcttctcccaaaaatccaaaaattttcacataacttttcccccttttgacaatgatttcatcaagcataggaattatgttcattaatgttcaagagcttagcatacatataacatatcaagtcatgtgttgcaataaaaagaagatgaacccatctataatataacaagcatgcattaaagtataaccatgaaccaaagattttacaatttagcttgaatcaacatcttaacaagcacataggttgaaaaataaacactaaacacatatacctattgcatttatcactctttctcaaataaactttagcacaaaataaccaagagaatatttttaactttttcttttcttgagcctttttgctcatatttttctcttttattccaggtacgtccttgttgtcaagactgtttctagggattcgatacccattattttgctcacatcgaatacgtcctcgtcgtgaagacttgtttccaaggattcggtattcatttttttcatattttttattctcttttcacaatgagcaattaaagctatttgaggaataacaattcaataaagcatatatatataaagcatttataaatcaaaccatatgctagcatcaacattgcatatttgcttaattcaagtatagaatttaagtgtcatgcatcatctcccttaaaagcaaaatctaaacctcatgaaaagactagaatacatacaagctatgctagagacaaataaaccttcaaagtattgctagcatgcacaagaaaataccatatacataaacaaagctctcttttctcaatttttttcattggcatattatttcttgataaaaccatgaggtacaaactccccctcaaatcatgccaaaatgatgaattatgcccaattcaccacgaagaaaagcaaagcgattagaatccaaaggtttagtgaaaatatcagcaatttgcaactttgtgtccaaaaactgcaattcaacatctcccttctcaacataatccctcaaaaagtgaaaacgaatatcaatgtgctttgtgcgtgagtgttaaacaggattcttagcaatgttaatagcactagtattatcacaaaagagaggtagtttctcaaaagtaagaccataatctttcaaagtagataaaagccaaagaatctgtgaacaacaactagcagcagcaacatattcagattcagcagttgattgatcaacactagattgtttcctagaaaaccatgcaatcaatgatgtaccaagaaaatgacatgttccactagtacttttcctctcaattctacaaccaccaaaatcagcatcggaatatccacttaagcatatagaagatgaagtagaatatcaaattccaaactcaagtgtatgattcaaatacctcattagtcacttgaccgcttgacaatgtgaagcacgaggagaagtttgaaagcgtgcgcacaaacacacaggaaattgtatgtctgccctagaagcagttagatacaacaaagatccaatcatacttctatattccttttgatcaacaacttcaccatcttcatcaggatccaacacagctgtagaaccaattggtgttgaaattggcttgcaattctccatcttaaactatctcaaaagatccttcgtatacttcgtttgatgcacaaaagtaccttgaggagtttgcttaatttgcaatcccaaaaagtacgataactt

SEQ ID NO: 89871 - DNA, 1236 bp, Oryza sativa
  unsure (1)..(1236): unsure at all n locations
ccctcgagaaccgaaacgggtgtttttccaaaaacaacttttttttttagaacccggtccaaaaatggcaagaggttaaaagccaactgtttccaagatttcaatttaaggcgggttacccctttccggataggttgncaattttggtacaaaaaccacaacgggattgccacacttagaggggtccttaaccgtgagccggtcactttatacaaaaattgtccgacaatgtggcgtttatggccaaagacttgtactntaggttgaccggttttgatcatctcgggagagtagtatttcaggaggccttctaacaagaacacaagtacctcagctcggacgtggcttgtctgnggcactcatgtccggtctaacgtaggtgtncgcagtctgacgggctggcgcttgtttgccgggcctagcgaacttgtagcggtcgttgtcgtcgctctcgtcttggaaaaacgaccatcctccccgtgaacatgtgacagtgtacgtgaaatatcgggtgtagtacatgcactagcctcatcaaaagaaacttcgcaagtctcaacgattttgttagtctcaaaaataagtacacgatagccacgagtgtgtggggggtaaccaagaaacaatccatctgtagaacgtgcctcaaacttattcaaatttccagatttcaagacaaagcatttgcatcaaaaaatgcgcaaatgtgatactttgggttgatgtccaaatcgaagttcataagaagtttttccaagtttagatctcaagaaaactcgatttgaaatataacaagcagtgttgatagcctcagcccaaaattttcttggagttttatattcatccaacatcgttctagccatctcaaccaaaacacggtttttcctttcaacaacaccgttttgttgaggaacacgaggagaagaaaattcatgttcaagacctctttcgttgcaaaattgttcaaatgaagcatttttaaactcaccaccattatcacttcgaattcttttcaaagaaccaggaaattcaagatccaatcgatgaaacaaaccacgaaagtgttgaaaagcttcgtccttagttgccataaagaaaacccaagaatatcgagaaaaatcatcatcaataaccaacacatacccctttctttcaacagattgcactctagctggactaatagtgtccatttgtaatagctgggtgcgaaggagaaactcatcaaaanggacgtcg

SEQ ID NO: 89872 - DNA, 5938 bp, Oryza sativa
aagttagcagtcaaagacgaaagatacaaacgaaatgcctaagcataaaatcgacgaaggtgttcaatattccaagaattgttgatgagagtaccatcttcgcgcttgagtcgataagaacctggccgagtgacttcggcaattatgaacggtccttcccataagggagataatttacgccgatcctgtgtggtttgaattttcctcagaaccaggtcgccgactaaaaaggctcacgatcgaacattccgattatgataacggcgcaacccttgcaaatatcgagtcgactgaattaaagctacttctcgggcttcttctagtcgattgatgtcgtcaactcggccctcttcatagtcctcctcgttgaagttccgaaatcgtagtgattcaaattccacttcactcggcaacattgcttctgcaccataaaccaaaaagaacggcgactggccgatagcccgactggaagtagtgcgtaaagaccaaagtacggacggcagctgatctacccacttgccaacatagggacgcagtcagtcaaaaatgcgtgctttgatcccttgaagtatcatgccgttagcgtgctcgacttgtccgttactcatggggtgtgccacggaggcgtaacaaattttaatgccaaagtcttcacaaaagtctctaaatgctccgccagtgaattgagtgccattatcagtgatgatccgattaggttccccaaaccgatgcacaatgttgatgaaaaaatctctagctttatttgccgtgatcgtgatgaccggtttagcctcaatccacttggagaatttgtcgatagccacaaagagatgcgtgtaaccgccgactgcccttttaaacgggccgaccatgtcaagcccccagaccgcaaacggccaggacaacgggatagtttgcaactcttgggctggcagatgaatttgtctggcaaaaaattgacaaccttcgcatgtccgcacaatcttgtcagcatcagacacagctgtaggccagaaaaaaccttgccggtaagctttgccgacaatagtccgtgcagcagcatgattaccacaaataccagaatgtatatccttcaacaattgtctcccttcttccaaaaatacgcagcgctgcagtattcctgatggacttttcttgtacaactcagtcttatgaataatgtaaagtctgctgcgcctggaaatccgctcggcttcatttttgtcttgagggagttcttgtttggtcaaaaattttataagaggttctctccagtcggtttcaatcatgcttacgccttgagtatccatggcttcaagtgtttcttttctgggcacggttggttcataaagatgttcgacgaacacatctgaaggagctgcttcccgttttgaaccaaaattggccagcctgtcggcagcctcattgttatgtcggaggacatgggtgagctcgagtccatcgaatttatcttccaacttgcgtacctcttgtcgataagcagtcatattatcatctagacaagaccactctttcatgacttgattaacaaccaactgagagtctccacggacgattagtcagtgaatgcctagagagattgcaatccttaatccatggagtagcgcctcgtattccgccacgttatgggacacagaaaaatgtatccacaatacgtagctcaatctttctccagtcggggaaatcaagacgaccccagctccagtgcctgtaagcctcttcgacccatcaaaatgcatagtccaatgttccatcttttcctctggcatgtcttcttggcactcggtccactcggcaaggaaatcagctaacgcttgtgacttgatcgaagttcgtggcttgaacgatatgtccaaagacatcaactttaaggcccacttcgcaatccgtccatttgcttcgcgattatgaagtatatctccgagtggaaacgatgtgaccaccgtgaccgagtgactttgaaaatagtgagataacttcctgacggtaattaagacaccatataataacttttgaacctgaggatatcttgtcttggagtcgactaaaacctcgctaacaaaataaattggacgttggactttttgaatatggtcttcctcttcacgctcgacgaccaggaccgtactcaccacctgggaggttgccaacacatataacagtagcggttcttgtggatgtggcgaggctaaaactggtgtagtggtgagaagtttcttgaagtcttcaaaggctttttgtgcttcgggtccccactggaaattgtcagtcttcttcagcagcttgaagaagggcatcccccactcgccgagtcgtgagacgaaccggctgagcgccgccatgcaaccagtcagcttttggacgtgtttttgggagcttggcggtttcatgttgaggatggcgttgattttctccgggttggcctgtatgcctctttgagataccataaatccgagcaacttccctaacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggttgctcctgcgttctttaatccaaagggcatggtgatgtagcagtaggccccaaagggcgtaagaaacaaggtcttcaagcagtcggattcttttagtcggatctgatgatatcccgagtaacagtccaagaagctgagtaactcgcagccggccgttgagtcaaccacctggtcaatgcgaggtaacccaaaagggtctttgggacaatatttgttgaggtcggtataatcgacacacatgcgccattgccccgtctttttccgaaccaggactgggttagccagccagtcgggatgaaggacttccttaatgaagcctactgctaacagcttggttaattcctccttgatcgcatccttcctgtcctgtgcaaaatggcggagtcgttgcttgatgggtttggcctcttgcttaacatgtaaagagtgctcaatcacctctctaggaatactaggcatatcagatggtttccacgcaaagatatctttattattttgaagaaaggtgatgagcgcgctttcctatttacaatctaactcagcgcctattacagcagtcttatcaggatcggagggatctaagggaatctttttcatcttggcatcaccttcttcggtcttcgtcagcttggttgcaggcacttctccctcgcttgccgtggtcgcagccagtcggatctcttcgcgggcaagagtagtctcgtgggtttgggccatctcgcaactttctttgtcacatgtgacggcctgcttgatgtcgctccgtagtgatatgactcctcgaggaccaggcatcttcatcatcatgtaggtgtagtgtggggcggccatgaatttagctaaagccggtcgtccgagtatagcatgatatgctgtctcgaaatcagcaacttcgaagcaaacattttctgtgcgaaaattctcccaagtgccgaaggtaactagaagagtgatctggccgagtggtgtagctgacaatcctgggataacaccgtgaaagggtgcattactcggctttaattatgtgcgaggaatctgcatatcgtccagggtcttagcgaaaaggatgttaagtgcactgccaccatcgatgagagtccgtcggagcttgacattgcgaaccactaggtctagtaccaaggggtaccgccccgggtggaccactcggtcgggatgatcggagcggtcgaacttaattgctatctctgaccaccgaaggtattgctatctcccgttctgttagcttctgctttctcttagattcataagccaggggtccaccgaacatgtgattgagttctttgcggtgatcttgaaaaccagtcggggcatcgtcttcatcatctttcttctttgatgtgccttgatctccgtctgagggcttacgcgcgttcttgacatattgcttcacaaactgtttgtagacgaagcaatctttggccacgtggttggagttgggatgatgcggacattgggagttcattattttgtcgaaggtgttgacgcgggaacgttgttgggaagacggagaggtggtcgccacaagttcttcgggcttacgcttgcgatccttgtggttgttacttccactccctcctgcagtcggcgtatccttctttggctttcaagcggtgcccgactgcttggacgccgtgatagcattttcggctttggcatactcattggctttttcaaacatctacttgaccgtcttgggaggtttgcgtccgaacttgccgactaggtccttgtggcgaatgcctttagtaaaggcggcaatgatgacgtcgtcggcgatgaagtggtcgcgtagctctgcccatgatccgatcgtgccgcggggtagcccgtggagccatgaccgggcagaatccgctagggccacaggtagataattcgccatggctttgctgtctcctcctgctgcgcggattgcgagaccatagacggtgagccaagatttaggcttggtggtgccgtcatatttctcgattccagtcggcttaaagccggctagccaatccactcgacgcagatcgcttgtgaaggcagcaactccgtccatgtcgtcgtcatagcgatctggtgaatgatggcctcttgctgcgcggcgctggttgatggtgtcgcaaagatcgatggggcgccttcgatgtggggagtgtggtcgttcaactcggcgctccctatatcgttcggaaggcaaacgaatagaccgttcatcgtgtcccctgctcctgcgactagattcggcgccggcaatgctgaggcttggctggtgattgtcttgagatcgaagatgagggactcggctaccagtcggggtgtcgcgtcccaaaacgactctaaaatacatcctcgaaataatgcctagaataattaaaatccgtgtgaaagcctcccacaattaaaatgtgcaaagttaaaagtcaaataaggcttggaggatttttgtatatttcctaaaagcctaaaatgcgtaaataaattttagtggaattttcaaagcacaaataataattattaagaaataaacaaagttaaaatggttttataaaaagaaaagctctaaaaagtctttttccccccctccccctcttgggccggctcggcccatctccttccctctctctcctctccccgcggcccattcggcctcctccccgtgcgcgcgccgctgacgggtggggcccacccgtcatccccttcctcccgccgctcccgccgcctcgcccgtgccctagcgccgccgccgccgcaaatcccgccgctcccgtccgccccgcgtgcaatcaagaggggggaaatattccccgtgattccctccctctttccccccatttttccctccctttctcccttggattcattcggaatctttccccctaaacctcgccggcgcatcaatggcggccggatcttccgcgcccgtttccccctcatccggctgccctctctcactcccaaccctatataaacactccccgtgccttcctccaccgtttacgccactcgccggtccctctctccgccggaatcgagcttgcgccgtcgatctttctcttcggcggaaccgccgagctccggactgccggcggcggcggcccggacctttctccgcttcggcgcccgcttcttcgggtatggcgcaaccttgccggactcggtcaccccttcgtttcgcccgccgaccggcggaacgcccgcgtccccgtttaaccgagccgggcccggcggcttccttcggttccgggcgccgg

SEQ ID NO: 89873 - DNA, 1233 bp, Oryza sativa
  unsure (1)..(1233): unsure at all n locations
atgatttcacggtatggtcatcgggttaanccaatgctctggcctttctncatgacttaaatgaccaaagtgtccatgaaatacttgaataagtttgttgtggttttcattgatgacattctggtatactcacaatcagaggaagaccatcagcaccatctccgtctggtattgggaaagttgcgggaacatcaattgtatgccaaacttagcaagtgtgagttctggttgtccgaagtcaagttcttagggcacgtgatatccgctaaaggagttgctgtggaccccgaaacagtgaccgccgtcactgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcatgccggatactcgcaaggacttcacggtgtattgtgacgcttcgcgccaaggattggggtgcgtgctcatgcaggacggtcatgtggtggcctatgcctcacgccagctacggcctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgcagacgcataagtcgaaaaagccaattgcaacacttcttaacgtcccgggcaattccaccccgaacttaaatcaacagattgaaagccctggatcctaagcataagggggtcgcgggattctttggctgcgttggaaaccaaagcccacctttgctcgatcaaattcgcgaggcttcagaagaacgatcccgacatgcatggactcctcaagaatatgaaacagggtaaagccacttgtttcacagaaggagaacaccggacccctatggaaccggaaaatcgttatggcgttccagataacaagagacattaaacaggtgatactttacgaaagctcacgaaagcccttatttcaatcacccttgga

SEQ ID NO: 89874 - DNA, 865 bp, Oryza sativa
  unsure (1)..(865): unsure at all n locations
agcgaggtagacatgctagctcggnaccgaacaannggntaatgatttttatcaaaatcattaagttaaggtagatacacatgttgtcatatgatcaaatggtctcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcg

SEQ ID NO: 89875 - DNA, 603 bp, Oryza sativa
ccgcgttgatagtcgagctcggtacccctcatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcgccagaggagatggtagaactcatcaaggattatgatgtgggaattcactatcatcctggtaaggcaaacgtggatgatttggagttagcccgggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtcgccgacgctctaagtcgaaaaagccattgcaacactcttaacggccgtggcattccacccgaacttaatcaacagatggaagcctgaatctaagcatagtgggtcgcggattcttggctgcgttggaagccaagccc

SEQ ID NO: 89876 - DNA, 743 bp, Oryza sativa
cccctgttggttgcgaaatttcgccaagcgacgctttgtgcgactccagtactttgtgcttggtttccaagcggatgctcttgtcccccagacgttggaaatccggatagtccccggagactagcgggacggacagctcaggatccattcctgccaagaacttctcctgcttttcctcatcttcccgtacatcctccggggcgtaccgggccaggttgttgaactcatgcaaatactccatcacggagcggttgccttgcttcaactctcggaactcccttttcttaagggccatgactccggcgggcacatgggtcctccggaaggcggcggtgaagcgggcccaagtaataggttgcccctctagttgcgtagcctggaaatggtcccaccatagagatgcgggcccctgcagttggtgggcggcgaagatgactttctcctcatcgctgcactgcacggtgtctaactttttccccacggcatgcaaccaatccaacgcatccacggggttgttggagctaaagaaggtaggtggacggatgcgtaggaactcggcgagtttagagtgttgtgggggtggtggtctactgtgggagtcccggcgatggagaggtgggttatcacttagaaaatgttatcatcgaatttgctccatgtcttgaaaagttgctccatattgaacgctcgatgggacttggggttcgtgtatccgtgattatggcacccaaactggagacatt

SEQ ID NO: 89877 - DNA, 547 bp, Oryza sativa
ctagcaactaaactttacctgttgaaaattcgaacgcccaagcaacttgtttaatatctattcgaagcgaatgcagattgaagaaaccttccgagacttgaaaagtcctgcctacggactaggcatacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagctcggtacccgttttcatcgtccgtcaaaaaaaccgggcgaaaaaaatctgtccgatccaaaacaaaacggacgaaaaaaccggacaaaaaaccgggcgaaaaaaagaaaagagaaa

SEQ ID NO: 89878 - DNA, 1272 bp, Oryza sativa
cttgtagactatcgagctcggtacccagtgtcaacgcctcgaatttacaaaaccagacttctaggcatagtgtgtataattctctatgtaaggaccaatcaaagtacacaaagaaaaagggtactcggcgagcttctcattttacgtggagcctaaattatttggctgacgtgcacgctgacgagccaggggcctacagctgtaaacaccaggccgtgcgcttacgatgcgctcgcctgggccgcccggacccccttgctgcgctgcgtcgatctcgtgcgccgccgccgcccatgcgtgccgcctctcccgcgccgcccatcggtcgccgtcgccggagaccgcgctaccgctgcgccatggctcagctaggccggctttgtgccgtgctgtgccccagccgcgccgcccctggccgcccgatcggcttgggccgatccggaccgtcggttcccgtggaccggcggtggaccgccttggtggtcccggtccacggtggaccggcgcccttgtgccgctgaccggtggggcccgcttgccggcgccgcccctcccctttgatgacgtcagcaaccctcttttcctttggaaaaataaatgataattgcgtcataattcgttaataattatagaaatccattaaaatggctcaaaacttctaaaatccatatctaattcattcgaactccaaattgagccattcaacttgcaaaattcatctaaaattgagctctacatgtttgtttacttttgatgtattgttttcttggtttttattagagtttttccttgttttgcgtgccagcatgtagttcccgtcgtttcggaagtccgcggtcgcgaggaaaaaagttcggaagatcaaagtgaagaagcaaggcaagtcacacaatcccattgagcatattgagcctattttataaatgttttaccgtttgcaaataagtatgcatgttttgctaattacatgggatccgggtattatctatctgctcgcttgtgccatgtttacttgatatttgtcctttgtcaaccgggggtaataaatcgactagctcatgttacttatgtaacctagctagaactatatgcttagccatgcttaattaccactagctcagttgatgggataattacagtattagacctttttagtatcagaatgagctgcgtgctcgagacacctggcaatgcttcatggtcgtaattatccaactaaaatgtgactgaatagtgggctgtgggtgcatggttttgctagtcgcacccatg

SEQ ID NO: 89879 - DNA, 531 bp, Oryza sativa
gaccccagtaatttgaccaagttagagcacctagcattaggtcataaccaattatcatcaacagtaccaccgagcttatttcatcttgataggctcatcctgctagatctatctcaaaatttcttcagtggtgaattgccagttgatataggcaatataaaacaaattaactacatggatatctatatgaaccgctttgtcggtagcctccctgattcaattggacatcttcagatgttaggatacctgaacttatctgtcaatgaattccatgattccattccagactctttcagtaacctatctggcttgcaaattttggatatatcccataacaacatttctggtaccatcccaaaatacctggccaattttaccagccttgctaacctaaatctgtcttttaataagcttgaaggtcagataccagaaggaggtgtcttctcaaacatcacgttgcaatccttggcagggaactcagggctatgtggtgttgtccgtttaggattttctccatgccaaacaacctct

SEQ ID NO: 89880 - DNA, 1311 bp, Oryza sativa
cggcatcaacaacatcgaagacccctatgattacaaccagttcgacgatgtaccattgtttactgatcttcctatgtgaattaagaatgttgagagaacaatcgatgaagcgaatatgtcgtacgttcgagcagatggtgttgccaaggttattaagtcatagttattttgtaacctttagttgtcattgtgttccaaatgtatccggatgaatttaagtgccccttatgttgtgctcattagcatgtaacatttggtaatgagttttcttactgccaaaattatatggaatttttgttgtaccaaaatattaaaaaatatatatatgtacagtttatttagatgaaagaaaaaaatgagtttatttggtaaaaagatctttccatgcgggcgacttaagccggccgcatggaaagatcattttcgttgcggccggcttaacggcccgcatgaaaagatcttttttgcatgcggctgacttaagtcgcccgcatggaaagatcatttttccgtgtggccacttaagccgcccgtatgcgatgatctgcgcctatatatagggagcgcggggagccaaaattttctaagtcccggcgcccacgaacccaagcacgccaggctgccaaaatttcccccctcgccgggtcgccgccaccaagtcctccccgctacagccggctcctcctcaagacctccctttcgccgtcaagtcctccgccggctcctccccgaagtagtctccctcgccgtcactgccgccaggacctctcccccctcgccgtcgccgccgcgcgcgaagtcctccccgccaccgccggctcctccccgaagtcgtccccctcgccgtcgccgtcgcgcgaagtcctccccgccaccgctggctcctccctgaagtcgtccccctcgccgtcgccgtcgccgccgccaggacctctccccctcgccgcgtcgccgccgccaagtcctccccgccaccaccggctcctccccaagtcctcccggcccctcgccgccaaggccgtgccggctcctccccgaagtcctacccctctctgccaccgccgtcgccgccggcaatacctccccgccaccgccgcgccggctcctcgggtcccaagtcccccggtaacatttcctttaaaaaaatgtgaaatgtgcaattgtggattgtggattgtgaaatgtgcaattgtggattgtggatagtttaattttgagaatgtttaattgtggattgtggatagttaaattgggacttatgttacattgggtctgatgtcaatctcggaattatgttaaattgtgacttgt

SEQ ID NO: 89881 - DNA, 4326 bp, Oryza sativa
  unsure (1)..(4326): unsure at all n locations
catggcttttttgaattggcgtttgactgcaagtagctcatcattattccttgatacctggggtgtgtataacttgactagttgggctatatatattgggtcaacttgatattagatgtgaatgcttaaccatgcttagaaacattagcacactattgggataacttatgattcactattaattaatgatggcttactgatagttcacgatggtcaatcgtgattgggtaattaattatttgccaattaaaacctgataatgttgggttgagagcacatggttttgagagatcgcgctcatgacaattaaggaccggatcacgagtttcggttgtgaaacattaaccgtgccaaccacaagacagcgtgggcaacggctttacctttggtatagcatggttcattgcggagcaccagactgagaagtggcggagataagcccacgggggtcgctggggagtccatgccttgtttataaaggggtgattatgatccaagaaaggtgcgctgccgtggattgcgttgtgcgaggggtattgtcacagatcctttccgaggtaccgcggtggtattgaggcacatggagacatgatgtggtgctagttcttgtgggtacacgggtacacctactgtcagaggtaaactattcgaatagccgtgcccgcggttatgggcaggtctaaaaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatgtcatatactcacctttcaatcattcatcagaggaaaggttctacagtgatgctgatggtgtggaggatttggtgtagccctggtcaagctgcctgtggagtggagtcgtctgcgccgtttatcttatctttccgctgcttagatttttattgattgagaggaactatctacctctgtaatgacattttgttcgcttattaattagagtaataattgtactcaattatcaatttgttattgtgtgcctcggctgattcctggacgagggttcacacacatgtaagcgtttggaattttggatagaaattccgggcgtgacagtacgtgaagtacaaaagctcgcaggccgaattgcggcactcaatcgattcctctcaaaggcagccgaatgaggtttgcccttcttcaagaccctccggggcacgggaaaattcacctggacacccgaatgccaagcagcgttcgatgcgctaaagcaatatctgcaaagtctgctcgctttgatcagcccggcgccaggaagcgaactgctactatacctggcagcttcgccagtggtagtcagtgctgcccttgtccaagagacagagtcaggccagaaaccagtttatttcgtctccgaagccttgcaaggagtgaagataagatacattgaaatggagaagcttgcttacgccctggtgatggcttcatgcaagcttaaacactacttccaggcccacaaagtcacggtgccatcacaataccctttgggcgaagtactccgaggcaaggaagtcactgggcggctcagcaaatgggcggcggagctatctcccttcgacttgcattttgtcactcgcactgctatcaagtcccaagttctaactgacttcgtggccgaatggataccagtgtttgccgctgagcccgagcccgtcgaacaaccctaggtgatgtactccgacggctcgtggtcgcacaaggggacgggcgctgcgacagtactcactttgccagggggcgtgccgattcaatatgccgcaaggctgcagttcgacataaccaacaacgcggcagaatacaaagccattcttctgggcctgaaaaaggcgaaagcattggtgctttggcgcttgctgtaatgccccgattttcgtttgggattaaaaatcatttaataatgcattttctagaaattaaataaaagttagagcaatttaatcaagtgaaattatgggggaaattaaaattttcccttaaaaatcattggccgataatattttgtaatattctttgtcctaaatactctctgaaattttccgcgaattttcggagctcaatagctaattttaaagtcacaaagttcatatcatcaattaaaataaaaagaaaagtaataaaaattccccctctttgtttttgggccgccccggcccaatccccctcctccgccccttggcccgctcgccctccctcctttcccccttccttctcgtgggccggcccagctcggccccccctctccccctaagtctgcataaccccttcctggcctcctctctccttccctcaccgacaggtggacccgaggccccacctgtcagctcctcccccttcctccagccactccgccggcaaccgccatggcaacccgggtcgccccacgtcgccgctaaaactgccgcctcctgcctcccgcgcgcacatccgaccgtgcggacgtggtcgccgcccactcctccaccctctcccccatttttccccaaattttcgctccgattcgagctccacctcgcccacatcgccggcacccattcctccatcagatccgcccctcccggcctcgatctcgagctcctcaagttacatcagttccaatgcagagtcggtcaggttagttttcagaaatcaactatgcaactcgacaccgaagtcaggccagaagcaggccattcaagccagcagttagaactgatgggaaagttagtcaagagtcaatatgttcatgagctaagtgagagtctcttttatgtggactttcctatcctcagctaagggttaagttccaagtcttgctagaatgaaagtgcatcgtcattgctctattttgattgatcgatgaagttttcagttttcaaagccagggctctttgtaaatcggaaaagtgttggttacatttcaaagacaacagttcaattgatcccagtcaggcgaaagtaagactactctctgtaaggggggtaggtctcagagatgagtgttggctcacctcgtcgtcgtttcatttggaggttcaactcagtgcagccatttgggtaatatttgaagaagccaattatagggcgtcaacagaattacaccggtctcaggttatctgattggattccagggtaaacccgtgaggccaagtcaactgttcagcttaggcaagcagtgccaagaacagttgcagttcagccgaaagaccaatcaagcagcctcttaggatacctgtggttcccgtcagaagtaggttaaaataaagtcagaatctgtcattcatgcaagtccacatacaaggtttcatgaaagctttgcaagtttctagtatgcttggtgagctcacaggttactaagggagacaatgctagtggttcagtccaaagaaaagaaattctatgagcactagcaattttggtcaaggtcagactaatcggagtcggtctattcagtgtatgggaagcaacagaacagcaagcttatgcaggtttggttcatcgagcaatcagtcagttgaatcagaaagaggcagcatgtgtcagcagatcagtcagacagcccgccagcaccagctttctttctagccatcccaaaatcttgggacgagattcctgtaaggggggtagatttgtaacgcccccgattttctagaaattaaataaaagttaaagcaatttaatcaagtgaaattatgggggaaattaaaattttcccttaaaaatcattggccgagaatattttgtaatattctttgtgccctaaatactctctgaaatttcccgcgaattttcgaagctcaatagttaattttaaagtcacaaagttcatatcatcaattaaaataaaaataaaagcaataaaaattccccctctttgtttttgaaccgccttggcccaatccccttcctcctccctttggtccgctcgccttccctcatttcccccttctttctcgtgggccggccaagctcggccccccgtttccccataagtctgaataacccattcccggctcttttttcttcctcacgacaggggactgagtatacgttgcataaagcatatagntcaagcccc

SEQ ID NO: 89882 - DNA, 701 bp, Oryza sativa
tttgtttccagttattgcaagtgctcatcatgcttaacccaaggcctacgatgattcagaccgaactggcaacccgaccctgggtcccagctcgttccaagccaacccaggccaaccattccacattttagttggtaagcaggttttaagaattaaaacactaacttgggtacattgctcggattgcccataaccgagggcgcgggtattcgaatagattatactctgatcagaggtgtacatctttacccacaagacacatgttgctcacgtgtgaccacgtgccacataccaccacggtttacggacggtagacgtgacatattttccaacccatactagccatagacaagagtaccgacccaatcccacctaccgctggaaccctcgggacaggcaggcaggactgaacccctagcagcaggacaccggacctgtgccatgacatctggactaccgggccggagctcgtgttgccttcatttgtcctagagatgtccatcgacccccgacttcttgcatgtgcatgcgtgtacttttggttataaccagactgatccacaaactaagccttacccactagacatgtggaaggtcggcagtgctttgcaacaggagaccgaagaccggtacttatatggcacgagggctgctatcaaaaccatgcaccccgagccagtctaaaactatttttgggattt

SEQ ID NO: 89883 - DNA, 775 bp, Oryza sativa
cgtgtgaaaatttgacagttggttatcatcttctgattttaaaagaaattaaaatattttgagggcccctaaaagtattgtgggcactgtgctactgtccttaatggagaagtgggccctggttggatccttctcataatttaggcctcagtttaaatgtcacctactccagggttccctaacccccaggccacagaccggtaccacctgaactctgcctcctatcagagaatgctttagattctcataggagcgtgaaccctattgtgaactgcgcatgcaaggggtctaggttgcgtactccttatgataatctaatgcctaatgatctgaggtggaacagtttcatcctgaaaccatcaccaccactgcgacccccacccggggtccatggaaaaattgccttccatgaaactggtccctggtgccaaaaaggttggagaccactgacctactccaaaaggccttccttgaagcctgcatttaaaatatcttctggccgagcatcgtggctcgtgcctataatcccagcactttggaggccaaggcaggaagatcacttgagcccaggagctcgagatcagcctaggcaacatagtgagaccccatccctacaaaatattctttaaaaaatagctggacatggtggcttgctcctgtagtcccagctacagactgaggtgggaggatcacttgagcccatgagtttgaggctgtagtgagctacgattcccaactttgcacttcagccctagtctgggcaacagagtgagat

SEQ ID NO: 89884 - DNA, 710 bp, Oryza sativa
  unsure (1)..(710): unsure at all n locations
gccgcttcctgccttgcgcctcacagtggtacagtcgttcatcacaactttgaagtagctatcaccagttatgatgggctagttgtaactgttcatgcattgtattctgagcctttaaggtcaagactgaacctaataactttggaagagattcctatagtcccggagtattcccatgtgttcccagacgatttacctggtatgccgcctaaaagggatatccagctcacaatagatttggtaccaggaacgactccgatccattagagaccttatcgaatggcagccaatgagttggcagaaaccaagaggccagtagaccatttgcttcacaaaggatacctcagaccgagttcatctccatggggagctccggatatttttgtggaaaagaaagatcatacccagaggatgtgtgcagactattgggcactagatgatgggactatcaagataagtctgcgctttccagaatcgatgaccttgttgaccacgttaacgagccataggtttctccaagatagatcttcgatcagggtctcaccagttgaggatccaagaagaagatatacctaagacagcgtttacactatgtattgagtgatcgatgtgctgaatgccctttagacttaccaattgccccgcgttcttcatataccagctgaataaggtgccatggattacctagacangtttgtgcggttcttaat

SEQ ID NO: 89885 - DNA, 754 bp, Oryza sativa
  unsure (1)..(754): unsure at all n locations
acaaggccacggccaccacaccagccaccacaccaaagagaatgttgccacgctgcttggagcgctcatattctggatccccagcaatgtcaatatccagcggcgtgtccaggctgtggcccaggagggtctccagcagcgtgcggttggccagagtctcattgacataaagatggaccaaggctgtgccatagcgtgggggcttgccgcggtcactgaccttcaccaccaggcggtgtagcccatggtggcgccgctcaatctccttctccagggtgatggcacctgaatgtgacccaatctggaagagtccataagggttgccacctgcaatgctgtagatcagctcggcattgacaccagagtcaaagtcctcggctgccacctggctgaccgtctcaccaagacgtgtctggggggtcagcagcttgtgagaggtgttagaaggggcagtgatatagggtgcgttgtcattctcgtccagcacattgatggtgacaccaacgtaagctgagcgaggtgggacgccaccatccactgccttcagctggaaggtgtaggtgctttgttgctctcgatcaaagctcaggctggataggatggtgcctgtgccattctggataacaaagtcaccgttgtcctgctccactgagagctgcacctgggcattctcccccttgtctccatcaatgacagtcaccatgcccactggactcagtgctggcatgttctgataactgctctcaancccact

SEQ ID NO: 89886 - DNA, 751 bp, Oryza sativa
  unsure (1)..(751): unsure at all n locations
taggtcctttgattactagagtggcagtagttcatcaaatcggcggtgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataagccagccgtgtaggcggaggcaccaatcggcggcgacggaagcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtatgtggaggcacccaatcgcggcgacngaggcaggccngcggtgaagatgacgatgcccaatcacggtggtgtgaccaaccgaccgtataggcggngacaccagtcggcggcgacggaagcaggccggcggtgaagtcttagatccccacagcggctgataataggctaggcgtgtaggcagaacaaccatcg

SEQ ID NO: 89887 - DNA, 766 bp, Oryza sativa
cacggaggtgagactacatactgctgcaagtgttcatcattcacatgaccacctcattgacgaaaccgattgtgaccatttcctgccttacattcaaaagctaaacctatgactacactgagggcgtggcattcaaggtggagatatgctcctacgtccattcttatgtctgctatttattcaccatcgatgctacagttggcactattcaaagatctacatatacgctattgctcatcatctacggtacactgaccacagctgtcgtctaaattgatcacacggggatggaagctacctgctgggataactcgcgagttgggacaaggatgaaaacatttggagcagattttcggatacgcccttctgcagacaacttcaatagctcatgcagcatagggagaaggtaagcaaaggtctttccggagccagtcttggccttagcgaccacatccttcccttcctgaaatcacagtattacactattcgtcagttgcacaaattattgaaaacctgaatgtctgctggaattgctaaaaaaacgtcgcaagttttttgggaaaaaaacatgcaaatgtaactatatcagaattatattacaattatactataattagatttggaaagttttttttctaaataacttaaacttaacatgtctgcccctgacaaacaggagaaatatagcaaaacttatcgaaaaggttcaccaagacaaagcagacaacccaaatatgcaaagcgaacaacaattttgcacattggc

SEQ ID NO: 89888 - DNA, 748 bp, Oryza sativa
ccctgtagtagaccacacattactgcagtagttcatcactatcatgattgactttagccctcaaaaggaaaaccataccgctttccacaacacaacccgtctattacaacgacccatgcttcattccaccggcaacgcgacgctacattagatcacgctcgcgctcgatcggcacgccaccacaacctgcacacactagagagggggcgaagcactacgttgcttcgcaaactcagggtgtggtggcacagccgcggacatcgatttggcagcatgagcaggctgggcttgcacatgctttcttgaacggtggcgtccccggttcatgtgtcgctcacagtacttctggtcggcgaccgcatccctcgagcaccgccatttcttgccgtccgtccggcggcaccggccgggctccggatccgcgctgccggagtagcccagctggaaagatccccatcccactgcaaagcaaaaacccaaccaagggcaatgcaaccaagatcagggaatggaacagcttttatcataaatatcagtccatgatgaaaggaactaaagccaagaaagcattcggttgatctgctttctttcccatttcttggcttacatgtgcttgagccaaagtaggcaggtgagtagggcgatgtgaggctcctcctgatggggatgaggaggctgtgtggtacagggctattcgcagccaagtacttgtatatcagcgcctggtgcttcagctcgatccactgag

SEQ ID NO: 89889 - DNA, 745 bp, Oryza sativa
  unsure (1)..(745): unsure at all n locations
cctcgaagggtaccgngantgnataaanncanccnngagtncangnacatngagactgtcattgatggagacaagggggagaatgcccaggtgcaggtctcagtctagcaggacaaccgtgactttgttatccacaatggcacaggcaccatcctatccagcctgagctttgatctagagcaacaaagcacctacacctttcaactgaaggcagtggattgtggcgtcccacctcactcagcttacgttggtgtcaccatcaatgtgctggacgagaatgacaacgcaccctatatcactgccccttctaacacctctcacaagctgctgaccccccaaacacgtcttggtgagacggtcaaccaggtggcagccgaggacttttactctggtgtcaatgccgagctgatctacagcattgcaagtggcaacccttatggactcttccagattgggtcacattcaggtgccatcaccctggagaaagagattgagcggcgccaccatgggctacaccgcctggtggtgaaagtcattgaccgcggcaagcccccacgctatggcacagccttggtccatctttatgtcaattagactctggccaaccgcacgcttctggagaccctcctgggccacagcctggacacgccgcttgatattgacatttctggggatccaaaatattaacgctccaagcaccgtggcaacaatctcttttgtgtggtggcttatgtcgttgccctct

SEQ ID NO: 89890 - DNA, 5925 bp, Oryza sativa
  unsure (1)..(5925): unsure at all n locations
tgcaaatccctacatggggtgagaatgcctactggcttctcctcaaacattaagcgactagtgtcgatgaaggatctgtcgctttcaggctacaattcccatgattgtcatgtaatgctcacagtattcctcgcgattgcaattagagcagtcgaaccaattcacgtaaagatggtcatcacaaagctctgttatttcttcaattccatatctcagaaagtaattgatcctgaagagttaggtcctctccggactttcgctatacagacagtgtgcgagcttgagatgtgtttcccaccatcatttttcgatatgatgcaacacctcatagttcatatcatgcctcagataattgcacttgggcccctgtacctgcatcagatgtggccttttgaacgatacatgtccattctaaaaggctacgtacggaaccgcgcccacccagagggatccatgatagagggatacacaaccgaggaggtcgttgagtgttgcattgattacctaaaagatgggaaagcaattggtttaccggtacctcgacatgaaggtagattatctgggaaaggaacaaaagggaagaaaagaatccacgacaatgactacaaaaaagtgaaagatgctcatttcactgtgctgcagcaactcgcaatagtggagccgtacatagagcaacacctgcatgaattacaagcaacaaatgtgggtcgatctaatagatggatcatgaagaaacacaagcatcactttactgaatggttcaagaacctcgatctaccagatggccataccatggaaaaaagatcaattaaaatgctagctgacgggccatcaagtgtgtatacctcgtggcaagcatacgatctgaatggatacacgttttacacaaaagcgaaagacaaaaggagtgcatgccaaaacagtggcgttcgcgtagaagcaatcgacacaactgagcaaaagagcacatactacggattcatagaagaaatctgcgaactagactacgggccaaatatgcagattccactgtttcggtgccaatgggtgaaacacccagccggcgtgtctgtggacaactttgggctgacaatagttgactttgaaaatgtaggcacaaggatgacccatgggtgcttgccgatcgggtcgctcaagttttctatgtgacagacccatctcatttgaagaaagacatagttatttcgggaaaacaaaggattttgggagttgatgatgtcgaagatgtcgaggcatacaatcaatatgagaacatgacactattcatagattttcgaaacaagatattacgcgtcgaagaatcaattggtgaatcgccgaagccatacatgagagatgaaggtgtggggaaaagtgttagatgctaattcattatatatgtatcatgttggacgtatcgatgaattttaatgtattataatgcgtgacaatgatggatgagatgaatttttgtatatggaatatggtgacatgataattgttggatcaagaaatagtttggtataaatttatttgtatgcatgcatttaaaaaatatcaggcgcaaacattaaaaaatcatattttatttttttttgataaattaagcatatctgtgtaaaaataaataaaattattttttcagttgggaatgacatgtggggccaaagggtttttgctggcggccggctttgcccaccgctagcaaaaactgttttcgctagcggcccgcataagctaccgccagcaaaaaccgttttcacttgcggcccacataagcttgccgccagcgaaaacccttttcgctagcggcccacggaatcctccgccagcgaaaatgttttcgctagcggtcggcgcgttcctccgccagcgaagatttcttcgcctataagtagctagcgcgcgcggctgaaaatttcctaagtcccgaaggcgcgcgaaccctaaaatttgtgccgccaggctgccaaaatttcgagcgccgccgccagcgataaccctagcgcccaccaccgtcgnctgctcctgcttcatttgcgccatgctgcattcggacacagcttcttcattcgcgccttcaccgccgccgncggctacttattctctcggccngacgacgtcgncgttagatccattcgcacctcctctccaccaccgccgatagatccagcttctctccgaccgacggccaccgcatcctctttcttttcgccgcatcttcatggattggcccaccgtctctaccaccgccgccgccagatcgagctccacctctcccccggctcctccttcctccacctcgggagttgtcgccgccaccgggactcgtccgctggctcctcttctccgccgccgccgccgactcctcctcctaccgccgctgccaagaccgccgccgggacctcctcttcctccgccggttcctcgtcgtcgacgccgcctccacctcaggagtcatcactaccgccgggtcctcgttgtcgacgccgccgccgccgggtcctcgtcgtcgacgccgggaccagctccgccgcctcttcctcctccgcgccaccgccgtcgccgccgcaccggaactccacggtgagccgtgacgagaagccgaggtacaccccctcctctgctcctcctccccattctgtaaaattgatgtatgatgaatgtgatgtgagatgaattgatgcatgatgaatgtgataaaattgatggatgatgaatgtgatgtgagatgaattgatggctgaattgggatgaattttttatgaatgttaattggtggtgaaaatttgggtggatgcagtttttttttttgtgttgatagaggcatgtatgagtttgtgcagcctctgaattttttgtgcaccaactaaaatcgatgtgcagccactgaattgtatcgatgatagaggcatgtatgagtactgtcctttgttttcttgttgcaaatgtgatttaatttgtacaatcaaaattgatcttgtgctcaacatattaagaaaaagaattgttctgctgttgcacttttttccaaaatgaaatggacctgtacatattgtacatatgtattgctgcactttttttccaaaatgaaatgcactttcttttgttcaggcctatgctgttatatatatatatatatatatatatatatatatatatatatgctgatctggatatgatgcattgagatgactgttgggtgaatatttagatgcacaaatttgttagtttgactgaaattgagtaattcgttagtttgatactatggcgatcaaaatgtgttgtttgaaatttagttcaaatgaaagaattgataaattggccgcagaattttggtggattggtcagtgtagtccatggacggaaccgatctagacaccaaaattctccatgcattttgtattctgtcattctttgataattaaggaacttaatttggtttagggtttgaaatttagttcaaatggaagaattgatagattggctgtagatttactgtagttcctaggttatcaaaccatcacagaatacaaaatgcatggggaattatagtggatttgtcagtgtcgtccatggacggaaccgacttagacaccataattctccatgcattttgtattctgtcattctttgataattaggtagtttgaaatgatcagggttggtgaattgtaatattgatgtcgttgccgatctcattgattggtaacaatatttatagttgtagtacaaaattagtatctaaattttgccttctttttggatttacaataagaaaatgattccattttgcaactaacattaattcaccttcaagcgatatcaatggacaaacccacccaagagcaacccacgggtgacaagggcaaggaaactcagctagtcatggaggaagatatttgcacgcaagtagtcgcggaggaatcttcgtcgtctagctcaagttaaccaggtagtggatcgtatcactcaccgagtgaccaccatccttctccggcaaggaagagaaagggcggtagcaacaaatgaagttgactccgactacgttccgcccgaactggtggtacgtagcatataatatatgtttagttccaatcatattaactgcgaactatggattttaattaaagtcacgttatttgcaaacaatagttgaatgctccacgtcgctccaaaaggaaagcccaagccgcaactgaacctgaagctgtagctatagccgtcgtgtgcacaacagctttaagcaaacccaagaaaaggaggggcgagcgagggaagaacatattgttgaaggaagtaagcgtgctgacgcggatgagtgagacaggggaacccctgtcaccggaagactcatgttcgaagtatagcaaccaatgtggggcggtggtcagggatatcgtggagatcacatggaaggattggaagaaagttccagagagtcgaaagaacagctgttggacatcgttgcaaagcaagtttgaatatccagaggggacagacaatgataaagccaaggattatgcgttgaagacaatggggaagctgtggcgaaattggaaaacggatctgaataagaaatatgtccaaaagggactcacgccgtttaaggactacggaaggataacacaggcccagtgggatgagttcgttacccttaagacatcggcggaagaaaaggagaagagccagaagatggctgagctagcaagaaggaatggatatccacatcatttgggatcaaccggttactggcaagcggtgaagaaatgggcaaaacaagatgaagagatggggaaggctgggaaacctgttcctatgaaaaatcacaacccatgaagcaggaacaccggccttcacccctgagggggatgtagtattcaaggatcagaagctccaggaggtagctgtcaagatgaagaacatcatcacgcagcaacaggccgggacgttcgtgccagatagagaccgggacgagctaacctatgccttgggcaaaccggagcactctggccatgtacggggagtttcctcaaagactaactggaaggatggattcaaacaggatgcttatacctacaagaagcgtgatcgctacaaggaagagattgactctcaggctagggcagcagcttgtgacgaatgcaacatatactggagtcaaaaaatgatgcacagtgtagctgttttagagcctgagccgagctatcctttcgatgttgtaacggaggatactccgtgcaagctcttgatttcggtcggcagggcaggaaagaaaatactcgttgcaactgggaggttcataccaggccacatgtttcattgccaagacattccggatgactacgccaaggtagaggtccggacggtcattgaggcttaccggatgcacgagctcgactttccaactactgagcagattgtgtaccttggagatgccatcgaccaattcatactatggcacaagaatgatattgaactagggtcaacggatggaactgatcgtccaccaaggataccggtgtcaccgtcgcatccaccagtcgtagcccgtccgagggatagtcctattgcttcaccccctagaccagagccaccagttgcatcacctctaggaccaaagccactagttgcatcatctcgaggaccagagccaccagttgcatcacctccagtaccagagccaccagttgcctcacctccagtaccggagcctcctgttgcatcacctcggacaaaaaaggatgcagaagaaccatcagagtctgtacaagcagagcctacaaagctagcggcgggtgaaattgaagcggtgcctgatcagccaatgcccgatcaaccagagcaatcgcaaccagagccatcgcaaccagaggaacctaagggtgccgatgtgctagtgatggtaaggacgcacaagcacaa

SEQ ID NO: 89891 - DNA, 609 bp, Oryza sativa
gacttttaaagcatgtgcacacaatattccagttctactgaacatcccacagccgcatgtactagtttgctctaaaggatcaccaacaactttgtactccttctcaaaggtacaattttcatctagactgccaattgccacaagatagcaattgttgccttccaatgccgtggtgcatgctaccatggatctttcatattcagcttgaaaagcttcgaatatgattggtgtgtatagcttgctagcttggattagcataggtgtcctcatttttattctgggtattttcttccttgattcaaattcagcatttagctcattttctcttttatcttccaccaccctttcaaaatgttgaagaaatcgaatgatatcaaaatcagatttgaaatgcctcttgagttcactatttacactctcacttaactgtgtacttctcatacctaatgtgaacacatccttcatgtaacattcagcccatttttctttcaccttgtatatactatccaaccaactttgcttgctcgcctttgcccttatggtgctaaatgcttgttcaaatgtttcctcatcttcgtactcaaacatacatgcactaaaatctgtgag

SEQ ID NO: 89892 - DNA, 759 bp, Oryza sativa
agcagatatgaaactagtacaagtgatttatggaacggatgattgaaagtctcatgcaaatcggtaagaatcatacattatccacaagattattgtgccgattgtgaaaatgctgatcaaggaacttctctgctcggaaggctttcttgcagaaaccacagcgccattcatttatatcaaagtgaatcttatgctgctcctgttcccgaaacatgtcattaccaggatgaagtctacatttgcttgggagttcatatttctctttttccacaaagggcatcaaatactgcatagaaaggaaatgttaatctgtcatattattatagaggcaccaatgcactgggcattttcatgttacacatgctttacctcatcaatagctttccaagctgcacggcttctttcccttgagcaatgcacttgatttgtgtgttcatgtgacataagaagagttctagaatcaagttaaaaggacagagggtcatgagtcaagcaagagcgttttcaatttccattaaggcttccaggaatgaactactttaggaattaaagaggacctaatctcggcaaggatcttgcttgtagtgtcatgccttgaaagggccaggtacaattttgggagggactaggtgagggtcttattttagaaattagactggcatgtataaaataaaacattaaataacatattttccttcatatgagtttgggagcttaagtacctcggatccagcagcttcattgaaattcctatagcac

SEQ ID NO: 89893 - DNA, 722 bp, Oryza sativa
cgtattacggtgtcatcgacaacatttgggaactagagtatggacccctgaaggtccctctgtttcggtgccaatgggttaggctgactggtggaggcataacgattgatgacagcgggatgacaatggttgacctaaacaaggtaggatactcagatgaaccattcgttctagccaatgatgtaacgcaagttttttacgtgaaggacatggatagcaaaccaaagaaggggaaagggcccgatgagccaagacgccatgttgttctctgtcacacccagaaatttagcccaaattttcagacctttttgtgtattaaatccctgtccaggaccagccagtgtacacaaaacgacaagtaatatacagttccaaacgtaaataaagcgtaaaatacttacagaagaggcacttagtcctcacaccgaaacaaaagcagcagcagcagaaaaagacgatcctagcggggcttcagctccactccacaggcaaaactcaactggggtctgagccttggtcttctaacctcgtcttcagctcagaagcactacacttctgaaaagggggaataatagcaagactgagtacaaccaccgtactcagcaagcctcaccaacaatgcagacgtgcaaggggacacaaggacggtttgtggctatttgcataaaggcagttgtaaaacattttattgagcaaacactaaaactgttgagtaattaagg

SEQ ID NO: 89894 - DNA, 828 bp, Oryza sativa
  unsure (1)..(828): unsure at all n locations
taagaagcactgttggagaacccttttgtagtcccggttcgtaacccccctttaggtccgggttttaaaaccgggacctaaagatcgctatcttaagtccggggtgaaataccgggaactaaagatcgatctttagtcccggttggtctgtttgtatgcatcgatatgaccttttgttttgcatgaccctgtggctgcatggtttatatatataatacatataacccatgcatatatatgttccagtacatatatgcatatataatatatgcatatatatatataatatatatatatatatgtatatatacatatgtacatgcataatatatatgtatatatgtatatatatatatatatatatgaccaaaatatatttacattatagaaaatgtgtacacatgcatatagaaacatatgtagtcatgtattaattacaatccattatatgtcctagctagctatgatttcgacgtagtagtagtcgctagctcagaagctaaggacctatgaattgtgtttccgtcgtagtagaattcacccttgggatcaagaatttgttcgttgatgaattccatgagttgttcttgaaccgccgcgataaattccttgggtgtggtcaggttatccctcatgcgaataaactatatgaatgtatgaaattgattagtaattaaacaagaaatcgatacgtaatgaaattttgaatttatttgtacgtacatttagctctcttgtggtgatgatttggtctgcaaggcagtggcaatactcgcacacgtaatagccacacaagttatgatgngctactgcacatctcatggtcat

SEQ ID NO: 89895 - DNA, 831 bp, Oryza sativa
ggtcaccgacatgccattgtgtctgtatgttgtcaatctggcactggaggttattatatcagaatactgggcgtttgaggagttaattctgtttgcttgagtagtcatccgaaaactggggaatctcgcataaatattggttggaaactgccaaatgtgactggtatcatacaattgtttataggcatgcccttttaattatgtttctattaacttggcttgtaaagtccattacttgcatagcatggaccatggaactgatacgttatgctcggtctctatttgttggtacgattcaggtctgggatattctaacacgcaagttgaaacaagatttgccagggcacgcagatgaggtacatgcatgcatattttggaacaataaaaatctgaattgaaattattatagtgtagtaacaaagattatgtatatatatataaatgtaaggtgtacgctgtggattggagccctgacggcgagaaggttgcatctggaggcaaggacagggtcctcaagctatggatgaactagttcccttagagtaaggtacttagctagtaacttcttgtcatggtggctctctcttgttcttggtgaagagatttgtagggttgggttggcttttcttggttttattttgcaaccaaaggcttgagggtatatatgcgggtgttttttagaaaaagggatataaaaattccggtttttgttaaaaaagaacttcaagccattatttccaaaggtccacttccaaagagagtgttgttaaagaaaagttgtacccccaaataagaaaagaattacccaactgggaaaacaaaacaaattgg

SEQ ID NO: 89896 - DNA, 1923 bp, Oryza sativa
tggcgcgtcgccggctatcacccacgatccagcctcactgctcgacttgagtttttcgtttcaatttgttatcaataatcaatatatattagattgatttctaatctcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtctacgacttcaccaccggcttgccaccgtcacggccgactggtgtctccgcctacacggctggcctattatgccgccgttgttgggcgtctacgacttcacagtcggcttgcctccgtagccgccgactggtgatctcgcctatacggttggttggtcacaccgctgttcatgggcgtccacgtcttcaccgaccgaccgccacgtctgccgccgactggtgctttcgccttcacagctggcctattatgccgctgttgatgggcgtctacgtcatcaccaccggcctacctccgtcgccgccgactggtgtccccgcctatacggtcggttggtcacaccaccgctgttaatgggcttcatcatctacaccactggcttggttccactggcgccgactggtgtttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaacaattgcaaaagtacccgagtagtaaactctgatccgtgaaactttgttccattaatgacgaactcatgtcactcatatgcatgtttgggaagtgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtctttaccgaccggcttgccttcgccgccgccgactggtgtttccgctaggggtggatatcgagccagctcggctcggctcggctcggctcggtaaagctcgttaggataacgagctggctcggctcggctcgttatcctaacgagctaaaaacccagctcggctcggctcgtttaaaagctcgagctagctcgttaagctcgcgagccaaaccatccaaaaactgcccctagccctcagcaacagccaacaccgcaagcagccaagc

SEQ ID NO: 89897 - DNA, 2129 bp, Oryza sativa
ccctcagcaacagccaacacagcaagcagccaagcatgcaatgatagtatgataaatggttacatgaaaatatcaaagcaacaaatcacattcacatataagtaatctactcaaagtcttggattaaacacatttcacaagtacataaacgtccacactccagtactccacagtcacaatgacacattctgagttactgacatagtgacatacatcatcagttcatcacatattgcaattaacttcaaaatagttcaacaaaagactgtaattaaacataggttcagtccagtacaataatccatgcttcaagttcaatagttcaatacttcaatacaccaatatttagcataagtgcataactagtaaagctgcagcctgcaaggttcatcattttcatgatttcatccaacacagttgcacataaacacaaaacacaaatagcatggcaattggcagctccctttctcccatagtcccacactccctttctcccatagggtgtaggcttgtagcctgcaggtaaacaaattatagagtatgatataaatgggtgaaagtcataaacttattaaataaatataaattgtccctactagttgcttgccaccacacaattggggaagtccactatttcgatgtcatcatctccattttctccctatgaaaacagtccaaagtgaacattttatacaaaagacttgacaaaaataaagaataaaaaataatcattgcattccataccacagggataggtgcactattgtcattttgagaggctcttatccagcttgaagcacaaaccaaagcctgaactgtttctggcttcaaagaactccggtagtcatcaagaattcttcccccggtactaaaagtggactctgatgacacactgctagctggaacagccaagaacctctttgccatgttggacacaacaggaaacctatgggcatttaccttccaataattgagtaagttgaaagtgctatcttcgagggacacatttggttcatctagatagatgagtaactcagactttgaggattctttagcatttgactgcaaaaaggattgaaatccacttggaataattgaagccaatgaggtggtagtagagattgaggatgaggccgagtgaccattgtgtggactgttcccaccttggttgtggcgacatatccgctcatactttctgtagagtttttccatctcatcagttatggcagcaacctctgttacacaccttgtctcaccaaaaaattcactgaagcaccatctaatgtacctcattttgaacctagggtcaaggattgtagcaatgatcatgatattgtttgtgttctcccaatatttattgaatttttccaacattgcatcagccatagtcaccagcaatacatcattagggtcaggttcataaagtccagactgctgccctaaccttgcagcttctaacagtgcagtttgtgcttgtgctctagaagctaatattgcaatcttaactttagctatgtatggatagaaaacattggcagtggggtaggttgaccctgaaaatgcagtggttgcaccagacattgttcccaagattggctgaattttctcaaacaaatcccattcagattgtaaaggtagccattcatatttggtgtctgattcagcataataatcaaaaccatttctatactcaatgcatgtctctagcatccgataggtcgaactccaccttgttttaacatcaatagacaaccctctaccaactttaattgaataagtgttgcacacacccacaaacttatacatacgggctggagacttcttaaagtacttcacagtgttcctaacattggttatcaaagattgaatttgttgcaggccatcattaacaaccaaattaactatgtgggcagcacaacgaacatggaaataatctggatcaaactgagcattctttctagcagcaagcttagacttcaaatttgaaacagcggtgtcattgtttgaagcattatcaagggttattgtcatgacctgtcctctattttccaatcaaccaagcaatcaaaaatagcttgagctatgacaataccggtgtgaggaggcctccacctaaacaaatttaagac

SEQ ID NO: 89898 - DNA, 555 bp, Oryza sativa
cctcgggcctccgccgcttccgcgcgagcaccctccgcacgcaggacggccagaggttcgcggagacccgcctcgcctccatccctcgccgccccgccccccgccccaccccacctcgccgccgacgagcaaggctcagacgcgggtgggcatctcgccggaaatcgaatgggggttagggttcgaggcctcggctcgcgcggagtcgagctggcgcctcctcggtctcgtgctacactgtggttgccatcgaagtggagtagtaggtgtgcttcttttaatttggagtacagtgaaaccgagagcctaaatggaaaattaccttcgccgtacaatgtccgtccgacggtatggattccataccatggaagggctttttcgatgggtgagataaataaaatgaaatgtaaggtctttttccgaaaactcgtgtcatgcctcgatcttagccgcatatcgttcgtctgacggacaatgttagccatcaggaatacttgcaagttgaaggaatagaaaccttttgcactgttgaccatctttgtagaataagcgaaa

SEQ ID NO: 89899 - DNA, 1446 bp, Oryza sativa
attcacggcgtgcatgcgatggcgatgaattcaccggcgttgtcagcgtaggccggggtggtgctcgggccgtcggtgatgggcaggtggaagtctgggcgaccatggtgttcccgcagcgcagcctgctgacgctggagacggtggcgcacctcggctgctctacttcctgttcctggtcgggctggagatggacctggacgtgatccggcggtcggggaagaaggcgctgttcgtcgccgtggccggcatggcgctgcccttctgcatcggcatcgccacgtccttcatcttccggcaccaggtgtcccggaacgtgcaccagacctccttcctgctcttcctcggcgtcgcgctctccgtcacggcgttcccggtgctcgcccgcatcctcgccgagatcaagctgctcaacacggagctcgggcggatcgccatgtcggccgccatcgtcaacgacatgtgcgcgtggatcctgctcgcgctcgccatcgccatctcggaggtgaacagcaccgcgctgtcgtcgctgtgggtgctcctcgccggcgtgctcttcgtgctcttctgcttctacgtcgtgcgccccgggatgtggtggctcatccgccgcatccccgagggcgaggtcgtcagcgacatgcaggtctccctcatcctcaccggcgtcatgctcgccggcgtgtgcaccgacgccattggcatccactcggtcttcggcgccttcgtctacgggcttgtcatcccgggcgggcagctcggcgtggcgctcatcgagaagctcgaggacttcgtcacgggtctcctcctcccgctcttcttcgccatcagtggcctccgcaccaacatctccaagatacgcgaccccatcaccgtcggcctgctcgtcctcgtgttcaccatggccagctttgccaagatcatgggcaccatcatcatcgccgcgctctacaccatgccgttccgcgagggcatcgcgctcggcttcctcatgaacaccaggggtctcgtcgagatgatcgtgctcaacatcggacgtgacaaggaggtacaaaacacatactagtatttgacacacgttgatctcctcctcttctaagctccgtaatggccgccaatggcgttcgttgtaggtgttggacgacgagtcgttcgcggtgatggtgctggtgtcggtggcgatgacgacgctggtgacgccggtggtgacgggggtgtaccggccgtcgcggcggctggtcgggtacaagcggcggaacctgcagcgcatcaggcacgacagcgagctccgcatgctgatctgcgtgcacaccacccgcaacgtgccgtcggtgctctcgctgctggagctctccaaccccaccaagcgctccccgatcttcatctacgcgctccacctcgtcgagctcaccggccgcgcctccaacatgctcgccggcgccgccg

SEQ ID NO: 89900 - DNA, 738 bp, Oryza sativa
caacagttgcaatcaggccgaaaggtttgttttgaaagtatgctattcagcttttgcattttagcagaacttctgttcacctatagggaagcatttcacaaagtgcattgaagaaaagcctatgaactgctcaccattagtttcccatcaaacacaggcaaggtgtatagaaaacatgcagctctcctaaccattgaccaaatatattcgaagttttgggggcatagcacttcaaatcaatttttttaaaaaaatctcttccaatgaataaaaaggcaaagcataatttaggttgtacaaatgtgaaacttaatcatgatcagcaagcaagaaagattcccttacctgatctttatttcttgaacattcttatcagatattgtatacaacaaagtgtagtttttcaagtcaaacaccttgtaagtactggttggaatgagaaaggaatgtcacaattcgaatgaggttaatcttctcgccttcaaagaaattagagctagaatacctgtcttgggcagaataagtcagcaccttcccgttaacatcatcaaattccacaaaacctggccatttcaaggactctgtctcgaaaagagggaaaccagcatctggcttcccccgtcgtatataccttaaaagacaaaataataaaaagattcatataaacaatataacactaccgtagcagaatcacaggaagacaagcttactctattcgagttgtcctgcatcttaagg

SEQ ID NO: 89901 - DNA, 835 bp, Oryza sativa
cctttagctgatggttctatggttgtgcattctactgagtatgatcatgatcacactaaacttttgattggccgtatgataattctacatgattacccatttagaattgttgagcataaagggtttaatgccttgatgaagtggatgaatcctagctatgaattcattggtcgcaaggccataaaaagtgaatgcatgaaattgtatgaatctgaaaaggaacatctcaggaaaagtcttagggaggctgagaccataagtttaactacagatatgtggacatcaaatcaaaaccttcagtatatgtgtttggtggctcattacatagatgttaattgggttttgcaatgccgtgtcctaaactttgttgaggtggagcctcctcacaccggtattgtcatagctcaagctatttttgattgcttggttgattggaaaatagaggacaaggtcatgacaataacccttgataatgcttcaaacaatgacaccgctgtttcaaatttgaagtctaagcttgctgctagaaagaatgctcagtttgatccagattatttccatgttcgttgtgctgcccacatagttaatttggttgttaatgatggcctgcaacaaattcaatctttgataaccaatgttaggaacactgtgaagtactttaagaagtctccagcccgtatgtataagtttgtgggtgtgtgcaacacttattcaattaaagttggtagagggttgtctattgatgttaaaacaaggtggagttcgacctatcggatgctagagacatgcattgagtatagaaatggttttgattattatgctgggggatcccaaa

SEQ ID NO: 89902 - DNA, 640 bp, Oryza sativa
ccacccaaatttaaaaggcagtaaatctatcatcacttcactaataaataaacacacgggcaacacaagtttgattattaccattttcttctgaagaaggatcatttggatcagccttgcagtaagaaataataagatcttggttgctggtgatgtaaatactgttggtattgcaatcagggtgccacaacatatggtcctcaaaagatgtgactaattcaccacggaaattccaaacggatactgatctactacggaaggtcaggaacagctgcatctcatacagaaagataaacgcagaaggagtcacaaattcacttctgcttacttcaattgattggaagtttcttacctgcagcattgcacaaaaattaactacaattctacaaataaagagaggaaactgtgttgtttcatttgctgttatccataatctataccaagaaaaaaacttacatcaagaatttgaaggttctccccttcctgtttgatcagaagtttttcattgaattgctcaatgaaatcaacttttttattgcgatgaagaaggtgttgaatgacttcaagcgtttaccatcttcaatagaaagaatgtcaaggggaatacagcccttttttcttgagtatatcaatagcatta

SEQ ID NO: 89903 - DNA, 541 bp, Oryza sativa
agacaacaaaataaactcctcctccacgttccgtggaggagtaacaagcagctactacaatcacacagcttaagctataggaacgtacacatatcaaatcatcagaagcctacggtgccaccaccggaccatctgctgttggccgtcgacgctgccgaggtccggtacgccgcggacggccgctggtttgcgttgctcacgtactggcgcaccggatcggcgttcccggcaggcgcggtggtggcaggcgcgggcgccgccgcggccaccacgtactgctgcaccaccagcaccgacaccgacatcgagaagtccgacgacacgagcatgtcgccgatgggccccagctccgggcactccatccagtcctccagcgacgccgtcatcggcgagccggcctccccggggcgcctcccgacgatgtacagctcgtggaggctgtcgtccatgttccggatggccgacaccgtctcctcgctgttggccaccaccttgtcggagtacgagatggcgtcgttgccgatgttgcgcgtcctgaagt

SEQ ID NO: 89904 - DNA, 1027 bp, Oryza sativa
ctcttttgtcattctatagaaagatatcattcttgtgaatgctgtcgctgttgcacctatagctcaactgtacatgataagggcatcatgtgtaaactatgatcttttttataaaaggtgaactgaatgtcatcacatgcaaatgtttatgtatctttctcaaaacatgatactagctggatcagctatttgaatatgaaagtaacgtgatagacttcctgaggaagtaaatgtgattcttctcgtcatttgtatgtgattttattcccctgatattgttcttgtcaagggtatttaagtccgtcttttatctttggtatcacacagctttcggttggtttctcatgtaatttatatctgttgacgttcaatccatatttacagtattaatctgaatcatgttactatatattttcatttttctgatgtaaaagttgctgtgtcagcttctcttcgctgaatgggaaatgaatcaccacttgataggaagacattaggataacttgcgtgtattacctggacaaggacaagactttcatcacctctaaaagatgcttcgtaatgcaagaaatgtatttacaaaggcttatatacctcaatgggaataataaagaactacatgcgtattagtgctattggagaagggcataaatcttacctaccaatgggaatagatacaacagaaagaatagccagcacaaaaattggaccaaatcacactatttgattccatcaaaatccttgaacctgactgaaactttgtctgatgtcgatgagcttccaattataaccaaaaatttgtctccaaattggttggtgtcactgcaactgccgctgtttggagatctgcttaagcccagcttccaggtcttccaatgtgattgtgatcatagtattcgcatagtcgcagttgaaatcaagacgtagatctagattctcacaggcattgatgagcagcgtgtctacaaggccaccattcatctgtttacgccgctgttcagttgtctccctggcaaacagctctcca

SEQ ID NO: 89905 - DNA, 1697 bp, Oryza sativa
tctacaaggccaccattcatctgtttacgccgctgttcagttgtctccctggcaatcagctctccaacgacctcgatgctgcagcttgggtccagcttgaacccatacagcaaactgctctcagttgggttattcatcttcagatgtaagatctctgctaattctgttgtggtgaaatcgtcaaaataaaagaactttgtgaccctcctacagaagccgtcgttggaggcgatgacgcgcttcattggctcacagtatccagcaaatatcacaactatcttgccattgtccattacagacattatctcctccaaggcctccacaccgtaatccttatcatcagatttttgcatcggtatcaacctgtaagcttcatccacaaacagaattccaccctcagcatcctgtatctgtagaatgtatacacattatgatgtataagttaattaagtagagcaatgacaaatttaatcataataactccaaagtcaaatctacccatgtatttatccaatgtccctaaaacctactccctccgtcccaaaatatagcaacctaggaccggattagacacaatctagtactacgaatctggacaaagttactatattttgggatggagggagtatttatttccagatttaacaattttttttcttttccactttatctcaaattgataattgagaaaccaagtcttctgacaaaagcaagtatttgcaaaacataagaatccaaatactaaggaccagtgtaagaaataagtaatagtttgcataactagtaataacagataaatagttggagctttaatactccgatttccatttttaaggatagagtttgtatagtcacacgggaacaaaattcagaactcaattgaacagagaacatagctacctttcgcctagtttttggtccagtgtgccccacaaattctccaacaagatcagttcgctgtacttcagtaactttgtcggtagggagaaccccaaccatatgaagaagctttccaagaatccgagcaaccattgttttacctacattagaggttgcaatattatatagctggctttagcacctaaactacaaacacttgaatgatttgtatggccttgtttattgttttaaaacttgtttacccaagctttgggagaaatgctttcagcatgcatcaaagcaagaatcacatgcaagaagttcaccaagcatacatatttcttaattgtactgttccaataaaattcatcggtgcacaaaatagtaattatgaccgtaataccatgatgataaatcatgcttttgattatcaaactgaacataattgtggtacctgttcctggattgccaagaaatgccatatggggagcccttctgctagcaatccctaagcccatagctcgtcgtttctcatcaaaaagcattcccctggcccatctacgcaattgcatttgaggtcctgtaatcctacaatttgtgatattgcttcttcaaactccgccattgcttttccttcacggcatgacatgagggctttccgttttctttgctcttccatatggcgagtgaggagtttctgcagcttttcattaccagctcctccaggaatatgattcgaagggattttgcctactgaaggggcaatgtgtgatgagaacaagattcagtacactaaagttgttgtaaagaaagcattt

SEQ ID NO: 89906 - DNA, 1341 bp, Oryza sativa
atttacctatgtttagcaaatctgtggcgacggcgcagtgcagaggccggtgtcttggccattcacaaatcacaattacttgaagcacaaagaaaccacactaaattatcgcctttaattgttcagaaacgtagtattcactccagagtaaaattcatttaccatatcccctatcagatgaaaacttttggaccgtttggtcacttacctgaattctccaggctctcaccaagtggatcatggattcagaaggcaactgcaataaaatcagagaaaagctctaacctccacaacatttatacttcgtagtttttcagtctcttaccaaatactgtgtactatatatagctagtcagttctattacaggacgacacttgacacgacacgaggactctgaaaaactcaagtccgttcacttgggacatcacatttttatacgtagctgagctgacaaagcagtaagaagtagttttcacttggacatggcgccattggagtggttgtcccagccccaggcgtcacccacctcgccaccgccgggcatctgcacctgctccggcggggacagcccggtgaaggggtcgtcgccggcgtagtccagcccggtgagcacgtcggggacgcggcacgccccctgccgggggttcagcgccggcgacagcccgcccaggtggccgaggccgcacgacagcgccccccgcgccaccatgtcctccgccatcttcacctgtacaaaactcggggacagcttcagagttcagaaacagccgaaatgcgtgatgccgatgtgatgatgatcaaataataatgcaatgcagtgtgcagagatgaaatgcatgatcaccttgacccggagggcctccacgtctgatttgaggattctgttgtccgtgaccgccgtcgtgaattgctgattggcatctgtcaactgcttgaaaagcgatgcgttttcgccccggagctggtcaacctgatgaacgagcacacgaattttgaaatctgaataaacccatagaccatcactcaaaattacagtaccaattggcacaatattttgttactcaatctgatatatggatggcgctgtttgaatttttaacattagcaaaggcgcaacgggtacaaatcaactcagtttacctgcgtctcgagatcagctaagtgagcttgctttctcttccttgatcgacgagcagactcccggttggaaaccatcctgtaatttgaagccagcaaccgtttcatgcaagttctttgtcaaatattccttctgaaaagtaatgtttacttctactactagcgaatacgcccataattttcatgccgtgacagacataatg

SEQ ID NO: 89907 - DNA, 825 bp, Oryza sativa
aatagtcaatttaataaacaatcatctcatcaatattcctgactcaatgattagtgaatagcagtttaattataagtagaaatgatacataggtttgaatgtgacatatataatctatctatttgacggagcttggggctcctcaccgggagaccgcgcaggcctccctttgccggttcggccgggggccctgggtgaggttctaagctcctagcctgtggaaagttcgcgagagtggaaacacacaagacacgggcgatgtatataggttcgggccgctgagaagcgtaataccctactcctgtgttttggtggatctgtgtatgaagaagctacaaagtgcgagccagcccccgatcgttctgggatcgtttttttccttctaagtgggcaaggtcctccttttatatctcaaggggataccacatgcaccatctctccctttctttcttttgtgtggggactcatcctctcttccctccaacttcacttctcttcattaatggacggagatttgtatggctgccgtccgaatgaccttctcatgggacggcccatacctacctccacttccgccggaagcaggcgcgacgtgggaacatggctgtctgctgacgacatgaccattgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcat

SEQ ID NO: 89908 - DNA, 5292 bp, Oryza sativa
ctttactcgcagggggatgggacgcggaacgcggcgctgagcacggcgctgttcaacgacggcgcgtcgtgcgggcagtgctacaagatcgcctgcgaccgcaagagggcaccgcagtggtgcaggcccggcgtcacggtcaccatcaccgccaccaacttctgcccgcccaactgggacctccccagcgacaacggcggctggtgcaaccctccacggccgcacttcgatatggcgcagccggcctgggagaagatcggtatttaccgtgccggcatcatccccgtcatctaccaaaggtacataattaacctacaccggacaaacacaaatcgtatttgtttttgatattgcacacctatatgacaatatataagacatatttgtaacatgtattttgtgatgtttttcagggttccatgtgtaaagaagggtggtgtgcggttcaccatcaacgggcatgactacttcaatctcgttcttgtgaccaacgttgcaaccaccggcttgatcaagtcgatggatgtgatgggctccaactcaaccgactggctgccaatggtgagaaactggggtgcaaattggcactcgttatcgtatctcactggacagatgctttcctttagggtgaccaacatggacggccagacgcttgtcttcagaaacattgtgccgtcaggatggaagttcgggcaaacatttgcaagcaaactgcagttcaagtgatcatcctgaattgattgggtttctactgcctgactgattatttatgatggacatttgcacagtgtatatatacacgttgtaaggactattgaattgtgcttctgtgcactattgcacatatgattttttttattttttattttttattgtttatacctgatttattggtgtatatatttatgtctttatcccatatgtatgggtgggtacttgtatatacaaagatgtttatgctcttcattgaatcaaaacatattcagattaatttttattacacttgtatcaacttcaactaaagttatataaaattgtaaatatcttataagagagggagtcatcctcctatccctctctcccccactttcacgtaaaaaattcttcctttccgtaaaaactgttcatcctgaaaatagatttctcataaaaccgaccatggtgtagaaaaccgaacaggtcacctctctgaataatttcactaaactaaataagaaaaacagttgcaacgcgggcctataatcagtagagggaaacgtcggatttactaggccaccaagccttagcacaactaaaagatggggtggaatggcagatgagctctcctagcataacacagcagctaaaacgattgctagcacaactatgcattgtaacaagtgaggcgcctgctgtgtgtccacgttcaacagatttgtcacaagaattgttcacacaaggaagcataccagccatgtgactctgaggcaaagatgatgttggaaatatggtcgcaatttggcatattttaatccaaatcattaagacaataagcatgacatttttagggaataaactagtgtgaatactaatcaagagcaacatacaaatcatgcttaatatagaataagcataaacattcatcacatggcattgttataaaaacattacgcttaatagtagtatatcagaaattagcgtgttgggaatagagacatactctaaaaatggtccttcgctggagtgtgaggcatagttgcctccgttgatggagccgttccctgcaccgcctcctccattgctgacatctcctccagctgcaccgttggcgttgtcgtctgtcgacatgttggcgttgatgaataggaaccaggaactcagacccaggaactcagacggaagaacgctccgcaaaaactttattgcccgcctacccgtgcaggaactcagacggacagagtttcggaggctctactcgtcccaatctcttttgcacgtaagagatcaaagctagggacgacggaagccacggcctcggcccagccaacgcgtgcgcgcgcacgtggtagtccgcccaccttctcaaccggtcaatagagagtcataattgtctctctatttaagatgagatctctccactaaaatttttaagatggtattattatcactaacattaattataggcctagggaatttaattgaattaaatcggacctgtcccttttattcaacagatgaatcgcgtggtttcaaggagtattcatgtttggcaacatcatgtgcatgatttggatgagcggtcaagatgacccatgtatacacccatttcgtttgatctctgtattttcagacggaattgctggtggggacgatttctgacgcattcatagtgagcaattacaccttaatcttgtttttcattaatagaaatggcacatgaacccttgtaaaataataattatgtgacttattttatccacatcaaatgttcaatggtacaaagcattgtaattagagtagtactatacatccgactgagccatacgactctcatacgactgcaccaaaccaaccaatcacatgagttcataaatattcacgtgggcccaatcaaaacaagttaaaatctgttatgtgcagtcgtatgcaggtcatacagacacagtcgtacgtacagtcattccgttgtaattaatctcgttctatattctatactcttgcaaaatttcgggtctatcagcccaccccccattcccaagtacgaaattatttaacccgaacttttttttatttttcattttttatgaatttagccattgtgttaaaatattcaaataatttaggatcaaaattaccgaaattttagtcggtacccccatacaactagcaaaaaagggatttagaaaacattgaaggctgaatacacaaaatatattggacaaagcaataccaaattgttacgagttttctaatcagagtggcgcagcggaagcgtggtgggcccataacccacaggtcccaggatcgaaacctggctctgataattttttccataatttttggcgctacgcaatttcatttaatccttttttttggctcaatttcatttaattcattttttggcgcagtttcatttaattcatttttggcgctacgacgatttcttttaaattgattttttggcgcgatttcctttaattcattttttggcgctacgacgattttgtttaattcatttttggcgctacaacgatttcttttaaattcggttgaatttttgggtcgattgttttgtcaagatttccattaattcaatttttggcgctacgacttttttggtcgattgttttgtcacgatttactttaattcattttttggcgttacgacaatatcttttaaattgggtcgaattttcgggtcgattgttttgtcacgatttcttcaattcattttttggcgcgatttcctttagttcattattggctctacgatgatttcttttaaattgggtcgattcttttgtcatgatttcctttagtttatttttggagcgatttcctttaattcatttttggtgctacgacgatttcttttgaattgtcttttttggcgctacgacgatttcctttaaactagaaaggtagcacacacacatgcgtgggcatcttatttaatgtgtttaaaattttattaccaacgtttatttgtgggtgattattattgaaatactttttgactatattctaatttgctagggattactttgaatgtcactccctccgtttcacaatggaagttattctagtatttcccacatttatattgatgttaatgaatctagacatatatatttatctagattcattaacatccatatgaatgtggaaaatgctagaatgacttacattatgaaacagagaaagtagttatgattttcttgtagttacccatgcaacatataaattctaaactaaaattacatcaatccgtatagttttgaatttatgagaaagtatatggtgtcacaacaattgagttggtttctataaattatactatatacatttgcactatgtatctttcttttgttaatatttagcatattttttacattaaataacattttttcttgtctaccatagattcaattttttcccataatataagtgaatctaaagtacaattgttctatccaaccaccgttcatttaatgtacgccgtgactgaccccctcccgtcttgcccacgttggtcgctcctcaccgtgacagagagatcgatggggaaggaagaagataagcgagagtgaaagaaagatgatgaatctgacaggtgggtcccacgtgtagatgaggaggaagatagaaaacgtaacgacgatggcactctaattttgtaaaatttgagtggacagctatgaatagacaaattgtaatgatatttatctgaataggcatttttcaatggcacgaatcaaattaacacttacttaataagcgggtatcatagtaattttccttcctcgttagcaacaatgttgagcaccctacgatatcttgctactacaggtgaaataactcaaatattttttttcaatttgttaacacacttggatgaattttaaatctaataatttctccaattgattatatgctttaatgattcaataaatacataggttatattccaatgagattagccgtgattatctttgattatatgtagggtgtatgttatggatttttttcaatttttttcatattgtcatatacatgttttttcaatttaaaaaagttacgatgctgctttattttatttcatgagattgacctattctgttgtttgtgtttaatctatattgcaagttaactttcttctttaccacttgacagcatagatttaccgaatctcgaatagtcaatttaataaacaatcatctcatcaatattcctgactcaatgattagtgaatagcagtttaattataagtagaaatgatacataggtttgaatgtgacatatataatctatctatttgacggagcttggggctcctcaccgggagaccgcgcaggcctccctttgccggttcggccgggggccctgggtgaggttctaagctcctagcctgtggaaagttcgcgagagtggaaacacacaagacacgggcgatgtatataggttcgggccgctgagaagcgtaataccctactcctgtgttttggtggatctgtgtatgaagaagctacaaagtgcgagccagcccccgatcgttctgggatcgtttttttccttctaagtgggcaaggtcct

SEQ ID NO: 89909 - DNA, 759 bp, Oryza sativa
gtaccctagatcactcaagagatcagagctcctgaatcccatggatttaacattttcattttttttactccacaacagcttgctagaagcctcgaatagtgatagaattcggatgccgatgcacgtagtaataattatccatcgactaattcggctgtcaaagttctacaaataatcagtatactgtcctacttatttaccacaagcacgaaggcaagcgtctctgatgaggcgcatctcgtcggcggcgacgctcatggccatcctctcgtagggagctcgccgggagcagctgagcccgaccctaatggcggatgccaagcaatcgcgcaccgtgacgcgcgcctcgctctcctcctccgacgtcgtcgacgacgctgctccgtcgagctcctcggcctgcagcagcagggccacgtcgaggatctcctcgatgttgtccgggaacgcgccggcgacgaactccggcagcgtcaggccgtcgcggagctcgccgtccgtcggcgccttcccggagaagatctcgaggagggttatcccgaagctgtacacgtcgccggaggccgtgaccatccccgtcgtgccgtactccggcgcgacgtacccaatcgtgccgcgtatgccgatggtgctctcggtgttcgccgccgcggcgccatggctggccggatcaagaagcagcttggcgaggccgaagtcgccgatgcaggccgtcatgtcctcgccgaggagaacgttgctcggcttcagatcgcagtg

SEQ ID NO: 89910 - DNA, 784 bp, Oryza sativa
aatgaatttttggtgttcatcggtttgcaaataattgagctttgctaatggacaatcacctattagcttgagatcctttgccttattcagcacatcagttgaaaatttagagctcggaaaaggtgtgtttgggcagttctgtcgaaattgatcagagtatatgcgtgcttcagtgactatctggttgatctcggatactggtggtggttgctttacataggaacacttataggacatatgaacagaagatgactccatcagatcaacagaacaacagacaagtacttttgtacctttggaccttggaactgcacaaaggtaacaaccagctacactcagggcagcctgcatgagattcaagcagaactgaatgaaccatgaaggatcttattttgctaaagtacagaattacccaatagtacttttcctatagagagatcatgatgagtattaacatagcatgtgctgtagaagaacatgatgagtatcttatgcaaaaaaagatatattgttggaggtcttgggttatatcttttgcacaagtgtacagcagcttttgaatgcgaacttatgtagtaccaagagatgctatggataatcaatattgaaattggagaaaatactgtcataagcttaaaatgtttgtgaatgaaaactattgttgaagtattcggagatgagtacttgagatctccaaatgataatggcatagatagattacttccaattggagagtagagaggttttccaggaatgctagggagcattgattgtatcaatgatt

SEQ ID NO: 89911 - DNA, 1447 bp, Oryza sativa
gtcaaccctctcaccggccgcgccgccgcctgcgccgtcgacgacccgtatctctcggactggattgataacgagggctcccgctgcatcttctccggcgacggcaccctccttacgtgctgcttctacgacgcagggccacccttatctatctacggtgccatttggtgccccgattaccaacaggtatggaaaagactcggcgacgccgacagtgacgaacgcgcctgcgccgtcgcctaccacgacggcgccgccgtgtgcgtggacttggcgagatgctacgtccacgagatcggaggtccagcagctggggatcaaaccacgtttctgccgctgcctgatgagcccggcaaggtgcgccggcgcagctacctcttggagcttcgcggcgagctgctgctggccagcgttctacaagacgccggctgcaccgacgacgacgacgacgacgacgacgaccgcctctcggtgtccgtgcacgcgttcgatctggtggctgcccttaacgctctcgatcagctagatgcagctgtggacggcgccggcggcggcgacccgccgtcgccgtcagtgtgggagaagatggacggcgcaaccggtgaccacgtcctcttcttgggctacccgagaagcttcgccgtggaggccgcgaggtacggcggggaggtgcccggcggaagcgcctacttcgtcggaaggtcgaagccgtgccgcgtgtacaggtgcagcttcgaggacgacggcacggcggcgacgctggtggacacgctgcccgccggatggaacgacgagaggtgcatgtggttcttgcccgagccggacattgctccggtgatcggagcacggacctaggaagaagaagaagtagaagctccgcgaagcctgcggcggcggcgagacctgaggatctacgccggcgatctgccacagaagatgtatagatccaggcggcggcgagtgatgttcatcaggcactggaaggaggtgttccttgcgtgtactccaatggagatgatctacgccttatgttttgttggcctcctcttgttttttggctcactattttgtaggctgatttgcggttggtttttttagttttgctatgttttagtgtactagcaaaaggatcgtgcattgcactgcatgcataacgacatggtgaatgaagtttgaccttaacgatttatcaaaacacccaagtatatatgattactaggtgaaaccccgcaaaaaaaataacgtgtaagatagctagataacatcagattaagtaaattaatgtggtttataataatttaaatttaaatagtgtgtagaatgatgattcaaacgaaaaactaaggcggcgtgattttatggaagaagaaaagtaaggagatagtttggaccgtagattaatcatctaaaggcaaaaacaattgatgtgatatgatttaattagagg

SEQ ID NO: 89912 - DNA, 908 bp, Oryza sativa
ccttatatgttattacggaactaggccgcacgccatattttccttttacataataagcatttctttatctcttcataataattctgagattaaaatatagcattgacaagttatacctggcaccgaatctgctttgagatctatctactatgggcaaatcttttatgtaaactaccaaaacatggtctcacctatattgacacaacaaatgaacaaaacagttgtagcattttattagtgcttcataaacttagaacagaaccgccacaaagtttcacatacttgtggcattatttttttgatacacctatactatttcattagtacatcactctaaggcctcgttctccgactcatttgagaagcctgggtaggtctgttgttgatatctaggagtgaaggcaccgagctcttctcccctattattcttaaggcttcgtgcttgctccctcgatatgcggtaagcattagcgatcacatccactggcatggcacggaatattgagttcttccctgcaaggtggctcaccatggagtttgcattggtcttgaatgaaatgtattggcatccttcatgctctgctttcttcaagacaacgtagtgttgtggaatgatcagcaattgacctggacgtagaacgccattgaataccgtctttccaaggttactaacgacctgaactcgagcatgcccttgaacgatatacaccaggctatgggcattaacgttccaaaacggagagagaatagcattctgtagagagtagagaacaatattatatataaatggtggcacagataaaactatttttatagaaatataggggggagagagatggagagtgaacaaaactccactttgataaatacctggtatagatttactctagtagcactcaattgtacaa

SEQ ID NO: 89913 - DNA, 1121 bp, Oryza sativa
tctgaatatgcagagtacatccattttctgtcagtacagcacactagataaatcaagagatcagagctcctgaattccatggattttacattttcattttttttactccacaacagcttgctcgaagcctcgaatagtgatagaattcgatgccgatgacgtagtaataattatccatcgactaattcggctgtcaaagttctacaaataatcagtatactgtcctacttatttaccacaagcacgaaggcaagcgtctctgatgaggcgcatctcgtcggcggcgacgctcatggccatcctctcgtagggagctcgccgggagcagctgagcccgaccctaatggcggatgccaagcaatcgcgcaccgtgacgcgcgcctcgctctcctcctccgacgtcgtcgacgacgctgctccgtcgagctcctcggcctgcagcagcagggccacgtcgaggatctcctcgatgttgtccgggaacgcgccggcgacgaactccggcagcgtcaggccgtcgcggagctcgccgtccgtcggcgccttcccggagaagatctcgaggagggttatcccgaagctgtacacgtcgccggaggccgtgaccatccccgtcgtgccgtactccggcgcgacgtacccaatcgtgccgcgtatgccgatggtgctctcggtgttcgccgccgcggcgccatggctggccggatcaagaaggagcttggcgaggccgaagtcgccgatgcaggccgtcatgtcctcgccgaggagaacgttgctcggcttgagatcgcagtggatgatcggagggttgcagctgttgtggaggtagttgagcgcgtctgcgatgtcgacggcgacgtcgagcctctggatcacgcccaggccgccggcaccgccgcaccatttcccggtcttcgtatgctttgcacgatgcagccacctatcgaggctgtagttgggcatgaagtcgaacaccagagctctgaactcgttgccctccatgtcgatgctggagcagcaagtgacgatgttgatcaggttacggtgcttgacgctgtgcatcgcctcgcattccgccatgaacgtcttggaagctccgacttgccggaggtcgagcacct

SEQ ID NO: 89914 - DNA, 567 bp, Oryza sativa
actctggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataacccttcagtaccgcaggatacccagtatagtgaagccctaatttcacagtacctttcagatagcgcattactcgctcaagcgcacgccagtgatcatctcccggattagaggtaaatcggctcaacttgcttacagcaaaagagatatcaggcctagttgcactagccaggtacatcaacgagccaatgatttgggagtattctagttgattc

SEQ ID NO: 89915 - DNA, 660 bp, Oryza sativa
gttcatcacatcagcaaaagcctgccatacaaatgatcaaacagtagagttagtaaatatgcgcaatttgttaccaacaattgatgcttgaaggccaaacaaagttagtcctaatacagtatgaagactaaaatattgctttagaaattctgaagtttaccatacacagtatgataacccagaaaatagtaagaacaaaattccagaaggtgagaaaataaagatacaaacaacttaaaaaacacatactgcagaagaaaggtccaatcaaccagcaaagggagaattataagtaaccttgatacattggtgaatgcggaaacagttcctgcccacattattggcagggcaaagaggatcatcaatgtgtattggatcaatgctgcaaatcaagcatatggaaaaattacagaaggcaatagttgacagaaacagataaactgatacattgatatttaattttatcacctgtgacctctttctcggttcaaataaatgccactttcttggatagagatacgcatatggcgcggatcaaatacattcctgatatccagattactcactaattaaattccatcttagatgataattatattactactccaaaacgattgcaatttgcacaggataaatcgcatatgagccctatagtctttg

SEQ ID NO: 89916 - DNA, 3762 bp, Oryza sativa
catttaagatttaacagaaatttctccagaagtaaggagattcagttttcctgattaaggtttttatgttttccaacatgaaggttgatggcacaatccagaacatttcggacatagtcccagtaccatctgagttagctactcgagcaaggaaaatcatggacatgtttaatgaaatcaaagattacgctagtaaattcagtttgtctgagaatgatggagtgcggcgatctattcctgatatgcaccaagtgcggcagactagctctatggtatttgagcagagcattattggcagaggaagtatcaaggacactgtaattgaaaagatgctgtcccaaaacaaaagcagtacacctgaaagccatgtttcagtcctgggcatagttggtatgccaggagtaggcaagacaactctagcgcagcttgtgtacaacaacacagaagtatgcaaatcttttgatgtccgtgtttgggtctgtgtatcagagaacttcgatgtaaaagaaattcaggataagaggtttttgctagtattggatgacgtatggaatgaacgaagagactactgggaaatgttccgtttgccaatgttgacaacaaagctttgcaaaattatagtaactactcgaagtcagaatgttgctagattggttcaaacaatggattcctgtgaattaagctgcttagattctaatgatagctggtcattgttcaaacaaactgcccttttggatgaagaacatgcaatataatccaagtctacaagaaattggcaaggatattgtttcaaggtgtaaagggttgccgttggcaatcaagactattggaagcatgctgcgctacgaaccagatgaaactaagtggaaggatatcttagagagtgatctatgggacttagagcaatcacagaatgaggtactgccagcactggagctgagctataagcagatgcccatgtacttgaaacgatgttttattgccctctccttgtttccaaaagattacatacttcatgaagaaaatgtggttcttctgtgggagccactggagttacttcaacatggtgatggagcaaataaggcaaaacttgcagtttcatatctccatgaattagctcagaggtctatgattgaaattagtactcatagtgcatacaagatgcatgacctcatccatgatcttgcatgctttcttgctggagatgagtttgttagaactgaaggtaattcacaagttgaaatctcaccaaatgctcggtatttgtcagtagtaccaacatcaccctgggaaattagtactatcaatatttcagattcttcagattcactcaaagctatcattgtgattggtcatggacttgacgaaattgtaatcccagatgacatattcctaaagttcaaacggctgcgcgtctttagcttgaatggagctgcgcctaccaatctattaccagactcagctggcaacctaaaactcttacgctttttgaggttgagatgcagcatagattgccagatcatgcaactacctaaatcggtattccagctttttaatttacataccctagaactgatgaagccagcttttgatctgtatacaccaattgtaagtggaatcggccgactaattaagctagaaactttgcctccacttgaaatactaagtggatatgacagtaacttaagtgagctgaggaatataagaaaagtaaggagcctgagtctaaaagggctggattatgtatgtagtgttgaagatgcaatggaagctgatatcccgagtaaaattcacctccaatcactcaacttggattttacgagctcacaccatcaacaactgcagcagcataagcctggtgcagtatctcataaggaactattggagagtttgcaaccatgtcacaccctcagagatctgagtatatatggttacagaggcctgaccttcccgtgttgggttggtaacacttccttttccaagttgacaaaagtagtgttatccaagtgtgaatgggaatgccttccagcacttggtgagttgccttcccttgagtctttggagatttccagaatgtataatcttcgattcattggacgagagttttgctgcctaaatcaaagtgttaaagttttccgctcattggtcaacttgagtttttcctggatgtatgaattgtcagaatggtctggagtgaaggacggtgatttcgcttgcttagagactctcttgttatgccaggacaataaactaagatttcttccattggtgcccttctcgtccttggttacatgtaggttatcgaattgtggtaatctggtaacagttccagtatcctatgccctttgtgacctatatataaatgattgtgcaagtcttattgaacttccttctctcccatcccttattaagctgaagatatcaaactgctcaagcctaggagctacaatccctatgttcccagcccttcagtatctaagtatcaaggactgtgcgagtctacttgaacttcccactctcccatcacttatggaactgaacatatcaaattgctcaggcctgggagctacaatccctatgttcccagcccttcagtatctaagtatcaaggattgtgcgagtctacttgaacttcccactctcccatcacttatggaactgaacatatcagattgttcaggcctgggagctacaatccctatgttcccatcccttcagtatctaagtatcaagaactgtgcgagtctacttgaacttcccactctcctatcacttatggaactgaacatatcaaattgctaaggcctgggagctattattcctatgtctccaaccctttgcgagctaagtatcaacaaatgtgcaagtctacttgaacttcctacgatggaatcactttggaaactcgagatatcacactgcccaagcctacgtgcagttggtcttttcccagaactcagtgtactgaaactgtctggtccatttaaaactgaggtggttgatagttggctgagcttcaactcgccactcgaacacttggagatttattcttctccattggtgagcatcccgcttaggccccagtatttgacatcacttgctaccctcagattattattctgttatgatctgcaatactgtgatggacttgtcagtctcacctcgctcagagaactaaatgtaaaggagtgtcccaagctcaatttacatcgttcgctcccatgcaatctgcaaaagtttgagctttatggtagatagttgtcttgttacatatccacaaggctgattggtctaggcacttatttggttcatcagaatgacctttgggacacatggactaagcaggtaactatcccttattatagtgctactgaaaattttgcctactttttaaattttagtaggccgtggttaactgtttttgcttgtaacattgcaaacacacttagggccttttcgaattgctacgaatggcctaccaattttctgttagtttgaataataattatggttggtttggattgaaaccagctagttgataatagtccatgttatatttggcatcaatctagaatattcataactataatttcttgggttccatgtcagtagcaaatcaaatatgaccaaatacagtcttatcctaccagagaactggcagggggcactaccaaaatatactatccaaatagccccttaattactgtaggatcgaaacacaagaactaagccaaccaaaccctggggggggggggggggaag

SEQ ID NO: 89917 - DNA, 709 bp, Oryza sativa
catatttacttaattcaagtatagaatttaagtgtcatgcattatctcccttaaaagcaaaatctaagcctcataaaaagactagaatacatacaagttatgctagagacaaataaaacttcatagtattgctagcatgcacaagaaaataccatatgtatagaacaaagctctcttttctcaatttttcttattgtcaaattttgcttgataaaaccatgaggtacaaaactcccctcaaattatgccaaaaggatgaattatgcccaattctccacgaagaaaagcaaagcgattagaatccaaaggtttagtgaaaatatcagcaagttgcaactttgtatccaaaaacatcaattcaatgtcgcccttctcaacatgatccctcaaaaagtgaaaacgaatatcaatgtgctttgtgcgtgagtgttgaacaggattcttagcaatgttaatagcactagtattatcacaaaagagaggaactttctcaaaagtaagaccatagtctttcaaagttgaaataagccaaagaatctatgaacaacaactagtagcagcaatatattcagattcagcagttgattgagcaacactagattgtttcctagaagaccatgcaatcaatgatgtaccaagaaaatgacatgttccactagtacttttcctatcaattctacaaccagcaaaatcaacatcggaatatcca

SEQ ID NO: 89918 - DNA, 694 bp, Oryza sativa
gtatgcaacaatggccattatctgttcctctgaatctctgatgtaattaactacacgccttgacattgtgactgacatatgggacccatcacctacaggtctacttccttcgtcccaaaaataatatattctctcctattacaataaatttgaataacacctgttcagattcattgtactaaaatgtcacatccctttcaggttaagtaggtttttttaggacagagagaatatatatcaacaaccacgtttcggtgattttacataagaggccgatcccgttcatggttcctctgacggtgcaactcttgcaggacctggccctggcaatgtcgacggtgaggccgtcacgacggttcctgaacgatgccacgatgaacggggatgtcctgacggagggcaggtacggcacggtgaggcgagtgtacgtcgtggcagaggaggacgagtggaagccggcggagatccagcggctgatggtgtcgtggaaccctggcacggaggtgagggcgttgcagggagctgatcatatgcccatgttctcaaaggcgagggagctctcagaattactcatggagattgccacaaatatagttgagattttcagaagcatgttcttcagataaaacgttactggaacatatatatatttctgaaaaatggatatagataacaatgccttagactctacaaa

SEQ ID NO: 89919 - DNA, 1166 bp, Oryza sativa
catgaaactactacggcatctcactctatcaggttatgaatgtgctacacatttatcacgtcctaattctatgtctgagctatttaatttgcaaaccctggacatacaagcgtatacgttacttaaaattggacgactgattaacttgcaaactttgcctgaaatacatctcatgaaatgtggttgcttcgttgacataagagagttgaggaatatgaacaaaataaggaagttgtgtattcgtggactgcgtaatgtacctagtatcatgcatgcagatgaagctcatttacaaagtaaaaggaaccttgaggtactagagttagattttgacgaattatttcttgataaagatttcgatgaattgagaagttgtgaacatacagagcatggtgacgctaatgaagcagctgtcactcaatcgcgaggccagttacttgagaaactacgaccacactaccaaagcctcaaggtactaagaatacaaaacttgaaccatggaaactaccccagctggttgggcagtgcttctttttccaagttaactgaactgaagttacaggcttgtcaatctcaacaccttccaacacttggtgagttaccttctctcaaatcccttgatataagccgaatggagtttgtggaacacattggccatgagttttgcagccttcagcaaagattcaaagggttccaagcattacaagacttgagctttgatggtatgactcgattgtcagagtggtctggagtggaggatggtgagtttccacacttggagaccctgttattctggaattgaattgaagtctcttccatttgttccattgtcatgcttgcgtaatctcagattatatggttgcaaaaatcttgttacttttcctgcctcagctaccatgaaggaactaagcatctcgagttgtgagaaactgaaggaactgccagctctaccatcactccgttcattagacctgtcccattgtccaagcttgtttgcacttggtcacttccccttgctcacttccttgggactgtattatatattcaatgaagatatactatgcaagttggtgaattcgtacatgacactggaagacttaacaatttggtctgataccatcaagtcattcgctcttgaacccctcggcctaccatcagttcgaaag

SEQ ID NO: 89920 - DNA, 2323 bp, Oryza sativa
agctcgagacgacggcgagatacggcggcgtcggcgcggggatttgccctaggcagtggcggcgaaggagagaggccgagagagatcgatcggccgaaaacgtctaagtgttggtgaagaaaacgagggcgcaccgggaatatatatacccccgtttttttactcccggttgttcagaacaaccgggactaaagatatctttagtcccgattgttgagaacaaccgggagtaaagaaaagatctttactcccggttgattatagcactgcatatgatttttgcttacatatgtgtttataaaatacaggttaatgcattaacattatttaaagtacaaagattaatgacaattacttcgaaaaattatttttgtctgtaataaattaagtggataaatcgtaataagcaaatatatgacttataattaataaaaattccaatatatatatatatatacttagcatatatatgaatgatattattatattggtaaaaactctaattaagatatgtatgtacatactgcatgatttaaaattaataaaaattataatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatagttttaaaaattctccagtcaattataattagcatatgaatgatagtaaattaaatgttaaaaactctaattaacatatgaaattgctacttgcgtgatttaaaacttttaaaaatcctctagtcaattataattagcatatgaatcctagtgaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttaggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtactcctcgatgtaaggagctaccaatgaagagtgttgcagaacagtgaaatgggctttacggaataaattgttgtctaccgtcattattgttttccttccaagagttccctttccccgtagtctcccttcatggcgtgattcaggtaccccgattgggcgaaggtcttcgataaattctacgcaaaattcgatgaccccctctgttccataacccttggcgatgcttgcctctggacgagcacggttacgaacatacttcttcagaacgcctatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggc

SEQ ID NO: 89921 - DNA, 4922 bp, Oryza sativa
cccccccccccccccgaaattttttatttttgttttatttgtttgatatttttttcacgcttagggacacacaaaaaccaaccatagaaaaattgaactcaaatggacgtaatatgtgacctgtaaaatttttcctctcctctcatctctctccgaactagtgcaaaggagagatgtgcaacttttttatttttattttattttttgatattttttcacacttaggaactcacaggaatcaaccatgtaaaaaataaactcaaacggacgaaatatgtggcatgtggaattttccaaagttctaccgaaaaacttctctgctcgaaaacacaatcttgcaagcagaatttggaggttttaatatcgccgaactcggcaaagctggggagaatcggatgtaacattttctgtagatgtccgtgcatatattatttgcctgattccgagtccgtatgagaaagttacgcctattttaatagatgacatattttgtccgtttcggtagagttttggaaaattctacaagtaacatattttgtccgtttgagtttattttttatacggttggttcctatgttctcctaagtgtgaaaaaaatatcaaaaaaatgaaataaaaataaaaaaaattgcatctctatgtacagtttaacttatatatgtcatttcatgtggttatattttgaattagattaagtaatttcatatagtggtagagtgcattatgtttaacatgctgatcaaagggttttactaaaggaattatggtctaattttagtgaaggtgaaaagtagactaaatggtatgctagctattttcagacttagttaagtggtagttcgagtttaaattttttttgtggttggttgtatcgtgatcctaagtgtgaaaaaacatccgaaaaaataaaataaaaatgacaccgttgcaactccatacagagaaacaggaatggaggcggcggcgccagcatggctggcgccctcctcctgccacgtcggttcgcgtgcgccacggtggcaggaggacggcgccagcctctctggcaccgtcccgttggatgacggtgccagccactctggcgctcaaaaaaggaccatttctgggataagttttttcaggggtctatttgcgaaataagttttttaaaaggaccaaaatgtgaaaaatccaggtacttggcacggcgagtgtatcagctcagcccacccgaggtatgcaacaatggccattatctgttcctctgaatctctgatgtaattaactacacgccttgacattgtgactgacatatgggacccatcacctacaggtctacttccttcgtcccaaaaataatatattctctcctattacaataaatttgaataacacctgttcagattcattgtactaaaatgtcacatccctttcaggttaagtaggtttttttaggacagagagaatatatatcaacaaccacgtttcggtgattttacataagagcccgatcccgttcatggttcctctgacggtgcaactcttgcaggacctggccctggcaatgtcgacggtgaggccgtcacgacggttcctgaacgatgccacgatgaacggggatgtcctgacggagggcaggtacggcacggtgaggcgagtgtacgtcgtggcagaggaggacgagtggaagccggcggagatccagcggctgatggtgtcgtggaaccctggcacggaggtgagggcgttgcagggagctgatcatatgcccatgttctcaaaggcgagggagctctcagaattactcatggagattgccaacaaatatagttgagattttcagaagcatgttcttcagataaaacgttactggaacatatatatatttctgaaaaatggatatagataacaatgccttagactctacaaaagaaatgcaaaatcatagtgataaataattggctaacgttgttaacagtttggggttggacgttcggtgttttgaaagattgatcaagatgtttggatatgaacagtaaaccagaaccagtaatcgcaaattcagttcaaaatttcggaccccaccggcaaatcaatatattgaccgaaatattcatgttttctcaaatttttgttggagttggtcaaagtttattcaaattcagtaaaaaactatcaaaatttcagaaaatttctttccaaaaagtgctgaaaaatcctgaaatcaccgaagtttccaccgaaatcaccgaagtttctaccgaaatcaccaaagtttccaccgagatcgaaagtgtaaaccctgaccggaacattgaacagaaacaccggatcattcccagtttgaacagtaacagtgcatttcagataaaacgtcatggaaatgcatccatccatctatctatctatctatctatctatctatctatcttctattatatactaaaagtctattaaacttcctacaaacgttctcaagccactacatggacatccttcaaacactctcaatccgccacgggcgttttagtaaattaaaaaatatcaaaaatttctaaaaacataccaccattgattttcacttaaatccgtgggtctattatttatgtcattagatctattatagataacacaaaactaattaaatatatcaaaaggaaacaaactctcctcccacccctccagccatacgtgcgtacgtacattttcctccctcctcactctcccaacacttattttaactaatttttattggaaaaacaactaataatttaagatccatatctttactatctaaaaaactaaaatacattatttgaacagatcgcaacaaaacagcatccgatttttaatttatttgaacagtaatttaatttatttgtaattaattaattaaatcaacatatatatcactattttgctatataaaagttaaaatacattatttgaacataccggcaacaaccaaacaaccacgaaacattaatattagtgtcatcttaaatcattctacacaataaagatttatcgaccattctattaagtcaccacgtgtgatattttaaaactagaaaatacttcttagaaatttgagcatcgttagtttctacttaaatcgatggcctattatttttaagcactagaaacatatcatgtcttgaaaattaggggaaaaaagagaaatttgagaaaaaagtcacccgatcattagatttcacttaaatcatttaggaaaatagaaaaagaaagtcaccttcacctccctcgctcatctgcaccatctctctttggcccgaactctatgctcttcattaatcataagctatcaaagtgaaataatcaataattataagctacatgcgcgatgtctaatctaacttttattgtattataatgaaaagaaatgcaagcatatgcctatattttgctatataagaaatatgaaatttgggaacaatgacccgtgcactttgcaggtcatccaaatagtaacgaaatactataaataattatcaacacaaattacgacattatacatccaagtataaaacaatatttttttgacggacaacatccctgcccttttacatatcgtccaaataataaaataactatgaaataattcagcaacataggatgcaccatcatatattattttgtaaacataaaaactaaattaaatatacaatgcctaagaaaaatatatcaaatataaaaaatcggtgggacatataccattggccttttacatgtcatccgaattgccataaaagaattatgaaataattcaacaatacaagtggcgccaccatacgttgttttgcacacatgaatagctaaattaaaaaaaaagctttaactcaaatacaaatagtccaagtcactacataaaaaaatccagtggctttagtagtagaaaaaaaaatccaattacttcatgttttctgaaattaatgcggtcaaataatccgagtaacgaaagcgctctaaacaatctaatagatttttttaggataccatctaattgattttagatggtgtttaatgcactttggtatatctgtagatattcaagcaggtattcataataaatcacattaaaaaatgtgtgcacaattatatttagccctccatgtgtattcatgctaggctatatgaagcctcgcacgctctacataaaacattcacagataggatgtttcccacactatgcaatcatattggactctacgaattcatgcatttagtatagtctcatgttatattcaattaatagtgagaagctatatcggtcttacatcggtcttacatgcttatacaaaaggtagctcatttattttttaaaaacattgacataaaatgtgtaaagctccatcactatttaacatatcacagagtttgaacataaaataagaattgtataaaacaaaacagaaaatagaaaaaaatgccaatatgaactgcattaattgaactaagtggaaaaaatgttattatttattttgcttcattcttgtacttaaattgaaacaaccattgccataaccattgcatcattttttattaagtgcttagatattaatgatttttctctatcatacatcacggtattatgatttttctccacatattattgcaagtataagcaaaaatactaagattatagtatatagtttatttagaagttatatttataactattaatttaatttttaagggtcaagttgattagatttttctttttaaaagtagaatggatcacacatatcatagggaatcgagacctaggatgtatgtatatctcctctgtcttattcatacgtaagtaataattaaagtgcatcaatataaaccaaataaaaggagggctagctaaatggtacaaataaaacacatttgtcagcaatcatagtcttttatgatttgatagagaaaacatagct

SEQ ID NO: 89922 - DNA, 1755 bp, Oryza sativa
ctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcccccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttctgactcatgtagatggatcggcaatgtatgtacgctgaccggcggtccaaagagtttattgacggcgtgtactattttttgacagtggccgaagctaacaggcaaaggggttttatttgttgtccatgcaataagtgtaagaatcagggggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggatgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggatgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctgtctatgcatgaaaaggaagtacataatgatgccgattattattca

SEQ ID NO: 89923 - DNA, 712 bp, Oryza sativa
catcaacgagccaatgatttgggagtattctagttgattcctagcaattctcttgttcttgcgaagcaacaagctaggatcataagatgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacatacatttatctgcctcattgactgcaaagactgcagatgtcaatgttttgtcaaatttctcatgccattgcttaggagcttgtttcagaccatacaaagacttcaacaatttacacactttgccttcttgaacttcaactacaaacccatcaggctgatccatatagatctgctcatccagctcttcattaagaaaagctgtcttaacgttccatttgatgaacgagaagaccatgtgaggctgcaagggaaagtagcacacgaattgtggtcaatctagcacaggtgagtaagtgtcaaaaaaatcttcgccttctttctgagtataccccttagcaacaagccgagccttatccttt

SEQ ID NO: 89924 - DNA, 636 bp, Oryza sativa
aagaacctgacacggatcaccacacctgcatcttggacgggcttcccatgaagggagtgccgtagttagcacccgccagtcgctctgttgttcacgacattgtcgttcataagccgcttttctctttaagtattgctcagtactttcggatgcgaaataccagcgaccttcttgtaaacaagtggttaggtcaagaacgggattttctgtatcgacccactcgatgtatgcgcaagccgtagtgcggatctgccgaatagagtagtgttacgaagaaaaaagcgattgcccatacggaatgaataagcatttgcagataataaaatacctcacggtcatagttagggcacctaaaaaagcaccttcctcgaatatcaagattcctcgaagccattagttggcatcgatcaccgcataggcagagtggacgctggcaccaaggtggtagtaggtatacacaaggatcgctgcgccagtttggatcctcaacaccccggcgtcaagccattgacgaaagccggtaggatttgtagtgaagaagtggggaagagagtactgaatgtgactgagttctgaaaaattgtgaggcctcactcgttaaggcgacttatatatgcgcaaaaaatcgagtgatat

SEQ ID NO: 89925 - DNA, 1125 bp, Oryza sativa
ttagagttcactttaggatcatctagctttagatctactcgggtagtcctcttgggtgtttgaacaaatatagagatgaaagagagggtttagagaccgaccagtaaaggtggaggaggagaaagtgccggccatcgtcgttgtcgtcgcgtgcttgtcgtggacggtggcgacggtgggcttgacggtgatggcggtcgtggcagcggcggtcgtagccgccgatgacgaggcatggtgcagcggtgatgcttcccgtcactggctacgccccctcgatcggttagggttttgtgggtggagttggcggcggaaccgaacctcatatcatgtgccgccccggcctccaccctctatttatatggcgcaaggtgacgggggcccaccagtcaatgggctgggcgcccccgatcagggcgcgggtcaaggtccccttgtgtcgttgggctcaaggggagggagatctatctaatattctcccccttgatctcactatttcttttagcttttttctattccatcatagatttgcacatagagcatgtttcatcgtcacggttaatcactgttggatttgacagctactatacacatctctattcagaaacatatactttaacttttgggccctgtagtccaggattcataaggcttctcttaaacccatgccggctacatgttccttgaacacgttgggtggtaggcctttcgtgagcggatccgcgagcatcctttctattctaatgagctcgagactgattgtttgatcccggactttgtccttcacaacatagtactttatgtcaatgtgtttggcagcaccacttgactgattgttgtgagcgtacattactgcgggttcgttatcgcagtataactttagtggtttctcaatactgtcaaccacctttaaaccgggtatgaacttctttagccagttcacctgccccgtggcctcatagcatgctataaactcgacatacatagtagaccctccagtgatagtctgttttgagcttttccatgaaatagctcctcctgcaagggtgaacacgtatcccgatgttgactttgcattatcttttgcaaaatcagaatctgaataccccactatctggagcgatt

SEQ ID NO: 89926 - DNA, 2413 bp, Oryza sativa
atactttttcctccaaatctccatttagaaataccgtttttacatccatctaatgtaattccaaatcataatgtgccaccagtgccattattatcctgaaggaatctttacaagagactggagaaaatgtctcattgtaatcaatcccttctctttgcgtgaagccttttgccacaagtcgcgctttaaacttttcaatattccctctggagtcatatttggttttgtagacccatttacagcctaatgttttggctcctttaggaatctcttctaaatcccagacatcgtttagtttcattgatttcatttcatctttcatgtcttctaaccattcagatgagcgtgcgcttctcatggcctcttcatatgaggtgggatcatcctcaatatgtgactcttctatattataaacttcatagttatcacggatagccaatcttctgactctttcagaccttctaggggcctcctcatttggcacattctgtacctgagactcttgttgagcctcccgttctggcacattatctatttgaggctattgcagctcctcctctggtgtggcaataatttctgttgagtcctgtagaacaggttcctcattttcattcattgttgccacaggaggggtaacaacaggtgctggtaccgcaacgtcatgcattgcaggcacaacatcagcaggtagagagaagaaaggctcctaagtcgacgaagcgggtacagacacccgcctcttctcaagatcaatttctcgaactactgagctccccctaatcattttgtcttccaagaagacggcgtgtatcgtttagacagtagaaacgataaccctttgatctagaataaccaacataatgagattcatttacaaatgtaataatgttctcacctttctttgccatgatcattttcaggaagtcaggataatctttatagtagttccttttcttgcagtggagacactgatccttttcaactgtgaactgttgttgctgaggcagatgctgaggctgttttgcttttgaggagggtgtcttgtagttcttttccttgttatctttaacaaagttaatagagccaccattggactcttttgattcttttctcctcttgcacacaattagcgatgagcttttcaaaattccatttctttggacttattttgtagttgacaacaaagttgtcaaagtgctttggcaatgaggccataaccagatggatcagaaagtaatctaagatgcccaaatccattggcttcaacttggaagccatgttgctcatcctaagaatgtggtctcttacaccacctccatggtacctctctgtcacaagctgctttatcagctgtgtagcataaatctttgaagaaccagtaaactggctctttattattttgaggtactcaaagacggtgtcacactttgggattaagcccaatatagttggctcaattgtgttctttaccgcagccaaacatttcttgttggctaaggaccatttcgcatgctcaatgtcatacgacattatgaggggagcattgtccctctctctcttttgccagtcagcatctgactctttttcacctctgacaagtgcagcaggttctatcggatatggggtggtcaacacccagtccacctttcctaagataaaagcaaggtcgagtttttttttccattctgcgtagttatctcccttcaaggtcggaatatctttaatgcaacccataggagtagccacctgaaataatcatgtacagtgagaacaaaattaacattaaaatgttatgcattaaatctacatcaccgttaggcaaaaatagagataacacataaggccataactataacattgcaattaacaacgttggtcagaaaattacaacatcatagtacagaattaatgttcctaaaattaaattctcccgttggttcgaaatttaaatttagaaacactaatttttatcaatttcatctatttgcagcggaagatctatataaaattcatatgaacagtagcaaattatgttatttacactatgtaaaaattacacctttggttcaaaatttaaacagaggtaaggcatgcaaaatcgattaaaaaatctattgaaatttgcatgaaaatagacaaaataaaaagaaagtcgctaccgttccttttcttcattttggcccatcaaagaagtcggcccatcgccgggcgtgtgcgggcgcccccctccccccaggccggaacctgggcctgggcctgaaagcccgccgcgcgcgccttccatattgggctcaatttggcctggctgacgccggccatccaatcgctagggtttcgatcggatggccaggcggagagatcgggcggtaaaataaacccgacccccagccgcgcggcaaaaaccctagcctct

SEQ ID NO: 89927 - DNA, 650 bp, Oryza sativa
ctcgggtcggctaaaatcgccaaacggggcccagaaccgagccgtgccccggggcgtagtgaactccgggggggaatcagcaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgtggcacagacatccttgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcctcgtcgccactgtcgcccactccgccgtcatcgtcctcctcgtcggagttgaaggcgaacgcgagccgaggggtcgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtatgag

SEQ ID NO: 89928 - DNA, 705 bp, Oryza sativa
agcgcacgctcatctgaatggttagaagacatgaaagatgaaatgaaatcaatgaaactaaccgatgtctgggatttagaagagattcctaaaggagccaaaacattaggctgtaaatgggtctacaaaaccaaatatgactccagagggaatattgaaaagtttaaagcgcgacttgtggcaaaaggcttcacgcaaagagaagggattgattacaatgagacattttctccagtctcttgtaaagattccttcaggataataatggcactggtggcacattatgatttggaattacattagatggatgtaaaaacggtatttctaaatggagatttggaggaaaaagtatacatggcacaactgaaaggttttgtcgtgaaaggaaacgataatatggggtgtcgtctaaagagatgcatttatggattaaagtaagcttcgagacagtggtacttgaagtttgatgggacaataaagaaatttgggtttcaagagaatattgaggacaattgtatttatacaaagtttaagaatgggaaattcattttcctaattctgtatgtagatgacattctactggctagtagtgatatcattctactagctagtagtgatgtcagtctactgcaggaaacaaagaaattcttgtcctcaaactttgacatgaaagacctcggtgaggcttcatatgttttgggcata

SEQ ID NO: 89929 - DNA, 1386 bp, Oryza sativa
atttataattatctccgcccgatttaaaattgctatcacatttgatttatcacatataataaccaaatgtttatttacatagttcaaaattcctattaattttttaaaatcatataattgacaattgcctttctcacatatagtttaaaattcctattaattttttaaaatcatataattaacaattggctctctgacatatagtttaaaattcctattaattttttaaaaccacataattaacaaatccatttcttcaaagagttttaactggaatggcatgaaacatatgcaattcattcattaaggctccaatacaaattaaatacatcattcacagtgatatgccttccgaatggtctaaacaaacgtaagccacttcgtcttcgggatcatcgtcaaggtcgatctgaggtctgacataaagattcttgttgtattcttcttcatcgacaacgttgtccacccccacaattcttcgcttgccatccctaacgacgtgcatcttcttttttgcggggtcttttatgtagaaaatctgttcgacctgcttcgctagtacgaatggttcgtctgcgtatccaaccttggccaggtccactaatgtgaagccttccttgtcgaccatgacacctgtgcggatattcacccaactgcaacgaaacaaagggactttgaagttcagatagtgcagctcccatatctgctctatgcggccatagtatgtgctcgatccaacctgatcctgatatgcatctatacggactccactgttttgcactgtgcttttctcatcttgtgtgacggtgtaaaatgtgtatccattgatatcgtacccttgccatgtgtcaacatcccaagatggaccccttgccaacctttgtaatatctcacttgggccatcggtcgaccgtgctacacgatccttgaaccattcgttgaagcgagcaccatgttctctgttgatcaaaatatctgatggaccaatattgtcctgtcggaccttcgctaaatgctcctcaaagtatggggttacttcagccatatgttgcagcactgcaaaatgagcctgcgcgtaggaagcttgatcgggaacaattctttttctgtcagttgtgccgacacctgccaacctttcttcgtggcgagacgtaggaacttcgataggatcagtctcggccatgtaatcgatacaaaactcaatggcttcctcggtcgtgtaaccttcaatgatgctcccctctggttttgctctgttccgaacgtaggacttcagaattcccatgtacctctcgaatggccacatttctctcataaaagctggcccacatatttttgtttgctttcagtaggtgaacagtgagatgaaccatgatatcgaagaaa

SEQ ID NO: 89930 - DNA, 813 bp, Oryza sativa
aagtagcgttaatccatattgatcaggaagtgctccaagtgagtgttcttaaactttccaccattgtcatttcgcacgctcttgatagtgagattatagaggcttagggctggcttttaaaagcgcttgaagacatcttgagcttagcttttgtcatggagaaagtacacccaagtgaagcatgaaaaatcatcgacaatgacgaatctatacttgtaacttccaatgcttatgtaggccacgggcccaaataaatccatatgaagaagctagagtggtcgtggtgtagtcatgatgttttttataggatgtgaactcccaacttgcttcccggcttggcaagcactacacacacgatctttctcaaaagaaaaattagatagccaaagaatgtgttccccttttagaacagatgccaaattcgtcattccaacatgggctagcatacggtgccatagccaacccatagaggatttagcaatcaagcatggtttgggattcactctatctatgtcgaaatcagtgagatagagatcaccctttaacacaccgttgaatgctacggaagagtcatctcgcgtaaacacggtcacatccacatcggtaaccaagcaattaaatcctaacttacacaattgagacacggataataaattgtagcttaatgaattgacaaggaggacattagatagagattgattcttggaaatgacaatcttaccgagacccattacctttcctttaccatcatctccaaagaccatattttccatgatgaactactgcagtcgagttactaaaacgggaaccacg

SEQ ID NO: 89931 - DNA, 833 bp, Oryza sativa
aagaacaaagaacaaagggacttaccaccggcaatatccgattcgaaatagcccaaaagctcaaagccacaacccttagaataacacaagccatgattaggagtgtgaactaaatatcttagaattctcttgacgacaatcaaatgacactctttaggctccacttgaaagcgagcacacatgcaaacactaagcatgatatccggacgagatgcacataagtaaagcaaagatcctatcatggagcgatataccttttggtccacacatttaccattatcatcgaggtctaggtggccattagtaggcatgggtgtcttgataggtttggcatcctccatcccaaacttcttgagtatgtctttcacgtacttggtttgagagatgaaggtgccctcttgtgcttgcttcacttgaagcccgaggaagaaggtcaacttgcccatcatagacatctcgaaccttttagtcatgatactactaaattcttcacaaaaagaggcattagtagaaccaaatattatgtcatcgacataaatttggcatatgtataaatcactcttaaattttttagtgaagagagtagtatccgcctttccaatttcaaagccatttttcaaaagaaaatctcggagacattcataccaagctctaggggcttgtttgagcccgtagagtgccttgtggagcttgtacacatgtttggcaactttggatactagaccccgggggttgctcacataactaactcccagaaggtccattgagaaaggacttttgacatcatttggaatacctgaaatatgaaaaccggcttggctaaaagattttat

SEQ ID NO: 89932 - DNA, 855 bp, Oryza sativa
tcctttagtctcatgatctctcaagaagtggtggcgaatatctatgtgcttggttcttgagtgttgaacgggattattgcctatgttgatggcactctcattgtcacatagaagtgggatcttggtgaagttgtagcaaaagtcttttagagtttgttatccaaaggaattttgcttcttggaggaccaaaaaacaagggaccgcccaagaaattggcaagtcccagttgtgctttttctatcaaccttacacttggcataatccgaatcagaatagcccaaaagctcaaagccacaacccttaggataccacaagcaaagattaggagtatgaactaaatatcttagaattctcttgacggcaatcaaatgacactctttaggctccgcttgaaaacaggcacacatgcaaacactaagcatgatatcgggacgagatgcacataagtaaagcaaggatcctctcatggagcgatataccttttggtccacacatttaccattatcgtcgaggtctaggtggccattagtaggcatgggcgtcttgataggtttgacatcctccatcccaaacttcttgagtatgtctttcacgtacttggtttgagagatgaaggtgccctcttgtgcttgcttcacttgtagcccaagaaagaaggtcaactcacccatcatagacatctcgaaccttttagtcatgatactactaaattcttcacaaaaagaggcattcgtagaaccaaatattatgtcatcgacataaatttggcaaatgaatgaatcactcttaaatttttttgtgaagatagttgtatccgccttcccaatttcaaaaccatttttcaaaagaaaatt

SEQ ID NO: 89933 - DNA, 823 bp, Oryza sativa
gagatagctcttcacatcagtgacttctagcctgtgacgaacgccatgcctgattgagatggggatactttaggtaaatacaacgaaaattttccagtaccaaaatggccataattaacaatagcctatttgaaataagcttgaagatcattgcatacttacagtatggccatcagcaatttgcgcaagcgatgggtcacggataatggagaggattggaacaacaaatgcatatgagcccccaatgatggtaggaagtcgagtgccgaataatgtctggagcagtgtttttatcccagtaacaaatagcagtgtttgaacaactcttgccttgtcatgcttttattggaagcaaatgaaacaaaaaattttagtaagaatagtcatatgttggtcctgcaatattaatgtgctgtagcatttgacaactgatacagaagctggaattctactgcacataaaaaacgggttaataaatgaagcaattctcacatcatttccacccataagaggaaccagcattgttgggatcatcacagcagtgcccagggaaagaatgtaatgctgaaagcccaaagcaattgcttcacctgcaacaaccagaaccactcagggttagtaacatatactatgctacaatacaaatcaaccaatcatagaacacttcagtgcagtgtaacactacataccccaggatggattggagtctatgcagtactcaaatccctggagctggtccatgggtggatgatggaccatgtcctcaggcttcacctcagccatttcacagccaaacactttacacttcttttcttcaagatga

SEQ ID NO: 89934 - DNA, 696 bp, Oryza sativa
atttattttggttgatggcatttaactgacaaatacatgatttctaggaaaatattatgcactctgcttgttctattaagaataaatattattttcttttatgagcaaagtaatttcaatctgaacttgaaactgtagttatcctggtttgcgcgtggcatacattgacgaagttgaagagagagacggtgaaaaggtgcagaaggtcttctattcagttttggtaaaagctcttgacaatcatgatcaggtaatcatttccacaaagttgaattaccttgatggcattttgatatgatgtacatctcgatagagcttatttacttttgtatactgtgaaggaaatataccgcataaaattgccaggaccagcaaaattaggtgaaggtaaaccagaaaaccagaatcatgcaattgtctttacacggggtgaagctctccaaacaattgatatgaaccaggtgaattgaacggttgttctaaaaaactgaagagctatgctgccactcaagatatatctaatctgttgcattcttaattatttttaggacaattatttggaggaagctttaaaaatgcggaatttactggaggagtttcacgagaaccatggtgtgcgccaaccaacaattcttggtgtgcgtgagcacattttcactggaaggtctggttggatgctttgcagttgttactgaa

SEQ ID NO: 89935 - DNA, 1271 bp, Oryza sativa
caaggaagaaaacccaaaggagctcatcgacaggttcttgaaattctctcaggaactggatcatgctatcttcatcgcccaatcacagaccaaaattaggcatgtaaaagcatgtggttccaattcaacatcctcagcttcaaccaaagctgctttgaaggctgcattggataggaagcagtctgccatcttatggatcagagaagccattgaagcagacctctcacctttttctagccatacaagacccactgaatcaccaaagctatcactggcagagtcaaagcctatgaccccattgttctgttgttccaagccaaagtgcaactgcagcaaaaggtcctcaaggaaagcatctgatggttcctctcaaggaagtaacatgagtgctgccatggacctggctgtagcactgagatcagagtgcaactgttggttcctcaagtacatcgacaagttcttggacgatatcgaaagcgagaccatgtatgcaccatgtgattcccaagttgcaggccttctgcagcagcttaaaagggtggatgactggctcaaccgtgtcgcgctacatgagaggatgctttcggttgaccgaacaaacaaggatatcatgttttctgaagaagaggagagcgatgcgtgcgagagggtacgaaaaaagatttatggagcccttttaaggcatgttcaatatgctgcaatggcgctagaaggtctaaatggtgtaattgatgaagagaaggacgagagaaaataacagttactgtgcaaagagctttatcaatatatagaatgaacaaataaattttgtgtagctgcagataatataagtttaccatcgtcagaattctagctggtagaagcatgttaggcataacttccaaatgctgtctgataaatgttggatgctctgatggtattgttgcaactattgctaatcttgtctgtgatgagacatggcatccaaaaactaacaattgcctcaagtgcgactttaaggccatgaaagatctgaatagtactattggtgaacctaagtaggacattgaaacaaagctgaggatatctggtgcaatttacactctgatcaattacttgctacacttgtcattacatacttgcatacatgctcatgactgcatctcacatttcattacatgttcttcggtacatttcaatttgtgttgatgtactggtgatgtcaattgtcaagtgtactgcctttttcaaagttagggcccctttgaatcaaaagaattatgaaggaattt

SEQ ID NO: 89936 - DNA, 1048 bp, Oryza sativa
tatgtgtcatgaaagtaaatggaagcaaaattccagaggtgctactggaaataggaaaaaagttgggaagtaactaaatgtagtgaagccaataggtgtattttggtatgccaacttataaatatgcccaagcaatgtgcctttaagtaaaataaatggatgtctttcctggatataacaacaatgaacatttttttttttgctcctgctttctagtatctacattactctatgtcatgtggtttcttttctattagctacactaattgtataaataactgcagaaacgaatttatgttgtccgtgggatgcatgaaagcagtgtttcactttttaagtaagttagtttttttaattgtttgcttttttatccatgaaaaaaaaactcattctcttgtattcaactcaaaaggtatacactattttggatcttgctgctatgctccaagtttgcattcagtaattttgtccaggtaaattttacacttggatattttggaaagatgatttgacaagatggctctgatgctcatactaatttacagataaaacctctgatcaagccaacaaaggacataatgaatgttcataatattcattatgagtggcatgaattctttccaaatggtaatcaatgtttatttttggggagtgttattatgtatttttccaaactgataatagctgttgtcttttcagcatcatataatgttggtgctgtcatgtcgctctgggctcctgtactcttggtatgagcttatccaacttccatattagctgaccacagtgagcagtggggtcttattatttttccggggtcatattattcatttccttttcttttgaactcatgtactaagtcataaatgttcacttgcaatgccttcaattcttgtaggtctatttaatggatacacagatatggtatgccatcttctctacaatatctggtggtgtgtctggagcacttggaagacttggagaagtaataatgaatcttgaacttttacctgtaactagttgttttactttaggaagtcatgaacat

SEQ ID NO: 89937 - DNA, 534 bp, Oryza sativa
aacaggcgcttttcactctcaaagcgcttcgctgaggtcccaaataatagtaacaacattttttttcatgatggatcttctaaaccctcaaatatttatactacaaaattgattgcacaggtttctcccagcaagagaactgaggctgctaagtttgctcagttgtggaatgaagtgatatgtagtttccgggaagaagatcttataagtgataagtgaggcccctggctcatgtttaggaggaaacatgttatcatttgctcatagcaatgcgtttaatgaacttctgctattcagggaaatggacttactggtggttccttattcgtcagaccccagtcttaaactgatgcagtggccactcttcttgcttgctagcaaggtttggcagaataaaattaaagcttctcttttctcctccttacgttctgtgttcaattgcatgatcgcaatttattttgtgggaaactctgcagatacctatagctttagacatggcagcacaatttcgaccaagagattccgatctttgga

SEQ ID NO: 89938 - DNA, 641 bp, Oryza sativa
tcggtacccgtgatgaatatggtaccgcctcaaacatcaagagtagagtcaatcgtcagtctgttttggctgccattacctcagctcagcagaggctgaagctctataacaaagttcctccaaatggattggttctctacactggaaccattgttactgaagatgggaaggaaaagaaggttaccattgattttgaacccttcaagcctatcaatgtatcactgtatctttgtgataacaagttccacactgaagctttgaatgagctcttggaatctgatgacaagtttgggttcattgttatggatggtaatggtactctttttggcacactaagtggcaacacacgtgaggtgcttcacaaattcactgttgatctcccaaagaagcatggtagaggaggacaatctgctttgcgttttgctcgtcttcggatggagaaacgccataattatgtccggaaacagcttgagcttgctactcagttcttcattaatcctgctacaagtcagcgtaatgtttcaggcctaatcctcgctggttctgctgattttaagacagaattgagtcagtctgacatgtttgatcatcgactaaaaacaaagatccttaatgtggttgatgtttctggggatcctcta

SEQ ID NO: 89939 - DNA, 651 bp, Oryza sativa
gcatgggactggatatgtcaaaaagggagtggattcattatagacctggagcacagttaagaaattacctgtcggcttgttcccctttgtcgagggcacgaacgtagttctcgtagtactgctggtagaagctctcaatttcgcgggcatcggtcttcttcacgcgtttcgcgagactgggactgttatcctgcgggttgcataagattccaagtgaagatttatagcaatggaccaaacattagacttaaaagttgttgcacgactaagctttgtggcaacttatgactgccaaccaaacaagccctgaactcaaataatttgggtggaaatcaagataatgaatacatgatcagtgcaaatggaaaataataccatgtgaaattgatgtatcgactcaaaatcatgatcgacaatatatcagattttttttttttaaaaaaaaaagagggtactccaaacggttcgtcgcattactgaaaaaggattacaagcataataaataaaatttggtcatgctcaattaccagaagttaattagaacataaaacatctcatctgaaacaaaagaaaaaacagcatcacacgtcattctggttctggaaaattgtgctttgtgtagcaggttgttcaatgaattcattttgcatg

SEQ ID NO: 89940 - DNA, 588 bp, Oryza sativa
taactggatgcaacagcaagcagactgtcatccctactgaaagacagagcagcgatgctggatgggtatctgggaaactgcaaccaaaagatgaaaaaaaaaagaactaaggcattctgatgtgaatttgtgatacagaatagagaattagagatcttcaaaaaatagttcgcgggactattacttgaaacagtttccttctgttagcgccatcccaaaggttcacaaatctatcacatccaccagtggcaaatgtgccgtgtctgcatatgttagatgaggccattaaagaaacggaaaataatcaaccgtttgtgagggatcagtggggatttcattacactgggtggaaggaaattgcgttgacaggatagactttggtctctccatcctcaggcactcgatgacacttgaaactatacctggatagaataaaggcatgtaactacgtatataaatggaacacagcagaatatgtagattaaaaagatgatctccggcaaagctaataatatcagcttaagtaaatagctatcaggaaagagttttccttcagcagcttaggtgcatacttcttatagggagggg

SEQ ID NO: 89941 - DNA, 612 bp, Oryza sativa
ccgttgagcgtcacctcgtaatgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcgggttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtttgccacgcgacatcagtcgaagattctgtatggaaatgggcgacgaca

SEQ ID NO: 89942 - DNA, 5979 bp, Oryza sativa
  unsure (1)..(5979): unsure at all n locations
aaaggtagattcctgatcagacccgtctgcaagtagctcatnacctggtgtgaactcaatgtggtgtgatttcgaatttaagtcctaaatttatatcagaacatgacctctcgtcaaggtaaaactcaagatccaaataggagaccttataatcaccgtgctggactacctagtcattccttaagtggatgggatttcctggtcctctcttagggcattcacagtgggttgagttggcattcagccttatcgatcctcaacaaatattgtgtgccacgtttgctactgccatatgtacctgaagttcttgtgtccaattttggtcactcgttctccagtctaattctgagtgagtgcgtggggtgaggcaccgtgagcacactgtggcgcactgtgaagatctgatccctgctttctccactgctcagcctgtagatgtgtactttgtctttttcccttggtcacggcatgaggaccggacgcagtgtgaatgcccttaggtggacatgattctttctttatctttatccatatttagaataaaagcatataagaataagaatatgtatatgatatttctggtgataataagtgtatgtatacgtgtatatcatgcttcctctatctaaaaatataagggattttggttagataaaacacatcccagtgattaaaatttcgtactactatggtgtgtcccgtttagggtttaaaatttcatatcgaaatttctgaattttcggtaattttgtcccccaccggcaagttcatatctcacccaaaattttccttttttgcaaatttttgtgaatttggtcaaattttatttaaattcattcaaaatcagtcaaaatttcaaataatttcagccaaaaattttcaaaatttccaaaatttcggtaatttggtccctcggcaaaaaaaaaccaatttcaaaattgaaaaccctagtcccgtttaaccaagattgacgaagcaagtatcttacagcaatgcactatggaactatttttcgtaaatatacacatgttgctcttgggacggggaggttgcagagcagacatacctggcacccgtcactcaccatcagggttcacaagcacgtttttcccccacaccaacaagcccacaccaacaatcttatagtacatcaggataggataggtgacacgttctaaaaaaaaaaggataggtgacatggtcacacgacgttcttaccaattgaatgggcaacacatatatatattttcttggaaaataactagttgcttatctttgtaaagtggagtgagaaaatggttatttaaaaagaattcctagatgtgcatttaaactcaagcccaatggcggaggcaggttaaaattatagcggggctaaaccaaaatgatcaagagcaactaaaagagatttagggttgggttaggattttttgggccttcttagccttttgggccatataacaacctcaaacaaagtctatattagcccttcatctataaatatatggattacaattttagaggtattatgggggctctaatgatatattaggggtagggggtctaaagacccccacggcccccacgctgtctctgcccagctcaagcccaaggcctaagcactgctccctccgtttaaaaaaactcaacttctaccatgctaccctcataatgtaaaacgagaagttttatttcttcaataccctctacctacctatcaccattaatattttttttaataatgagggatattttggtcattttcaccttactatttttgcattgggatgatagggtttgatttaatatgggacagagggagtaagcaggatacatcagtctatagaggtgatctggttttttgagtgtagtaacagtaagacacgatcacatatatagacaaagttgatttgctctaaataagaagcaatcacacgaaccatgagcagactaaacccaattttcaacacaacaaaacatgacggaatcatggatcatgaacaaacttaacagcctgtttaagtacttgtttcaattcctttatggaagacaaactaaaaagatgggtcttttccgatcttctgcacaataacatgaaaaatcacaagttcaccgtatccctccggcaaagcatcaaaatacagaaacaactctagaaagaaacagccggttgctctgatttggctgcatctgctgaaagattgtcttttctagcagcagagtaggcaaggcatggatggagggttgcaaaagaactcttgtggtggcaggtttcttggcttgtgcaaaatccaagaagaatggcatacttgaattcttgatgcatcccaatccatgcctcagctgagaaccaaatcgcatctacttacatatcggtatgcattatatagccttagaagaaagccctcgatctcggctaggctcacgctgtgctactatatcactgataaagaaagctaatataggatgcctcatcagatagagatagaaaagcatcatcggacttatttccttctaattttgagtcattagcatatgggttcaatttgtagatgacccacatatcaatgattcatgtttgaagtataagtcaaaagagaagtaagtcagagtatctcaattctcattagatatattgccgcggatatcaatggatcttgggttttatttagacattgatggctttcagtatcacaaacaagagttaaaatatgtagttgaaaaaattttggtgtaatgtggtcatgtgttcatgtgttttactttatccaagacaatcgacgattttttgcatactgtattatttaatattcctatctcacgaaaagttcatttgaagcgattctcaaacaaataaggctgtgttcttccttccattttcccaacccatctctctcgtttttcacgcgcacgtttttcagactgctaaacggtgtgatttatacaaaaactttatatatgaaagttgcttaaaaaattatattaatccattttttaaaaaaatagttaatacttaattaatcttgtaataatacaagcttcgttttgcatgccggggaccaaacccctcctcccgaacacgggttcagatcccctagagttggcatcaactccacctagtggatttgggcaaatccaaatctcatccatcgttttatttctacggttgagatcataattgactcccttaattgatgcatatttggatatttcttttcaactgtcctatttccaacgtaatcaagaaaattaacgtaattaatcttcttcctacgattaatagaccaacatagaagatcttttcagtgtagagaagagtgatatcgtagatggtgaacatgggcagccttgcgatgtgcagaaacttactcagcgcaagcaagtagcaacatgtaagtacatcacgtcaagctccttgatgctgctgcacaactcgttgatatagccgatagagtcctcgtttacaatctttgatgaaggtaagattaaaagtcgaaggaacaaattaaggataggtggttgagctgtattgatttaatctcaaccactggtgacaaataacggctgggattgacccaaatccaccggataaagttaaagccaactctagaaaatctggacccccgaacagagtctaagtgttgtggttagttcacgttgatgtctctctcatcaatcatgttatatcatatacctggcatttgtcatttggtaagccggagagcattaggcaccgtttgaatcagcttcttgactgagctactatcttggttttcgtaagcacatttcctaaagtgttgaacgataactttttaaaaaactttctatatttaagtttcttaaaaattaattaaatcaatttttaagtttataagttcatatttaatcaataatgtgcttatgattattctctcccgtcaacaagctcagttgttcaactgtaataaacggtgcctttaatcgtgcatgcagtagaaccaagtgcttcagatgaatattttgcggtgcagggggtgaagttataatactctctgttgatttgtggatcaagcaaaagtagggtagagtaagtgctccagatgaatattttgtgggagaaatttaataaaatttttaaaaaaacaaactcttcatgggatggatggagtagcacataggtatattactaatttaccttagtccgattagcatgaattaaaatgttcctgaagaattgataccgttgcatcaagataagacaaaagctcaaatgctagcaacacttgccctccactgggggattttgaatacctcggcctgaaatttcaaatcctaatatgcactaagatcctagcaaatgctaacatgaaataaaatatactaagcgtgttggaataggtatcaaatatactagtcttattttgttatagttgaacttggagttataataggtgataggagtaaagttagagtcggattctgtaacccagtaactctcttaaataagggggtaccacaatataattatgacgactataactgtgaagtcaatttgcccttgagtatgatcttctggtgaactaattaaagacgtatcctgtaatcctaaagaacacagaaaaaagtttaatccacatcccatggttttattgctcgcactagatactagctagactagctatcaaggtaaaataaacgatcacatacatttcaatctacaagacagagagagtagcgatgccaacagtatgtacatttgcaaaaagtagaaccaacaatttggacgactactctatcttccaggtcaaaatgcaaatgcatatgctgccttgtctgtcgttgtctactatcttcatggatgatctgaggatctgcactagagcccagccaagtgctaagtgccaacacaactccaaatatctgtatgggtagtggaagtcgaccaggatggatttccagtgatcccattgtctcccagtcctataactctagtctttacaggcagacagagccatgtttctctttgagaaatttagatgaacatctctctcgtgtgtcgttatagttccaagaaatagggcaatttatagccccctatcaccaaggccatttcttttggtaggctctcctatactcctttcatcttttcttgtctaacgtaccttttctatttatactaccactgctacaaacaagattttttcaaacgggtattttgttttttccgtgcggttgtcagttcatcattttgttttttccgtgcggttgtcagttcatcatctgggaccgtacggaataatggattatcccatgcggttgtgttatatcacccgcatggaaccaaaaaaggccaaaaaaatatatataaaaaaagcaaaaaacgccgccggccaccaaatcgctgccttgaccgccgcatgcgacgaccaggaggaggacgacgagcggacgacaaagccttgcctcgctgctcgccgctaccgcgcccgactgccgccaccccgttggtgaagaggcggcgctggcggttgcggacggtgacggcgcggccctcggcgaggacgtgggggaggtaggcgttctcgacaagtgcgtggtggcggtggtggaaggtggcgccgcggaagtcgtcggcgacaacctcgtggtcgtcgacggcgagggccaagcggtcggcaccctcggcgaggtcttgacggccacctcgctgctcgccgccacgcccggccaccgtagtgactgccaccgagcccgaccgtcgtctcgccccggaggccgtctcgtcccggtggccgtctcgaccggatcgcccggtcgacgtctagcccagccgtcgactcgtgccggaggtcgtcttgaccaggccgtcggctcgaccttacgttgactataccgaccgccgacacctcggcccaaccggttgagggagttggtgagggagaagagataccgtagagagagggttgaggcgggtgtccatgcaggactcgtccttgtggc

SEQ ID NO: 89943 - DNA, 1679 bp, Oryza sativa
cgcgttaacggcccgttaaagtttcgctgccctagtgcataggtgatgcaataaagtcaaaaagtttcaatctacatcttctagtttatcatctaccattgtttctgggtgccaacggtctaaccgtacgtgtgtgcgcggtctgactggtgggatagcggcggtctgaccgcaagtatccgggcggtctgaccggcgaggcttctgcggtctgaccggtggcaggaaggcggttcgaccggcggcgactggacttcgtcatcgacttcgttcaagggtaatctttaattccacaaaagattttgggtttttggtttttcttaccattcactcccccctctggtaggtttgtttggtcttgtgcgatcctatagtattaacgttgttacggagttacccacatcgaacacattaggaaactaagcgtgtaaaaaaatcttttcttctatcctcttatcttatactagcagcgtatctatatgtatagatgggtattagaggcaccctaaaatactgtaatcgggtttgataatcccctgagtaaaatgcagcgttggtatcacaacttatgaggtgggtgcagtttagtcagtcatcttgtaaattgctcaaataattcacccatcttcgttcgatggttgtcacatcctgatttttgtttcaggatttataaattatttaataaattattaatagaatttatattaaatgttcattaatttacaagtgaagttaaatgtgggaaataaaatttcccaaatataaagcatggatggatttaatttttattaaattctccatggttaattatactctctggaattttctcggatttttcggagctcaattattaatttttttaatcatacaaagagaagttcagcaattatttaaatattaaattaatcattaaatggtctaattataattttgttaagtacttttagtgtccaagtattttcaggatttttcttggaattatttgagcattggaagtatttttaacaattgaaagatcatttaagtgattattttaattggaaaaagtttttaaatcttcccctaagtcgttgggccgatttcggcccaactcttctcttcccgcgcgcggccaagccggcccaatcggcccagccgagccgccctcctctctctctccaaagtctgtttgatctccctctctctcagtcagcccaagcaaggaaaaaggaagccggaaaagtctatttttcctccctgctacagtgtcgtccctaaccttcagcctgcagtctggacagagcccgagctgcgcgccgcatcgcctttccgccttcaaatcccacccaatctgaccccgtttcttccggatttttgaggggttttgatcctctcatcctcctctatcttttcccccaagaatcggagcaaatcgttgggtattttatccaaatcaaactcgttttcgagtttatctccaaaaccgagattttggtttccggcttcgattactctcggttgggagtcgatctctttaatccaagcctatataaagcaccccctagtgcttctctttcgctcgccccctctcccgtggtctatggtgccttgtagcgccggcgtcataccaaccaaacctgccggcggcgctgggcaaacttttgtgaggtcgcgcccgtgaattccgtcgtcgacgttgt

SEQ ID NO: 89944 - DNA, 1002 bp, Oryza sativa
  unsure (1)..(1002): unsure at all n locations
tttgaacgtacgaacaactgcacagnagcccancatatttctgttaatattttgtcaggttggtgacccagttcagttgcctgcaactgtaatttcatctactgctcagaagttagggtaagatctctctctctctctctctctgttctatacatactctggatgtaaggttttacaacattctaaataatactaatgtatccattaggtacggtactagtttattcaagagatttcaggctgcaggttttcctgtgcaaatgctcaaaattcagtatcgcatgcacccagaggtaatattgcctaaattcatttaaaagatggagactggagtcgttttcttattttattaatccactaaaaaacagattagtatattcccctcaaaagaattctacgaaggtgtcctagaagacggggagggactcagcaagaaacgtccatggcattcctacagctgtttcggcccattctgcttctttgatgtggatgggactgagtcccaaccatctggaagtggttcatgggtgaatgaggatgaagtggaattcataaccctcttatatcatcaaatggctatgcgctatccagaactcaaatctagttcccaggtagctgtcatatcaccatacaggcatcaggtgaagctcttgaaggaccattttcggtcgaccttcggtgatcagtctaaggaagtgatagacgtaaatacagttgatggattccaggtttgttttgcatgcaaatgcagacctgctgtatatgtagatttgtagcaaatcacagtgattataacttttgtaatgtttgttcttgatgctcacatataggggcgtgaaaaggaagtagtcattttctcatgtgttcggtgcaataaggaacaaaagattgggttcgtttctgattttcgacgaatgaatgtcgccatcacaagagctaggtctgctgtactagtatgatgnncnnctgtnccatctgtntgtcatgcaatcaatggcacag

SEQ ID NO: 89945 - DNA, 3997 bp, Oryza sativa
tcaccaggttgatcagtgatcggaagacacctctatacgtcggatgcaagaaaaaaaacaccaaattgtcagctaccttggacttaatgaagctgaaggcaagtagtggacggacagacaagagtcacagaccttttgggaatatttaaagccatgcttctcgagaagaacacattgcctatgacaacatatgaagcaaagcaggttttgtgtcctctgaggttagaggttcgtagaattcacgcttgtccaaacgactacatattgtacctcaagcaatatgcggacttagatgcttgtcctgtctgcaagacttcttgatacaagcgaaagaaaagtgttgacaaaggaaagaattcaaagcggggtggtccggcgaaggttgtgtgatattacctatcattgattgtttcaatataatctttgccaaccccaaggaagcggagttaatacgttggcatgccatagagataaggtacatgggagttctaaagtcccttgggagttctgaacaaaggtatgctaagataccctgcagattcgattcaatgaaggaatatcgatcagaaatacctagaattcatagccgaccctaaaaacatgaggatatgtttgtgtacggatggcatgaatccttttggagacatgagcagttctcatagcacttggctagtgcttattgcaaattataacctaccgccatggttgtgcttcaaaaagaaaatacattatgttgtgcttgttaatccaaggaccgaaacaatccagcaatgatattgatgtgttcttggagcatgttatcgatgaccaagaaattctttggaagaaaggtgtggaaacttgggatgcgtatggtcaggagtacttcaagctacaagttctattgttctgcaccattaatgagtactttgtacttggtaatctttcaggacaaactgtcaaaggaaagaaggcttgctccgactgtatggaagatacacgtagtaggtggctgaagaaatcacgaaagatagattacatgggtcataggagatggctcccactacgtcacgcatttagaagaaagaagaaaaatttcaaacggtaagagagaacttcagtctgctgctaataatttgtccggagataaggtccatgacatggtcaaggacataactaatgagtttgggaagaaaaggaaggggattcctaacgcttacgcgctccgaaggccgacgcgtatgttacgcccccgtcgctaaccatgtgattagcactaatgatgacgtgattagtgattagtgctaatcatagtacctacaagaactttttcttttttctaatagattgaaaactttcaagttagatttgaaaactttcgacttaagatttaaactttgaagtcaaattttgaaatctttcaacacaaactttgaaaattttcaactcggaatttaaatttgcaagataaattttgaaaactttcaactcgagatttgaaaactttctactcagatttgaaacttttaactcgagattttaaatttgagttataaaaaatatttttgatttgataatttttgcttgtattatggctgtgtttagatccaatggtgtaaagttttggcgtgtcacatcgggtatgccggcacacatttgaagtattaaacgtagactaataaaaaactaattacagaatccgttagtaaaccgtgagacaaatttattaagcctaattaatatgtcattagcaaatgtttattgcagcaccacattgtcaaatcatggactaattaggcttaaaatattcgtctcacaaattagtcgcaatctgtgtaattagttatttgtttagcctatatttaatactctatgcatctgtccaaacattcgatgtgacagggtgtaaagttttgccaggggaactaaacaaggcctatatggatctaaaattattttagctatgcatgtttctagattaatatgtactcgtgatctttgaaagttttatcttcttaaaggacccttgagcttgtactcgtggaaacaaaatgtgagctatcagtgggtacttttcactttcatcatgcatgtgtaatttgtaagttccgtgataaaagtgccttggtcaatcactcaagcactttatcattctcatgcaaacaaagattgtttagctttagaagtatcacctctgtcatgcttgaaaaggaataacgtgcaagtttcacccaaatatgccaaaaaagacgatataattgccacaccacgatggtgacgtagcattattgtatttaaacaaggaaatatgtaacgtatttgatattttagttttgaatatgtaaatcgatcatgagatgaaatttagtactccaatgtagtactcctaccaatcacttaattaataaataaaagttaataccacatgattaattatgcacataactactccctccgtcccattttaaatgcaaccaaaagtttctgtatccaacttgaacagtctatcttatttgatttttttaattagtatttttattgttatgagatgataaaacatgaataataatttatatgtgacttatgttttttattttttaaataaaaaaattaaataagatggacggtcaaagttacgcatggaaaatcatagctataattaaaatagaatggagggagtactagttcgacctacgctgcaatgattggatgtttggatccattcattaattttctacacaaaatgttggcccttggcctaaaagaaactaactattgataaattattgaaaaatatacatgtacctgaactagagaactagagtgtgcttgaatcaacgggttgtgaaccctctcactcatgattaattaagtattagttaaaaatattaaaaatagattaattttttttagaaaaatcgtataatagtttggaagtctactgagaaaaatgagaaaaataaatgagaaggtagttgaaactgaaattaaaatagtgtagtgccaaacacagtaggctgtgttcggatagcagggatgggaacccaatctccccgtacggaaaacggagcgatccattagcgagtgattaattaagaatcggctaatttctttttaaaaaatggattaatttgaattttttaagcaacttttgtatagaaactttttacaaaaaaatacaccgtttagcagtttgaaaagcgtgcgcgcggaaaacgagggagaggggttgggaacttggagttccaaacacaaccttagtaaattttcataaaagcaaatccaaatacttgcggaaaattggcagccgtcgtctcgactcaaccagtagcacgccagccttcagccttctccttccttcggccggccgccttttcactccttcacccaccggcatggccaacctccatctcctcccccttcttctcctcgcccttctctcccccgccggcgcgggctccggcgaggcgcacgcctccgcggtggtggcagagaagggcctggacttcgccaagggcgtgctgatcggggaggcggtgcggtcgctgaccccgctgcgcctccccggcgtggagaaggccgtgcgggtgcccttcctgggcgccatccgcgtcgccgccaccaacatcacgctctttcacctcgacgtcggcgacgacttccgcatgcaccccggggacaccgccctcgtcgtcgtcgcctccggagtcagcgccaacctcagcatgggatggagctactactacgattcctggctcttccccatcgagatctacgacagaggcaccgcttttatcctggtagtactaaccctttgcctagatctcgagttgattgttgcctaagaaaggattcaattcgatggcgatagcgctagaaatgggtagggcctcattggtggaaaactagaatgtgggggcataagctggcaaagctgccgttccagttgctttagaggcaaaaatcgttcccgacgcatgatgttcttccttcaaaacagaaaagaggaccttattcc

SEQ ID NO: 89946 - DNA, 9148 bp, Oryza sativa
  unsure (1)..(9148): unsure at all n locations
atttaacccaattttttttataaatttttagnttggcatttgtatgtggtaatagaccttataatttacttagggtattggtcccatgataaactgaactattgataatattccttgagcaatctcatatttgtaatgtcttaagtaataagggtcagaagtgaaaaaattgcataggtaattgcaatttcatgggggacaacatcttcgtggcttccctgtccactctttcctgcatggatcaccctccagattcagacatctatcacattttgctcaacttgatggggctgttgatcccattggcaaatgatgcctatagctgtgacttatgaaatgtgatgttgtatcattcatgtttcatgtaaatatcatagggtgaacaagctgttttaggtaattttctgctttatctttaccttttgttctttgttagtaactcataagtgctttctgtgtctaaggttcaaggaatggaagttggtataaccatgcaaattaagaattataacgggagtttgtctctctctgtgttgcaatgtggatgtaatgtcaaggacctagtgatatccctggatggtggagcatcttggttttatcaggggtatgtatctcttgtgttaaagaatccataaatgttactttttaaattatggcaagtcgattttccatctgagcctttgctttgaagtttaagatctgaaatacttgttttgatgattcgaggcctcctttaacccatgatttcttcctacactgggtcctttgtcgaggaaattacatattgcaatgttcagacttctgtacaaaattggcatatatctgtgcattctgacagtgatggcaacctttcctttgcatctgcttcattatttctactaaacatgaattttggagtcgtggcatgtttgtcaagtcagagctaatattatcaaataaaacgtctcttctgtttggtgctttggtggttttgtttgagtctttcctttggggtcgattgacagagataagatttcattcactatattactatttgctggtacacatgtatattcagataaatgatcccgtgttattctttttaattctgaagcatgtcaagagcccaaatgtctatcctcctagattaatcgctgagccttattcccctcctttcttgaaggttaataaatgctttcgagggccatattaaagctgcagttgagacgcaaatcctagaaaatattattgacggcacatccaaacttgactcgttgcttcaaagccttcataggagtgtcaatctggctaatatttctgctttgaacatgacttttgttacggatccgcagtatggaaattcctcaattgagtttgatatcaatggattattctcttctgcaactgctaagcttagcaattcgcaaaagcatccccaactttcattatcatgtggtggggcatccaaaatgcttctgctttcacttgatgaagctgttttcaattctgcattagaggtttacttcaaggtaatcaaaacatttgtgtcaaaacaataattcatgaatatttacttttcacttgcgttgttgcttgtttcttggattttatgtcagctactttttttttcttcaggcaggttcaatgcattgggtagttgacaaaattcccgatcaatctctactaaatacagctagttggaaatttatcattcctcgcttgtactggagctatcccaatgatgacatgctgttaaacatttcaatggcttcacccccggtgatgaggattacgtctgaaaagattggtgctactatatatgcggacatgataattgatgttttacatgacaaagagacaattccagttgcatgcatctctgtagtaagaatcctcaactgctaaacttcatttatgatgttgtgcttttgatgatgttcattgctaaggagagaagattctgccattactacaactcttatttgaacgaagtgcaaaaaaaaacgatctttttagtcgcagcccatgttgaatgcatcttgaatagagaggtgcttataagaaaatgaacgccatctatcaggctggaagtaattaagtctgctcagtattccgcaatactatcacacaatcctctagaatagttaggccatactcttctagattgaacttgactgggggaattcactttgaatttaataaatttattgctcgtgaagtatgtgttcgcatatgccctatagatcggtaatgactccaaacatgggcagnnnnnnnnnnnnnnnnnnnnnnnnnnnnnnnnnnnagtttatgtacctgcggacgatttgaccgaccctgcttgcactacttcaacatctctttttgtgtcttccagatcatatatctgtattcctgagtgcgattctaactactggaatcattttttttcttggtaggtagtaagtgcctcaggtgtcgcagaggcagcaggcaataaagtatatggtaaggttgaattgggcaatttctcccttgccttgaagtggagcaaaattggtaacttccacatgtcattgattcaggtaacagaaaaattagctttctttatacaagtttatctttcctagattgctttttatcagcattatagcaagcttgattagtctgttagttaactactgggcctggctaagtggctatttctgatcattttgtttctatccatgtgcgggacaccattatcactttatcagtgaaggtttttgttttctcggttcatgcttaataccaaatgataacgagtttctgcttgcagggagtgattcgtgttttcttgaacacggtttgcatgccctatttgaactcacggctggggcatggagttatcttacctgtggtccatggtttcacactcaaagacatctacgttcttacttctcctgagaagttgacactttgttctgatgttgccttcgctaatgcaagcagcctggcaactttaccaattttgagatcccctcgggttttatagggtatatgtgtacctcacgtttgggccaaaaagggccttgggcataatagtaagtgcacacttgtacatatacatctgtacattaagataaatgtacatagtttctccttcattgatatattcacattcatgattcatttatacaaattctcttcgtatgttctttttaatgattagagcttgtactgttctttttaattctcagtttcgatcctttacatcttactgtcttattgtattaatatagatggttgaaatatgaggatagataatggacacattttatcgccattagtcagcctagacccaacaagatataatatagcaacctagtcatataaaaaagatttttcaagataaagttttacttcattgttaattttaagatgtttctagggcctagttctttttctccactcacaacttcatttaatgctccatatatgtgtccaaacattttatgtgacggaaaagtttgaagtttgaagggaactaaacatagaagttgtttgaaaaaaacaaataaatccccttttcaattttataataattaatatttaattaattatgtgctaatgagttttctcgtttcgcatgcgctgaaaatatccaccacctgcttagaaggaacagggcctaagatgactaattaatatatcttgttgcatttttggccaatttagtattactagaaaaaatgttcatacgttgcaacgggtattcgaaataaactaaatatttagtagctacttaaaaaaaatcaggatgtttatgtcccaatcatccctccctcgccctttgtcagtcacaacagtgcgatgaacatagaaggatggggttagctaggggtctgaccatgcctgcaactgtggaccgtttccaaattttcaacttgagcacggagggaaaaggactttgatctgtcaacaaattgcactctaatccattaaaaaatcaatagagagatacatgggattgcaaaacaaagaaatcaataaattgtagctgaaattgtgctagaggagtgcgagtgacaatgggtgtaggcaatgtaaacggacacgcggaggaaccgatcaaagatatagcagcggactcgacgcgtgatcatgataaatatattgtattatcattgatcgatctattacttaattgagtttcttgtgtattttctacctatgtgtgtcatgcacgacatgactaaaacatgtatgcgtatcgctttgtgtcaaagcagggatcagaagaacttaataaatatataaatatgtaatgttttaatggtgatgtgtgggaaaagtcttggtttataaactaattagaaaatagaataggaaacaaacttttatttagaaacaaacttttatttagaagaagaatggtacttcccgtaaaaaaacaaagaaaggaacataattgaactggatggggtaaataatcgaactggatggactgtctataacgttgttgtgagctgtaaagaaaaagaagaaagagacagtatcagactgggtggatgggctggtgcattggcttggcaagcggacgcactcacgtactcagcgtgccgacatcatatcgaagtaggatgacttacaagatgtttggaaacattttaacttttataatagtagagatagaaatatatgttggaactattacctttgcggtgttcaaacatatctataagttggatactaaatcctaaatcctaggtacccggtataagggggtgtttagatccaggtgtgtaaagttttggtgtgtcacgtcgggtattatatagggtgtcgcatggggtattcgggcactaataaaaaactaattacataatccgtcagtaaactacgaaacgaaattattaagcctaattaatccatcattagtaaatgattactatagcactacattgttaaattatagagcaattaggtttaaaagattagtctcgcaaattagtcgtaatatgtcccggtcatgttactgcccatgagccatccattgtcgtaggaagagacaccagagcacgtgcgtgctctcctggggatttggtgcaccacgccggcggcgaggttctggtaggtgcgcgggtgcatcaggttgagcagccacggcaacggcagcggcagcagcagatgctgccaaagcgtgccaaggtgccactggctgcacacggcgacgaagctgaggcggtcatggtgggacagcaacgaggagacgatctggcgaggtctgtcaggaggttcgaccagcctggaggtggctcggcagcggcggtggcggcagcggctgtggcggactgctgcttctgctgaaacagatccccacggtggcacgagaggaagacgcgcgcggctaattaatatgtgggacgaagaacaagtcaaactagtcatgttggcgccacatcagccaaaaccagacttcgtttgcaccggttttgatagtttagggaccggttctatccggtttttgtgttcgaggacgaaaatcgaattcggtgtaaagttaagggacctcgaatgaacctattctatataaatacgtgggctttttgctttactatcgttagccctacccctcacccctcacccctctggccctccacgaaggcccagacagcccaacgtcgggaaccaggaaagattaggggaaaaaaaaaaggagaaaagggcgtgagaaaatcaatccactgtgtggctgtgtcgcaaaaatcttccccaatctcgctcgctttccgccccccctcgcttcgtttcgcgccgcgctccaacgatccaccgccaccctcgcgccaaaccgagccatttcaaaactcctccccccgcccttcccgaaccttatagaagcccctcccctccccttcccgcgcacgggggatggggagcgggcgggagcggaagcggcggcggaggggggagatggggcgggtggcggggatggtgatggtgctcgcgccggcggggcaggcgcggggcgggggcgcgcccacggcggcggagcgcgcgctcgcggcggtggcgcgggagcggctgctggaggcggcggagttgctggcgcggcccagggatctgttcccgaggaagccggtgcgggcgctcgtgaaggacctcggcctcgcccgcggcagggacccctccgccatgggctaccgcccgcgcagggcctccatcgccgagaggatcctcctcaccaagcgcaaggtttgcccacataagcctctttcacactccagctcttcttctcgttcactctgtgagtatatgtttcgattggatgtgcgtacgtacaagaggggtatatggaataatctcgaagagatccctgtgtttggtttggtgaattgaaataaatggttcaggatggtggagtactaagagtaagtttaatagtatagccacctattagctccaaatcatctatagtcaattcatacaatacttaactacaaatatatactccctccatcccataatataaggcgtgcacgcatttcaagattcaacctttaaaacatttgaccaacacttagtataatatgaaataaattttatttgttaaaaattatatcattagattgagatttaaatttactttcaaatggttataattttgttgctacaaactttataatatatgagaaattataagataaagattagttctggagactctgccaactttggccgcgccttatattataggatagagggagtactacatcattaataattggtcccacttgtcatacacacatagcgtcttgacgtccgtgctgcggctaggtacaaatctgtagctcgtttctcttctctctcatcttttgtatcctccacatgtgcttatagttgacttatagtcctttattgtacctactctaagtgtacaacttctaagaattatgctgccagaggatatgcttttccgttcaacgaaattcattgaatggcaccatcactggaaggcatctcactggacctctcacatgtagtaacatgtgtgttggtcagtaatagaaccaacaattaattccaccaaacaacaacgggaatatcagaataataagtaaaacgccaaaataaaataaaaattatcaaacttaatcttgtaacgtcggatatcattccatgcaactaacgaaacaaatccctgccatctcatcccattcaacttcatctctccaaccaaacaagcccatgtgatgtgctgacactagaaagtgttcatccagaaaattttattacatataatgttacgtagagctttcaccacgctctcatgtaggtccttgtcgtcacaacttacctgaaattatgtataaccataacttatgttacacaattccccctcaggttttataagttatggtttttgaatccataaggttatttctgctgcattattttgtttcaagaggaaatgtttggaatttgtcataaggaggtggtatcaatgtatatcttactaaaagagcaaaagttcctcctgcaaccataatttggcatgatcggcttcaggacacttgtccggaaattctacatgaccagtaaaatctgagaacagttatggatccatgaacttcactggaacacgctatggtttcttgacgattttgagaggagatgaactatacccaaaatatccatagtctctgttttatactccctctggtcattaatatatgacacttttaacactaaaatactaattttagttttaaaaatgtcatgtattaatgaacggagggaatgccatatctaggcatgccccatgtgcctcatatattaatgtttcattccaaatgttcttgggctcaagtaaaagctgccatttgaaacccctcttgttgatctctaatatttcaaaatggtaataaatacatgttgtgcagcaaattttctgtaacatatttggttttattaatgcagattttctaaagggaaaatgtatgcatctctaaagtttgtgcttttcttccccttttttattttgtcatagatggaagaaatcaaggaggctccagtgtatccaacaactaatgtgtctcaaacaacagccacgagagcaacaactgtcttccaacatggagcttctaagccaactactgggttgcccatgaatatttcagctgttgcctcattccctgtcacaaccccacctactataccatccccaaatatcttgaagcagacacagttaaatgaatcaccatcaggagtgaaagcagctggtacctcttcaattgtttcagtaccatctgttggtcctacaaatattaaagtggaaaagggtgttaatagtcctacttgcacacaaaatggaggtattataaacatattctttcatgactggttttcttacagtatcaatgttataattgttattcctattcattatctatgagtattaggtttcttgcttgaattaggacatagtgcttaatgttttatctcgtgaattttgtgtaaattttataaatactagcacagcacatgtgcgttctgacagatgataaataattgtgccatatgatctaactaaaaaatgaaacaaaataatctacatggtatcaattagttaccgacatatttgtgtgaacaaagtaatttttttagaaaggatcatgcaaactgcacaaacgggtcatagagcacaccatcactcccaactccgctttttgaaagagtgaagattatccccctcatactcatattgttaatatcatgcacaaaactacagatttaagttgagtaaatagcttataggaatatggtctggtatttctcagaatagttactcccagtagtttatacatttttaatgtacatcaattgacttctttattttaagtgtttgcctagtcagctgactagcctaactagtcactagtcagcggcaaaccgacctggctcctgaacatagggtaatcggtgggttggtcggcctaattggtcagttcttagtctgtgactagtcttttgtatttctttggcagccgttttgtactaaaccctgacctaatgggcttaattgagtccttttggactcttttccttcttaatataatgatgcgcagcctgcgtgtttgagaaaaaaattaggcaggccaactaaaaatgatgagctacttgcagacggngacatgcagttcacctt

SEQ ID NO: 89947 - DNA, 1027 bp, Oryza sativa
ttggggcgcccaaaaaaaattttttgggggagaaaaaaaaaagaatttgcttgtgccttatggcatggctgtttggtccactggtattggaacccgtcccctcataatggatttcatgaagcaagttggtcaggtatatctcgtacagaactcataagagaatacatttcaacatattacactaaattatgtttttaaaacacttatttaatttataggcaaaccgacgagtgctagctactgatgaatggctcagggttcatggatgtgatgatgtatatgctctcggtgattgcgcgacaataactcaaagaaaagttatggtatgtgtgtacttctcaatgcaaagataccatattttttgttcaagtaaagaatgcaccatattttgtcattggcaagaacatctcgatatgttatggtataattataatttaacatgtttcatcgcctgctctctagaatactaagctagcataattgaatttcaaatagtggcctatgtacagcaattagcccttttcagtgttaagttgccagttaattatatctaagtctttgttttgataataagttcatatgattaaatataaaaaattacaaatgctgaaattattatggtttaaagactgcaactttgtgtgaagctgtttagccatctcaaacatatcactattatagttataaagatttacaccgtggtgttcctttctgaaccaacttcaaaatttttggaggatgttttcagttcctacttcaaattctttttgtgagaaaggcaagattgacatgatctagcatctacccagatgagtcgtcaacgccaactgaacataaacgcctgccattgttagcacaccaatgtcatgttttggtcactacttttagatattaattcttgacattctgtactggaacgcggtgatatggaaatttcacgaagattttctttttaattttttcggataagcctaccaaggaccattgttggctcttacaattgcccaaaaaaattaaaaaacgtttc

SEQ ID NO: 89948 - DNA, 508 bp, Oryza sativa
cgggcccgcgtgtggaattcgacatactatttcgcgtattcgagctcggtacccgttaaatagtcgagaagatgtccgtgattgtaaactagcagtaggtgatacaaggtgtttaagcctgcctccactactgcacaaaaagagatatatcatcttcagtttactcagaaatcttgcctttttataatatcaatgtgtcctttattttagtattcctagtacatctcactgatcagaacacattcacatacccacttttcgacaccagaaatcttggatcagcataaataactcttgtaagtgcaggtgacctgggcaacagctgaggtttttccccaagtttgggggccaaggtacctccaaactgtagcaacgccattgaaatacttgctggatacccacaaagcttcaaccttcaatatactagctgccatttcacagagatagagtcaggtgaagcataacaaaagcaatacacaaaagaacgatattcgagtaagttcacaat

SEQ ID NO: 89949 - DNA, 2724 bp, Oryza sativa
  unsure (1)..(2724): unsure at all n locations
taacggtgtnngcaaggtgtatcntagtgacttgcaccaagttcttctcctgttatatttaatagatgcntntaatgtttataatagacaaaacttagcatttctggacctcattaatgcacacacgtcgcgtaaatagctaggtatgatttgcgcttcttaaattcattctttttcagttttacaaatactgtcatccttgatagccccatgtatttacattttacttcattttatttgtgtccttcatgtcgtacttagagttttatttatagctatatatgtgaaaatttatagtatctgaagttcccgtgaatgcaaggattaactgtttgtttaaccaaatcctgcagtttgttgtagctaaattttgtaccctatagttgtgtgctactcgttaccacccgcattttacattatcaaaagtgcataacagacttttaaatctgaatgaattgtcgaaacatcataactaaccgcacgctagcttttttggtttacttgtttaaccgacttaattacttcaaccatccccacaaaaaaaaaacttacttcaccataaagtactgcttttgtatgaatgatttgtgtatattttatattaaacatttttctcatctagagtcgacgtcacttcctcatcatgtttatttgatttgaaagggacggaatgcataaacaggagaccattattggtactaataggtgcaagcaggggattctcttaaaggtctacttcctatataaaaaatcaaactagggataaatctgatcacatgtaaatctgtgttcagatttatcgttagatttgattttgtttgcacagaggggtatggcagatacttgaagtaacaggcatgtaatgcttcttctggccgttcacgataaaaatagcaactacagatattttgatcaagattttaaaaaactgctccataaaaaaaactatagatttagtattaaatttatcacaaaactatataattaaagcaagtaaaaaaactatagatttctaaatataaaattagcacaaaactatagattttagagtttaaattccttgtattaccattatgtcgaaactatgagtgttatagaattttgactaaattggtgctaaatttattttttatgataactttattattaaattagtagttttgtgatacgccatcttaaatttgtagttctgtgataaattaaatgctaaatatataatttgtgatataccaacttaaatttatagttttaggatgatttagtcaaagtattattttgtatcttgtattgcgcattgcaagatacataaatatgaaaatgtccactctcaattaatactctaaactattttttctgttctatatatttgcctcttgcataaaagaatgtctattatgtattcattttcttaggaatatatcgaggagacaaataatgtttttgtatgaatgatttgtgcatattatatatcaaaccttttctcatccaaagtcatcacttcctcatcactttgtcctgtttatttgattcgacagggacagaatgcataaacaagagaacattattagtggcaggagattctattgaagatctgtggcagctacttgaggtaacaaggcaagtgatacttatggtccattactcgtgacgaaaatgagatcgatcgtttgtgtattcatgtctcagtatttatttacaagatatacaaatgtgaaaacgtccactaatatcaattactccctctcaggtaaaaaataattatcattttaaacaaaactaatgttaaactttaaaaactttaactttgaataacttctaaagtattttccttagatcttaaaatgtattttaataaaatcatatatttattagtacttctataatattgtaatgatctctattgtaatagaaaatagtggtaaaaattagtttttggagatcgtgttgttatatccagaacgccaagtatttttaatctggagggagtattactctaaactatttttttctatatatttacgatctcttgcataaaaacatgttcatcatatactcattttctgacgaataaattaccgatctgaagttgatgccaaaatttaggaatctcgtttccgatatacctttcagcctctatcatcagcatctttttgggcaatagactaaccctcacatatgcagtgaatttcccacttgttgcctccacatgaactcctccacgccattcttcctctttcctcctcactacaagcccttcctctcgccctagcttctcaactctgtccagaactgacctggaatccgcacccggcacgacgaatcgaactcgatctggcaatggaccgatcaacccgcttagatcgcatcccgaggcgaacccgattatgtcgaaagcatttagctccattgcttgctccaattcagcctcccagcctcccatttctccacctctagtttagaatgagaggatgcagcttggatcataccgaatgatgacaagctcccatcttgttggaaccaagggtgatcgaagatttcaccaatcttgatacgggtatcgggttccggtcaagcatccgcccgataagagagcggagctccggcgagcaccatttcgggcaccggaacttggcggcgcagatcttccggtacatggccatgaggttgccgtcgttgaacggcaggtagcccgccggtgagcacgaagagcaccacgccccagga

SEQ ID NO: 89950 - DNA, 1209 bp, Oryza sativa
  unsure (1)..(1209): unsure at all n locations
cgcgcatggattgcacttcngtttgtacattgccactatatgaaattgaagtttgcatccctgcacgtcgactctagaggatccccataagtcgttatgaagctatttggtttaatataagaatcctttgactcggttgtgcagcaggcatggggagaaggagaagttgtgcgcaaccttggggacttcaaaaccaagatggcctacacaatggacgaacttgtcaagtggagcaaatcaaagattggcaacataaagaaaggtattgaaagtccgaggaagaaattaggtgaactcagaatggcagggatgcttgactctgaaccaaaggtgaaaaagatcaaagagcagcttcaggaaatgcttcgccgtgaggagatatggtggagacagcgatctcaaatcacttggctgaaggagggtgacaaaaatacaaagtatttccacctgaaagcgtcctggcgagctcggaagaataaagtgaagaaattgcgcaggcctaatggcagcctggtgtcaaatgaaaaggagatgggagaggttgcccgtgatttcttccagaatctatatatgaaagatgaaaatcttgaccctactgaacttttcaatttgttccagacaaaaataacagcggaaatgaatgagtctttgatgaaacccttctctgaggaggagataggagacgtcttgttccagatagggcatttgaaagcgccagggtccgatggtttcccggcgcatttcttccaaagaaattgggacccttaagactgatgttattagagtgtgttaacagtgaaatttggtaagcctggagtagtcaacggcttagagtcagcatcggctttgaagtctgagattagccgatgagagttgtcaagtcgtcagttgtcggattcttgctatattcggttaaggaaattgatctactaaatgaagtttatccagaagagaccgagttcaaagagaatgcggcatggcaagttatctattaattaggaatagtttgtaagtttccttttatctttaggaaagtttctttcttgtcctacaaggactagtatctacccataggtataaatatgtacacccggggtcattgtaaactatcttcacgatcaatacaattcggcgcatcgccacccttttacttctacttttgtttttacgttccggcggaacttggcacccgacatggggctgcatcgt

SEQ ID NO: 89951 - DNA, 3957 bp, Oryza sativa
aacttggcacccgacatggggctgcatcgtcttcgatctccggcgaagggatcagtccaatgttccgtcggcccaggcaattgtatcgtctacgtcggcatcgttcaaggctgcatcagtacattcgacctcttggattactctggtttggataatatatttgcctggctatttatcatatgtctatgttaatctagtcctagcatctcaatttagctctatcggatgtctctcactttagggtttctgccggtatcggctaaatcgccttgctagattagattagtttagacatctaccaccctgaaaactcagtcatcggcttgattgtctagatattatttttctttttatgcttagtgctgcatcagttaagtttgatctactaagtcgtgcttagaaccataatttctagcctgcttcttgattgccaataagggtttcatcggggttacagccaatgagttatctggacgttgcatcggcttacaaggattgcatgtacatataagttggatttagccgatcgcaacaaaggttttactgttttatctaatcctgtggatttaatgacatcggacctccagccgatgtatgctttaaccttcggatcaatacttgttctactatatcatattgttagccgattggtttctactgggctattcggatcagtgcttattatatcttgtttctagccgattggtttctactcggttatattgttattttattacatcatcatcaaccgattgcctttatatcattatctatattggacatatagccgattgcttaaaccctatcgctatcggctggtatcgacatcggctattatcagctatcggttggaactactccatcggcttgtcagccaatcggctgttttatctgctgtttacatattttgtcagttgtaggatcaaattgactggcacgctcgcatctcatcaatctttggaactgcacaggagctaagcagatctcccaggccggtgtgttcgattttttcgtcaacagagtggtacaagcattttttgaaaacggcgaaatgcaggagggagcaaatgacactgtcatagttatgattccaaaaactaagtcaccggaggagatgaaggatttctggcccatcagtctatgtaatgtgatatacaaggtgatagctaaatgccttgttaatctatgtaatgtgatatacaaggtgatagctaaatgccttgttaatcgactcagaccgctccttcatgatgtaatatcaaatgcatagagtgcttttgtatcaggttgcatgatcacagacaacgcgctcatcgctttcgaatgcttccatgccatccaaaaatgcaaaagggagaaccagaatttttgtgctctgaaattagatctttcaaaggcctatgatagagttgattgggcgtttctggatggggtgttgcaaagaatgggttttggagaatcatggaggaagtggacaatgtcatgtatgacatctgttagatacagtatctgtttaaatgggaacctgctagatccttttaccccaacaagaggattgcggcaaggtgatcctcttagtccatacttgtttctgtttattactgacgggttgtcacatattctggagaagaagagcttggaaggttcaatccaaccaattaaggtgtgtcggggagccccggggatctcccacttactttttgctgacgatagcttattgttttttcaagccgaggttgatcaagcgagaatttgctggaggcgctcagtctatacgagaaaagcacagggcagcttattaacccagcaaagtgttctctgttgtttagtgaattttgctcataggagaggcaggaggagatcaaagctgttctgcagattcaaagagcaggttttgaagataaatacctaggccttccaactcccgaaggtaggatgaaatcagaacaattccaaccaatcaagggaagattttctaagagattaacagattggtgtgagaggtttctatcagctgcagggaaggatactctgataaagagtgtagctcaagctctccccacctacacgataggagtgtttaagatgcctgaacatttttgtaatgattatgaatagatggttcgcaatttttggtggggacatgacaaaggggagaggaaagtacattggatatcctgggaaaagctcacgagccctaagcttcatggtggcctgggctttcgggatactcggtctttcaatcaggctttattagcacgtcaagcatggaggttgatcgcggagccgaatagcttgtgcgctcggttgctgaaagcaaagtattaccccaatggctcccttactgatacagctttcccgtccaatacttcaccaacttggaaaggaatcgaacatgggctggaattgctaaagaaaggactgatttggaggataggagacaggcggactaccaagatttggaggaatagatgggtggcgcatggtgagaaagttgaggttatacagaagaagaattggaataggctcacgtatgtacatgagcttttgatccctggaacaaacgcctggaatgaggcattaatcagacatgttgcgacggaggaagatgcaaatgctattctaaagatccatgtgccaaaccaggagacatctcactttcctgcatggcactatgagaaaacaggccttttttcagtaagaagcgcctataagctacttcctccgtttcacaatataagtcattctagcattttccacattcatattgatgttaatgaatttagatagatatatatgtctagattcattaacatcaatatgaatataggaaatgctagaatgacttacattgtgaaacggagggagtagcatggaacttaactaagagtgctcaagttcaggccgcatcaagtactgctaccaatggtgaaaggaagctctgggagaatgtgtggaaggcagacgttcaaccaaaagttaagatttttgcatggaaacttgctcacgacaggctgcccacttgggagaataaacgaaaaagaaggatacaaccagtaggcatctgccctatctgtggtgtaaaggaggaaaatggtttccatgcgactgttgaatgtacaatggcgagatcgttgcgagaagccatcagagagttctgggcgctaccgccggaaaggaagtttgctatgactgggcctgactggctccttgtcctgttggatagcttgaatagttcagacaaggcgcgtgttttgtacttgttgtggagagcatggttcctcaggaatgatatgatccatggaaaggggacggccacaattgcagagtctgtaaatttcctcgtcaactatgagaaggtactgttgccgatccgacaacaaagcgatgacatcaaaggaaaaggattaatgtataatgaaccaatggtgaaattactgcaggttcagacaaccaatcaggttgataaatggcacgcccttcccgaaggttcagcaaaggtaaatgtggatgctggttttatagaagacacaggagtttcagctgctggaatcatcattagagactgcaggggtttagtgctgtttgctgtgcaaaaaaatcctgtgctactgctgtccaagctgaggcattggcatgtctagaaggattaagggcagccatggaatggattcatatgccaagaatcttggaaactgacagcgtagaggtgttcaaggctctgtcacaacaggagctgtcgagatcacccttggcagcgacaataaaggaagcgagagggatgatgcagtgtctctaaagtgtgcaggtttgcaagatcaagagggaagcaaataggattgctcatgctttagctcaaatggctatgaggtctagatcgtgtgtggagtagaagttgtgtgctcccgcaggaatcttaaacaagatagaccaagaatgtaatcatctcggggatcc

SEQ ID NO: 89952 - DNA, 1439 bp, Oryza sativa
tcgtagacgcactcgaatcgagctaattttggaacagaaacataatcttcagttggaaacaagaagtggattcagaatcgaagcaaacttaacaaaaagggaaacaaaaatgaatctgaaatgattggggatcaaatcgaagttaaaaaaaaaaacacccgatgccataaacccaaaccaaaacccagagcgtgaacatttcaaaaccgccgccgccgccgctgtgtcccctagcgccaccggcccgtgagagagagaggaagagtgagacagtcagacagagagtgagagagagaagagagagaggaagagcgagagagagaagagagaggaagagtggaagaggagtatgacaggtgggtttcatattttttaataaatagaatgctgactggattatcacgcgtacaccacgtagaccaaaaccaccgcggattgggtcgagggggttaattcgttcggtatgcatagttgggtgtgaagaatgtccggttttatgattaggggggtaattcggtcgaccactacagtacgggaggtaattcgtactttttccttttataaaggatcctagtggttacaagagcctcagtaacatcttaggtcctgggttcgactccacgagggagcgaattttccaagatttagcggcattgtgctttcagtggtaagcgacgtacccgtcgacaacgaggcgtctgtggtgatttcttcaatctccaggatttactagttcagtcttcgaagatgctcataggggtagggttttgcgtgcgtgtgttagtaaggatgagtgtgcgtgtgctgtgagtatctgtgttgtgctgtgtaatttaaaaaaaaaagaagtacatacagttgttgtaaaaaaatacaactgagtttgtgggtggtagatacgctgccaccatcattatcttcacttgcgagttgtgataagatcatcttcacttccattcgtttttagccttcttgcatgacagcagcaggctgtctagctagtacagggaattttatttccgtatcatgagatcgagtttttccataaaccaaaggcaacagctctaaacgtgttatttcttatagaacaaaaacatccgaatcggaagcattagtggcctcataaacaggagcatgaattaattaacaacatggatcgaagtgttaaaactagattattctttccaatcacctacttattaaagaccaaacgacagctacgaaagagtcacccccgatcgaaactcgaaattaaagttgtagtccatccaatagtcatattttatcttagcacacagaccaacgataagtgtttctacttatcatctatttaaacatgatactagtcattcctcgtaaacaagcgattcattaatatttacatttctcgatgtccatgtagccaatcttgtgtggaagaatggagagtcacgcattaa

SEQ ID NO: 89953 - DNA, 883 bp, Oryza sativa
tgcgtgcaaagcccatacatattctacgcgcaactgtcacgcacaaaaacgaagtttttagtaccacatggaaaatctatgacgactgacaccggcataaaagacgacgcgctcgcatcgctcctggcgagctcggtggcgtgagcttgttaccccagctgcgggggggcgggagttggcatgtttcggctgctggagaaaatgaggtttctccctcgatcgaatatggatgcaaacatcctcccgactttggcccacgagggagggaaggtgtgagtcaccctgggctcttgacggctgcgtcatggagcgaagaggacgctgaatcgtgggagaggtgtgtggtggccggtgcccgacgacggcgcctggcgatgcgtggggagaaggcgagcagttgtatgtgaagaggacgctgaatcgtgggagaggtgtgtggtggccggtgcccgacgacggcgcctggcgatgggtggggagaaggcgagcagttgtagttgggacccgccacaccccgcacgtgcgcaagtccatgacgtgagcgctcccggtcattaggagccacgtcagctggcggcctccgccgttgagcttttccctgccaaccgacaccctttttcccacccattggcgaatgccctatagggttgggttgagataggagtagaggggagtgaggtggaagaagattgctaggtggcttgtgggctccacgtgggccctgcactgactcaaccaccacgttaacaaaaccggaaagcaatactaccttgggattaaaagtggaccgttttgcaagataaggggtcagggcccgttaaaactcaacgacaagataaggaccctagataacttttttggagatgaggcgcctgtgcatatt

SEQ ID NO: 89954 - DNA, 730 bp, Oryza sativa
aggtggtcatccgatttcttctctattcaccaaacgcagtttcgttgaaatttaggtacaaacttgtagggcctgatcatcaccctgcaatcgtctgttcgtacaagaaggtcatccgttcctcacattgcaccaaagcctctgaataatgatcaagaacgctggaatgggtttgagtaacgtacagattctcaaacttcatacagtcactatcatataaaggtcatgttgatcatgcttcacaattgagcaacattctaggagcattcattcctgttcccattgcagcaccattcaaaccagcttctccatatttatcatatattgatcgcttctcatcatcagccaagacctgcaatcctatttatgttagaagcaaggtacctgtagccctacgtcagcatagtcataagaacctctgggatttggttatggtcagctgtactaacctcataagcattgctaatatccatgaacttttgttcagcaccaggatctctaaagaaaaatacacaagcatcccgattgcgttatttgattatgtagttatgagaaaggtaatgcaccacctagtaatcaggtttataatggatcgaaagcagataaagaagcaatatatcgagtgtatctgaaacgcaattcccatataatggttagtgcacacttgttcacctcaggatggtagctcccagcaatcttcttataggctggaaaagaaggaccattttag

SEQ ID NO: 89955 - DNA, 1458 bp, Oryza sativa
  unsure (1)..(1458): unsure at all n locations
cgcgcccattgagnntttgattgaccattaggcgacacattgactatagggccaattcgagctgggtgcccttatcaccacattgaaataaatcgtcttatatacatattgttacagcaaaatattacgttgatgccatatgtaatatgaaaaacgtgccttgcacgtgcatgaatactagtttttttaaagtcactctttcatgactgaataaactaagaaacatcataaatccttctttctagtttccaccctcgttgtttctgctacactttttgcttctatactaaattagttacgtctaggttatgcttctatgatacaaagtgagcgaggctcaactaaagaatgccttgtacactacatcttgtcaggaaggatggacaacaagatggctttcaattgaaactaatatgcatatatgaaagtcattaatataccattgtttaaaactttgaaatcatatcttgatgtcgcttgaaacaacatatttgcatgaagtgacacgtttggtcgacaagcgcatgtcatattcacaatgatcatgcatatgcggcctttcatatgcgcttattttagtagtggatgaagaatcaatgtggattgctacatctttacgtgctttgtatgttcttcgattttgttgtagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaatgatggtaattagttacgacgatgtactaggatatatcaccccgagtttcacatgtcaaatatgatgatatctgagcctatttttaacttccaaaccactatattgttaaaactcagtacaataaaccgccaagggtggtaatgctactaggtgcactatagtacctagggtagataccatatctagatggcaagttcaaagccaacagagcttgggctggagcttgagccagattccgatcaaagtagagatcatcaaactgctggagttgtagctgctgcgctatgacctgaaaaatgttaatatcctcatagtgagactgttgcgccaccagccaaagctggtgccagacttggttgtttctcagttgaaacgcaactgattgcaataaggggcttgccgtatgccatactgctgccttacgaactcattatatgggctaagcacctgttgctgtagcaggagaagcgactgcagctgatattgcctataactttgacctaaaacatcaaactgcgcagaggcgctgcatgcagcaatagtaagaagagcaaaggcgaaaatgatcttcattgctacgggacactagatcttntctttttgctgtataatgccttgactgtgtgaacgatggngagggtttncattgcgcttgtctatttat

SEQ ID NO: 89956 - DNA, 721 bp, Oryza sativa
cgctgctggggacgtcgccggggacggcgttcattgagtcgtcgacggggatcagggagggcgggaggacggggctgacggcgctcaccgcggcggcctacttcgcggaggagctgttcgtcacgccgctgctggcgtcgatcccgtcgtgggcagttggcccgccgctggtgctcgtcggcgtgatgatgatgcgcgcggtggcggaagtggactgggccgacatgaggcaggccgtgccggcgttactcaacctggcgctcatgccgctcacctactccatcggctactgcctcatcggcggcatcgccttctacatgctgctaaacttatgggactgggcctggcacgccgcacaggggctccgatcccggcacctgaaaggggctcgcgcctagacgaggagcgcccccgccggagacaatggtgaacagaggaagaacttggaaaaggcttaattagcctttcttttatgcaacaattctttttagaagaattagaaggggactaggacttgctttttatacctggaggagggttcaaaagggctaagaaggatggtcaagtgaagttaataaataagttcaatgccagaaggcctggccattttcgggagggcataattacacaaaaatcgttttttgaaataaaaaatccgccttttacaataattttgagaacttgcgaaagaattccccatttgtccatggaatgacatggg

SEQ ID NO: 89957 - DNA, 2733 bp, Oryza sativa
  unsure (1)..(2733): unsure at all n locations
aagaagtggtggcgcacacccctactccctccgggagtgacgatgctagcgggagccgcggcccccaccaccgtcgcaacaactctcccactcctgcccaccgcgacccccccacagagggaggaacctctccccgccgccgcgcggggagaaaccgcgcagtgtcggggcacggggccgcctgacatacggcaacggcggctcatcccgaggcgcactttaggcggcgggagcccttctacggcatccccccataaattcggagccggagacccctgtccagcgatggttggacaacatgaccaacctggtcaccactgcccagcggtagcaggctgcgggtggccgacccgccgcctctggtacctcgcgtaacccaccgctctttcctcgtcagcaagaaggagggcccgtcggtcggccctgacttcgaggtggtcgacggccccaacgtcatcgaggatctcgggaagccggggacgtcatggtggcctctacgaggagggacgctcgaatcaacattgagcaacacagggacgagcactgggcggcccgcatggggagggcgcctcctcatccggagtgccccgctcctccacgcgaggcggcccgcccctcacatttacccctggagggaccagttgcagggccttcaaggcgagtctccagagtccggtggcccccgaagtttcgccccaacctcacggagaaatatgatggcagcacgatcatcatgatgcggggggcgacgactaggtcatggcgaattacttccccatggctcttaaaggtcaggtgcgcggctggcttatgactcagccccccgactccatccactcctgggaggacctgtgccagcagttcattacgaactttcaaggcacgtatccccgcccaggagaggaggcagacctgcacgctatacaacggaaggacgacgagtccctccgctcatacatacagcgcttctgccaggtccgcaacactattccctgcataccggcccacgcggtcgtttatgtgttctagaacggcgtgcgacacaactgcatgctagagaagattgcctccaaggagcccaagaccatcgccgagcacttcgagctggcggacaaggtggctcgaaaggaggaagcgtgggcctggaactctcccggcaccggcgcggcggctgcagctgcccccgagcccgcttcccccccccccccaagggggaagaggaagccggcccactctgatgacgagggccacgtccttgcggccgatgggccctcttgggccccgtgcaaagaaagagccaccggcaacaagccgagctccactaccccccccccccggcgaaggtcggtctgcggataagtggtgctcgatgcacaacacctatcggcacagatcggcacagcctcaccgactgcagctcggtcaggtacttggccgagcggtacagaaagaccgatgaggagaagcggcagagtcaacgggagggcaaggcccccgcgacccccgctagcgaccggcggggggaggccaataaaaaggcccccgccgatgatgatgatgacagcgaggacctggaattccagatacctcagggaaccgtcgccactcgcgacggggggtttgcgctcacacctcccgccgcagtttcaaggccatgaggcatgagcttctggccgcgatcccaactcacgaggcaacatggaaggcgcgctggtcggaagtgaaactgaccttcgaccagagcgaccatccgacggtgctcgcttggggagggaagttggccctcgtgatctcccgaaccatccacaacatcaagatgaagtgtcctctagtcaacgggggggccggcctcagcatcatctccccggctgcctttgatgcccttaagtccccggggatgaagcttcagccgtacctgccgatcatcggcgtgaccccgggacacacgtagcttctgggtcacgttgagctcccggtaacctttcgtgactctaccaacctccgcaccgagcgggtcgacttcgatgtggcggatcttaatatgccctacagtgcggttttgggaggcccgcgttggtgaagttcatggccgccacccactacgcctacctccagataaagatgccaggccacagtggccccatcaccgtctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatgggtaccgagctcgaattcggcctgtttcaaacgatncgtcttactatgggacac

SEQ ID NO: 89958 - DNA, 1334 bp, Oryza sativa
aaccccaggaatatcgagcatctacaccgtttctacccataatgtcgcgcgttttttgctttcttggggctcgggccaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaacgagccccgaggggcgggacaaagggagtaaaaatggcaacttgatcgtaaagaagtcaactaaatgcgttcgctttgtttttttccttgccgcaggcatttagaagagaaagcacggatgtaaaagtgcaaaggagaagctttattacaaccaggatggcacaatggcctagagtttcaagcgttcaccacgagcacataacataataaaggaggagaggcgggggcaatcacggagtgcctgggcctccaagtacagcgccgctgaccaccttgtcccaatccttgttgccatcatcgtcgccgccgtcatcactcccgctctcctcatctgagggaagcgcgagggtgaaccaaggggccgtcccctcaaagcttgagatgatcacgtcggacgcgtcccgaacttgctcctgagccctcgtctcaatccctgggggaaatcctcgagcacgtgccacggaaggatgttggggtcgcgagcttgatgactcgcgaggacaagctccaccgcagcccgtgccaaggaagccgatgacgacttcacgggctcgccgaccttctgctacagccttttaagatccgccgccattttgtccagccgaagcgcgagcgccggtcttgtgggcacgagcttcttgtcccggcgcacgaagatgcccacccggcgtcccacgcacttcagccgttcgatggcatcgtaaagttggccaggcccgatgtcgttggtgaggtggagggccgcgatctccccagcctggttctgtaccagacaccccaggttggcgagagtatcttggccgccggtgagctggctgaccaactcggcgtcgccggact

SEQ ID NO: 89959 - DNA, 676 bp, Oryza sativa
  unsure (1)..(676): unsure at all n locations
atcaatatcatataaaggtcatgctgatcatacttcagaattggacaacattctaggaacactcactcctgttcccattccagcacccttcaaaccagcttctccatatttatcatagattgatcgcttctcatcatcagacaaaacctgcaatcctatttatgttagctggcaagcacctgtaaccctacaacaacatagtcataagaaacaatgggatttggttatggttagctggactaacctcataagcattgctaatatccttgaacttttgttcagcaccaggatctctaaagaaaaatacacaagcataacaattgcttatttgattatgtagttatgaaaaaggtaatgcaacaactagtactcaggtttataatggatcgaaaggagaaaaagaagcaatatatcgagtgtagctgaaacacaattcccatataatggttagtacttacttgttcacatcaggatggtagctcctagcaagcttcctataggctggaaaagaaggaccattttagaactacaattgaaagccacattaaactactacacatattttgatcaaaattgactctgaaggattctaacataatatccccttaggcattattggataggacacattctagattatctaccggtcgtgggntgggnatttttgttcaaatta

SEQ ID NO: 89960 - DNA, 1541 bp, Oryza sativa
tctttggcgatgtcaaagtcaccctggcttgtgcagagcagcgcgccgataacttggcggcagccaccaagccgcaggccccggagccctccacaccccgcgcctccaagaggcgcctcgcctcggccgacgagttgcccgtcaaggagattccccttggcgatgatccatccaagaccgccaagattggcagtaccttggacgccaaataggaaagtgtgctcgtctccttcttgcgggcgaactccgacgtcttcgcgtgaaagccatcggatatgcccggggtccccagggaggtgatcgagcaccgcctcgcagtgcggccagatgcgtgacccgtccagcagaaagtacggcaccaagccccggagcggcaagccttcatccgagaggaggtgatgcggctcctggaatccgagaagtcatccacccagagtggctggcaaacccggtggtcgtctcaaaggccaacggcaagctccggatgtgcatcgactacacggacctcaacaaggcatgccctaaggatcccttccctttaccacgcatagatcagatagtcgactccactgcggggtgcgaccttttgtgttgtttagatgcctactccgggtatcactagatccgcatgactaggaaagataaggaaaaaactgctttcattattcctgtaggcaccttttgttatacaactatgctttttggtctcaagaacacaggccctacattttagcgcatgactcgtattactttgagtgatcaaataggcgtaatgtagaggtgtatgtcgatgacttggtggtaaagacgcgccaccaggacacgttgttgcaagacctagctgagactttcgacagcctcaggtccacgtgcatgaaactgaaccccgagaagtgtgtgtttggtgtgccggcgggcaaactcctcggtttttttagtttcctcatgaggcatagaagctaatcccgagaaaatacgcgcgatagagaggatgcgccccccagcaaacttagggatgtgcagtgcgtcacgggatgcatgcccgccctgagtcgattaatatcgaggctgggaaagagggcgttgcccctattcaagctcctcaaacgctctgggccgtttgtatggtcggaggaagcggagcaagctctcagccagctgaaagcttacctcacctcccccctatcctagtggccccgggaccagaggaaccgttgctgctctacttggctgtgaccccccattcggtgagtgccgcccttgtagtagagcgtgacgaaggtgacctgcgtcgcgagcccggctatgggaagggaccaggggtccccttaactagtgatggcccctcgtcccccaacagcccgatgcccgaagcccccaacccccgggaaggccctgaggtccccgtgggagagagagaggccccggcggacggccccgaggcctgtcgcactgacgtggctcgagaccccctcggggcccccgagcacgggcgccccgagctaggttgccctaacgacaaaggtcgaccccaccgaaag

SEQ ID NO: 89961 - DNA, 2057 bp, Oryza sativa
  unsure (1)..(2057): unsure at all n locations
tgggccctttgnnggtgtggattccgattcactatgggcgaattcgagctcggtaccccgtctatttcatcagctaggcactccgagatgcgaaaacctgataccctcaggcccagaagatgctttacgcagtcttgatggcctcaaggaaattgcgccattacttccaagcgcatcgggtttccgttgtaacgtcttaccctctcggccagatcctgcacaaccgagagggcactggtcggatcgtgaattgggccatcgagctcgctgagttcgatctgcactttgaaccacagcacacgatcaaaagccaggttttggctgacttcaacgctgagtggaccccggcggacgactctattccgtcccatattccctccctccccggagatggagaagacccgaacgccgatattcgcaccggacattgggttatgcactttgacggctctctcaaccttcaaggtgcagggaccggagtcacgctgacttcgccaagcggggatgtcctcaagtacgtcgttcgacttgatttccgagccacgaacaatatggcagaatacaaaggactcatagcgggactgagagcggcagccggaatgggcatccgctgcctcctagttctaagcgattcccaactggtcatgaaccaggtcttttggcccaacccgctcttttggcccttcgcggtctggggtctagacatcctagggcccttcaaagcggccgaggcgggtaccagcacctatacgtcgccatcgacaagtttaccaagtggcccgaggcttacccggtcgtcaagatcaactggcattatgccctcaagttcatcaggggcatcacatcccgattcggagtacccaaccgtatcatcacagacaacggcacccagttcaccagtgagctattcagcgactactacgacgacatgggcatcaagctgtgcttcgcctcgctcgcccaccccaagagcaacggccaagttgagcgggccaatgccgaaatcctcaaaggcctcaagaccaagacgtacaacatcctaaagaagcacgggtattcttggctcgaggagcaacccgcggtgctgtgcgcgaatcggaccaccccgagccacgccacgggggaaacgcctttttccctggtgtacggccctgaggcggtcctatgctcggagctttccctacgtttgcctcacgtcgcgctgtacgatgaggccaaccaagatgatcttcacagcgatgacctcgattatttggaagaacggagaaggcgcgccgccctatgtgcggcgcgctaccagcaaagcttgcggcgctaccatcagcgccacgtccgagcccgatcactacaagtcagcgacctcgtcctacgccgcatacagtcgtgtttagggctgagcaagctctcaccaatgtaggaagggccatacaaagtgatcggtgtcccccggccgggctcggttcgactaaccatggaggacggcacggagttgcctaaccccaggaatatcgagcatctccaccgtttctacccataatgtcgcgcgttttttgctttcttggggctcgggccaacccccgcacactcctcagcctgtgcgggcttggccgagggctaccactgttaaatatgttgtatccaatccctccctcagcaataaatttttctgcttaatcaaaagctgttgcgcgccctttcttactccttcctatggctcgtcctggcttaaggacgattcgcgcttgctccggaccctaagtggcgttggataacctgaaaataaccgaaggggagcctgaacgcgggccgtgccccgggctgcagcgaaccctaggggctcggaagggcctacacatggccatccccgacccccgatcaccgtggcctcggtctggttagtcccgctgggcggctcccctggagcgacggccttgcccctcgccacctaagtgtcgcggaccaagtgcaaattccccctttttaccggaaccaaaccgaggggcgggacaaagggagtaaaaaggcaacttgatcgtaaagaagtcaactaaatgcgt

SEQ ID NO: 89962 - DNA, 1600 bp, Oryza sativa
acgagatttcttttgcatggcattcagaatacagcagtccctaatggtcgccctttatgatttacaggtacaggcaccttggccagtttgctccactgggtggagagcaaacagccgctcaattgccgggtgattggatacatgttggtcacagcacccaatggctatggtattctgtctatgccaggtattaataatgccaccctactgaacatgcttgtcttcctttctgcacttcatcttccctcgcatgtatggacgtgtcgtgtagagtttttaatggcgttttgctcttatggaatgcagtaagcaattcagctggcgcaccaggatgctggtagtatctgattggggcaggcggttcatctatggaagggactcaagcagcctataaattgaactaggatggtgttgttcaccgccctgcattttgccaactgaagctctattagacttggataatacaatttttgcataccttcggaaacaactatttttgcatacagcatcattttttttagagagagagagcatcgttatatttgttcggctattttcacaagctcaggtttctgtagcgtagcaaggttttgtcaccaatttttgatcttgccgatatttctatgacacaatggaggttaaatgatttatacatcagtactttataatacagttcagtatcctagtaatttaaatgttgatgttatgtgttttttttacctcgtccttctcttctagcgagatgacgctaaccacagattcaattccctgtggaggccttcctttagttgtttaggaagattaccgttaattatcttcttgaattgttgctgatggagataataaaagcagaacagagcctagttccgcctttctcatccattccaatttcctgataaagtgaacgtacatcagtaccatttgaaggatacgtgcatcagcaaaataatgaaattcttgaaccaataaatattcccaaatcgaaatttgaatcctaatcctcgtccaaaaaaaaagaaaaaagaatcccaacatccggttttgagcaaaaaagcaacagaattttgatctgtttccaatgaaaacctgtttgagcagaaatttggaaaccgatgaaaacgtgagaacaaagatggcaaaccagtttgagtggaaaaccaatcggtgcagtaaaatcgacgaaatcaaacaatatcccagaacatctataggctcaacaaacgtatattacaaatcgacgaaaaaagaaagaaaccaagcgcatgtgcaagccccagaagctacaagctgtgagataccccgaactcaaagaataattaacccaaagaataattaaattatttaccactggacccatatatcatagacaacgaatgacagataattaattgccacgtaacccaaaggtacaagtgcggtgtaacgttggtgtgcaagccccagaacaagcagcgagacaccgcacggtgctacccgtggaccggatctggatcgatcgttgcaggaaggaggaaacggccatcagtagacgcatgcacaattagcgcgccattgggattatctgtgggcgcgcttctgggcacggagaacttcattgcct

SEQ ID NO: 89963 - DNA, 832 bp, Oryza sativa
tgaaggacttccatgacctactcaaagattcagacgggaatgctattaaggagtcaaaagagctgaacatagaggaattcaagaaagcccttgctcgagtggactcgcaagttaagatgctcccagcaacagctcaggtaattattcatgtctaccattagagagtttgcactttgcacatagggaaagaaatctgttgcaatatatgtcaaattgatgtgtccttaaatatctacaaaccattatatgttttccaaatgagattgggtatatttgtagtctttatgtgccaaattaaattgttgacccaaacacaaagaaccatcttactaattggttgtatggatgtatatagttccttggttttgtcacatatggtggatgaggtaatttcttgatcttagtgacaaaaaaagtgccttagacttctgaatggagggagtaaatttttgtggttttgtcacatggtggatgaggtaatttcttgatcttagtgacaaaaaaagtggcttagatttttgaatggagggagtaaatttttgtttggcattttatatgtcaaattgatgtgtctttgaatatctacaaaccgtttcatgtattctgaattttcgtttggcacttcaggttgcttcacaaaagggagcctatctggcaaactgcttcaacaagatgaaatactgtgaagagaaccctaaaggtccgttgaggatcagaggcacagggcgtcatcggttcaaacctttcaggtttgttttcccttgctctcttagcatacatacattaggcacttaaacactgctgaccatgttgatatggatttacggatgaa

SEQ ID NO: 89964 - DNA, 1200 bp, Oryza sativa
  unsure (1)..(1200): unsure at all n locations
atcttccagtatatatagcaaatcctaatcaccttctaaatcttttaaaaaggaaattatgcaaaaaaaaaagctaattaagccatttccaagttcttcctctgttccccattgtctccggcggcggcgctcctcgtctcggcgcgcgcccctctccggcgccgggagcggagcaccgcgacggcgtggcaggcccagtcccatgagttgagcagcatgtaggaggcgatgccgccgatgaggccgtaggcgatggagtaggtgagcggcatgagcgccagggtgaggaacgccggcacggcctgcctcatgtcggcccagtccacctccgccaccgcgcgcatcatcatcacgccgacgagcaccagcggcgggccaactgcccacgacgggatcgacgccagcagcggcgtgacgaacagcgccgccgcgaagtaggccgccgcggtgagcgccgtcagccccgtcctcccgccctccctgatccccgtcgacgactcgatgaacgccgtcaccggcgacgtccccagcagcgacccgaacacgatggccgtcgcgtcggacatgaaggcgaagtactgcccctcgaagtcccccgtcgcgtcgtccacgaagccggcgaacctcgccatggagtagagcccccccgtggtgtcgaggatgtccacgtacaggaacgtgaagagcgcctcccaaaagtacccgggcggcttccccgaaagtcagccccccggcggggaattgatgcgggcacctcaacaccttcttgaagacccgagcttttttccccgggggcgtgtccggaacacctgacngcgggtttcccgccaggaatgaagggacaaaaagaatgccaaacaatgccccttgaccttttataagcgaaaggcatattagaaccccaacggtaaccacaaggtgggaagtatcccccgaacagaaatttcccccgaacgggcccccgttgagcccccctgccttggggacttaaaccggcccagaccccgttgaaccggacccccagggaagaggttaaataacccaaggccccctctttttttcccctaaaccaaaaaccctccccgcaaatttccggcttggaaacacgcactttcccccccaggaaaaagaaataaccctaaaaacccccgccttgggatcccccctacacccctctgaataatttctcccggggcgcgg

SEQ ID NO: 89965 - DNA, 1901 bp, Oryza sativa
  unsure (1)..(1901): unsure at all n locations
ggaggaggaagagttaaaacaaaaagaacccgggaaaaatataattgcggagagatggaccggtgtgaaaatagaaatgttttcagtgtacaaccgggcgggccgtttattacccggttaaaaaccgacccttgggggggtaacccttatatgaagcactcttaacaagaacgccaaaatcctggcgataccctataaccttttgcaataaaacaggtaaaaatgaggttcaagccgcttagtgatccacttaattttcagcctaggcattaaagaaaaaaatttctgccatcagaccaatcttagtttcagggggtagttgtctaactaatctattctacaaggcgttttacccaaccggcagaaccctaaagtagaaccacncattaaagttaattgaaagctaggctaggttacaatggcatttgtaaataccaggccaatatatatccaacccagagtattcaaggagttcgaatgttctgatcaagcttggaacgatgccaagtaagacgatacaattgcctgggcgacggaacattggactgatccccttcgccggagatcaaagccgatgcagccccatgtcggggtgccaagttccgccggaacgtaaaaacaaaagtagaagtaaaagggtggcgatgcgcggaattgtattgatcgtgaagatagtttacaatgaccccgggtgtacatatttatacctatgggtagatactagtccttgtaggacaagaaagaaactttcctaaagataaaaggaaacttacaaactattcctaattaatagataacttgccatgccgcattctctttgaactcggtctcttctggataaacttcatttagtagatcaatttccttaaccgaatatagcaagaatccgacaactgacgacttgacaactctcatcggctaatctcagacttcaaagccgatgctgactctaagccgttgactactccaggcttaccaaatttcactgttaacacactctaataacatcagtcttaagggtcccaatttctttggaagaaatgcgccgggaaaccatcggaccctggcgctttcaaatgccctatctggaacaagacgtctcctatctcctcctcagagaagggtttcatcaaagactcattcatttccgctgttatttttgtctggaacaaattgaaaagttcagtagggtcaagattttcatctttcatatatagattctggaagaaatcacgggcaacctctcccatctccttttcatttgacaccaggctgccattaggcctgcgcaatttcttcactttattcttccgagctcgccaggacgctttcaggtggaaatactttgtatttttgtcaccctccttcagccaagtgatttgagatcgctgtctccaccatatctcctcacggcgaagcatttcctgaagctgctctttgatctttttcacctctggttcagagtcaagcatccctgccattctgagttcacctaatttcttcctgcgactttcaatacctttctttatgttgccaatctttgatttgctccacttgacaagttcgtccattgtgtatgccatcttggttttgaagtccccaaggttgcgcacaacttctccttctccccatgcctgctggacaaccgagtcaaaggattcttctctttcccaaatagcttcataacgacttatcttcacactgttatgaacaagttcttcttctaatctctccagtagcaacggtacatggtcggaactaggtgtaacaaggtgtgtgatgcttgcctgtctaaatctgcccagccatgcntgcgangctactgctcgatccagtcgtactcttaccattgttgcacctctttgattgtatcatacgtccatgggcactcatgaaaacca

SEQ ID NO: 89966 - DNA, 780 bp, Oryza sativa
ccggttgattgcctttcaagtacacgatcactatgggcgaattcgagctcggtaccctgaaacaacatatttgcatgaagtgacacgtttggtcgacaagggcatgtcatattcacaatgatcatgcatatgcggcctttcatatgcgcttattttagtagtggatgaagaatcaatgtggattgctacatctttacgtgctttgtatgttcttcgattttgttgtagtggatttagtatttgccatatgtgcttcgtgtttgttcttattggaattaaaggatggacatcctttatacgctccatttatatcttaaagacaaagtagcttcggatcgaatataagcacacagtaaaattgtagagtaccaacgatggtaattagttacgacgatgtactaggatatatcaccccgagtttcacatgtcaaatatgatgatatctgagcctatttttaacttccaaaccactatattgttaaaactcagtacaataaaccgccaagggtggtaatgctactaggtgcactatagtacctagggtagataccatatctagatggcaagttcaaagccaacagagcttgggctggagcttgagccagattccgatcaaagtagagatcatcaaactgctggagttgtagctgctgcgctatgacctgaaaaatggtaatatcctcatagtgagactgttgcgccaccagccaaagctgttgccagactttgttgtttttcagttgaaacgcaactgattgcaataaggggcttgccgttatg

SEQ ID NO: 89967 - DNA, 1825 bp, Oryza sativa
  unsure (1)..(1825): unsure at all n locations
ccgctttgatgactgactcatctagtgcgaattcgagctcgtacccgcattcgccaatgggtggggagaagggtgtccgttggcaaggaaaaagctaacggcgggagccgtcttctgacgtggctcctaaatgaccgggagcgctcacgtcatgaacttgcgcacgtgcgggggtgtggcacgggtcccaactacaacttgttcgctttctccccacccatcgccaggcgccgtcgtcgggcaccggccaccacacacctctcccacgattcagcgtcctcttcacatacaactgctcgccttctccccacgcatcgccaggcgccgtcgtcgggcaccggccaccacacacctctcccacgattcagcgtcctcttcgctccatgacgcagccgtcaagagcccagggtgactcacaccttccctccctcgtgggccaaagtcgggaggatgtttgcatccatattcgatcgagggagaaacctcattttctccagcagccgaaacatgccaactcccgcccccccgcagctggggtaacaagctcacgccaccgagctcgccaggagcgatgcgagcgcgtcgtcttttatgccggtgtcagtcgtcatagattttccatgtggtactaaaaacttcgtttttgtgcgtgacagttgcgcgtagaatatgtatgggctttgcacgcacgccggcccgaagtctcgaaattatccaggatcatcatgcgccgtccctcgtgaaggccgccgccgccgggtccgtcgccggcgaacagcgtggccaccgccataagccacccgctgatccgcccatgcacaacagcccatcctgttgcagccactcctcgccgccggcacaaccaccaccaccgggctttctcaccgacaccaccggcgacggcagcggcagcctgacggccaatgttctgcacaatgtcaatctcctgcatatcaatcacactcccaaccctgaaatggtggaatacctgctagtattccactgcagatcaaacactttcctttggttggcttgtagagtagagatagggtacagtctgcaaacagaattggttcatcggcactggatataggatacagcttgcattgcaacagagtttgcagaatgcatggctttactaaagagggatcacccttacaatttttgcgctgttttattggactgaaaattaacacaaatcaatgtacccagtgacttgccatcagccaagcagctgtcttttcggttttcagaatggattcggtaaagtttaagactcccgagcaggaattttaggcactgtattgccattagataaatcggtggataatatacatattggtttgccaaacacttggaacaagccacaaaattcgagttaacttttatttgattgaggaattcacaaaccgtttatacaaggtctagtacccaagaaaataatagcgtcctgaacaaacaaaaggacaaggaaagaacaaggctggttcttgtcaagaaacaatgtaacttgaaattaaatgcaaggtagattaaaacgatattgcgttatgagaagggagggagaaatgttccaagcccgnggcctctgggctttgacactgtagggggttaccgatattggttaacaagttggacccaaaaaatacttcattttctacttcctaaactcaggtaagagggagaacgggaaaatatttttctcattgagaaaaagagcccgtgggggtggggatctcaaacttttaacctgtgaaacctcgggggtaaaaaattttccttgggaacacgggaagaaaaattctcttgggttttaattctttag

SEQ ID NO: 89968 - DNA, 979 bp, Oryza sativa
acagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgactcttatccttgcgaccgcgatcttccgaaacgacggattctacacgctggcacgcaaaacgaggaaaaactctaataaaaaccaaggaaatagtatataaaaagtaaacaaacatgtagagctcaattttagatgaattttgcaagttgaatggcccaatttggagttcgtatgaattagatatgaattttagaagttttgagccatttaaatgaattcttagaattaaactcgatttattgcgcaattattatttatttttccaaaggaaaagagggttgttgacgtcatcaaaggggaggggcggcgccggcaagcgggccccaccggtcagcggcacaagggcgtcggtccaccgtggaccgggaccaccgaggcggcccaccgccggtccacgggaaccgacggccggatcggcccaaagccgatcgaacggccacgaggcggcgcggctggggcacggtgtcacaccctaaaaatcctaaatatataaattgttgtttaattggaattattagaatttattttaaaagcctagaagagaagatctaattttaattaataaattccaatataaaatggggccagataaaatttcattaaatactttgcttaattctataattcctagattttctgggatttatttgagctaaggaagtatttttaataaatggaattacatttaagaaataatttaaattgaaaaaggttttaaaagtcttcttttggctttgggccgaaagtcggcccaaaaccgctctctctctcctcggcccaagtcggcccagtccgccgcgcgcgcgcg

SEQ ID NO: 89969 - DNA, 689 bp, Oryza sativa
tgtggtatgccaacatagtaaactacatggtatccaagtacgtaccaccaggggaaatcaatgaaaactgaagtatgaaagccgccgtcacatatgggatgagccatacctgtatcgggtctgctccgatggcttactacgaagatgtgtgccaactgaagaaggacttaagatcatagaacgatgccatgcctcaccctatggtggccattacggtgcattccgcacccaggccaagatttggcaaagtggcttcttctggaccaacgatgtacaaagacttaaaagaattcgtcagaagatgcacaagctgccaaaggcaaggaggaatcactgctcgccatgcaatgcccctcacatacaatttgtaagtcgagatattcgatgtttagggtatagacttcatgggacctttccctaagtctcgcaactgcgagtacattctggtggcagtcgactatgtctccaagtgggtagaggctatgtcgtgcagcgctgcggatgcaaggcatgccaagaagatgttcacagaaatcatcttcccaagatttggtacccccagaatggtcataagtgacggaggttctcatttcattgataaaaccttccgagacctcctacgagaaatgggagccaaacacaatgtggctactccttaccatccacagaccagtggacaagaagaaaca

SEQ ID NO: 89970 - DNA, 1053 bp, Oryza sativa
gttcgagtggccgagatccaccccgtccacccctcctccgtcgaggttcgccgccggagcatcattcccgccgtgcgacggtgagagccgccatgtccgccgccttcagccatggtttccgatcgccggggtccatctccctccccctaatctctctcttttcctctcttagggcctcccggagctcgtccgcccgccgccgttgtcctccagtggctcgccgtcaccgttcgccgtcgttctcctccgcgccggccactctcggtgaggcatacctcctcctctattcccctccctctccctcctagccgcgccgggtcgagccgccgccccggtcgtgcgccgccgcttttgcgccgccgcctcccgccgctggttgccgttgccggcaacacgcgcgcgcgccgccgaccttgccatggccggccggccggctttgtgccgagccgagccgagccaggccgccgccgcaccgtccgatcggccccgggccgatccgggccgttgatcccgtggaccggcggtgaaccacccgcgtggtcccggtccacggtagaccggcccctgtgcgccactgacatgcgggccccgcctgtcggcgccgtccccccttgatgacgtctgccctgggatttatttcgcaataaatgatttaaggacttttgttatagtaataaatacagtgaatcttctaaaattcataactaattcatccgtgctccgtttaagcccattcaagtcttagtaaatcaagaaaaatgtgtagaatccattaaaaatggttttgttctctgtttcagtagtcgtatagcctgtttgtattgtttgctttgtatgtcgcttagattccggttcttccgacgctccggtgtacttcgaaatagtcgccgaggttcctccagcaacagagcaaggcatgtcatgcttgtcacttgaacatgttgatcctatatttcaaatgctctattgtttttcttcaaatactgcatcgttttataatgttactatgggatgtttacctattgtcatagccatgctattgttgtaccatgt

SEQ ID NO: 89971 - DNA, 726 bp, Oryza sativa
ctgttccagtttaacctgactgcaatctattttgttttaattgctgctccttcatgatatcaaagctcggttaaccgttacatatgaaagaaatggatgaattatttaatgtggtgcaagaattttgtgatattgaaggtgttccagttccaaacatgtacgaagaaatactggtaagtaggggtgaaaacggtacggaaatttccgagaattccggcaaccgtttccggtttgcaccgaccgtttcaatcggtatcggtaattgtcggtatcggaaatggaaacggtaatctctttcggaaatggtagcggaaatgatatggggttttttccgaccgttttgtcggtaactgttttttatcggtaatttccgtcaaatttccgacaaaattccgaagaaggaagtcggctaggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctcctt

SEQ ID NO: 89972 - DNA, 1489 bp, Oryza sativa
tttctatggaatcagcttgcatcacctaaacccgaattccatagtgcatatcgccaatttcgtccatgtttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatatttggaactcttttccaatcggagatgaagcagtacaagccttggagttgctggatcgtatgttaaatcttaaagaacaaggcctacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaagcatcttgttcaggaatatgcattgatgaagtcagatccaccagtctctcagcgccggtctcctcgccaacacaccgctcagggaggcggagggccaacgatcagaccagatccgcaacctcagacctccaaattgactggtcaaacaggtcctcgcaagagaaagctggtacttgatgatgatgaaggcgacgataataaatctggggataagggctcgcctaataaacccccaaagcgtaccatgcccaggaaaaaactggctggccgtgcaatgccaaagatcagaacatcttccaggtattagacctctcggtatgattccgcttcggcatgctttgctcatgaaaatgatacggaatactgaaagaacactttgcaggaaaccatctgatatagatccaactggaaaagatcctgatccagctgcgacagaagcaaatgtatccaaggattctgagccgactgccgaaagccagccgactgccgaaagccagccgacgggcgcccatgcttcgggtgacaaggccaacccgagtgaccagccgccgactggaaaccggtcggcaacaactgaagcagcaacaacccaagagcccccgactggaaaccagtcggatgtaggtcctgatcaagagatccccgaagtagaagcgcagacgacgacttcgcaagggccagaggctggtaacgactcgataatcgggtctccaaataaagaacaaggatcacctcacgtccagctaggaacaccttcaggtaagtca

SEQ ID NO: 89973 - DNA, 641 bp, Oryza sativa
tctgggtctctggcaagaacaagatatggcaatccatggagcttcagttactagattaatgcaagattatcttcaggaaaaagccggtgcatgcaaacttgtcggattggaagaggagcagccacaagaatcaaattagggagaaatacaagtttttattcagaattaatggaagtgatgaatcaatcctagataataataataataaaaagataatcaaacaagctcctctgatcgtggcacaaatgggagcagcagtagcataaaccaatggaggaagaacagctcaaatccgtaacgaattcctacacgcacgcgtgccatgctcacatcacatcgaaatcctcaaatgcgtgcaccgatcaagattgatacagacggtgataggcttgccgggttcgtcgtcgacgtcgagctcacacggcggagacggcgtagacggcggcgacgacgatgccggcgaggatccccaccggcgagacacggagcggcgcgacgccggagcccacgggcgtcgccggcgtcgccttcgaccctgtccccgccggagtcgtcggcgtctgtcccgcaggagcagcagcagcgccacctgcacgcacgcggcgaaggtgttcgtcagctatctcgtgctcgtcggagac

SEQ ID NO: 89974 - DNA, 738 bp, Oryza sativa
cccctacgaccgccgctacgagctgcggaacaactacctcatgctcctcgtcgtctactccgcgtgggtgacccccttcgagttcggcttcgtcccggagcccgccggcgcgctcgccgccgccgacaacgccgtcaacgccttcttcgccgtcgacatcgtgctcaccttcttcgtcgcctacaccgaccccaagacgttcctcctccaagacgacccccgcaagatcgcgctccgctacattaccacctggttcgtcctcgacgtcgtcgccaccatccccaccgagctcgcccgccgcatcctcccaccggacctccgctcctacggcttcttcggcatcctccgcctctggcgtctccaccgcgtcggcatcctctttgctcggtaacctaccttctacgtatacggggagtttctgattctagaagaagttgcagctgttagaatcttttcaaataattcagcttttttatccatattctaataagttatagttatacaatctagatgatgaattagaggggaaactattttgatccctcgagggatgtccactcgtttgcttaaaaactatccaaatggttatgagaaattctagaaaaaattgacaacacacgtacaacatatctatacaactctacaaaattttaggtccaaactcaactcacacgttgagatataaaaatgacaaattcaatgtatgaatagtagcgcattgtttacatcagcgtcctc

SEQ ID NO: 89975 - DNA, 1761 bp, Oryza sativa
aaaaacgaaaacctaaaaaataagggtaaaatcaatattaaatattaaagtaggggcagaacaaaattgccccttaattattcagtcttcttccacggtttaagtatagattgacaaaaagaaaatttattatggaaatggattacatcttcgacttctgtcataagacacacaaccataagtttcttaaaaacattattaaataaatcaaaatgagaaacaaagtgatgggaaaaattctcaattctcctttattattagctagcgttaaaccacatagatttttagctagcaattctaatggactacgccacctagaatggaattagagacccttggctaccgattccaagagtgtagcaccattgtgcgcagtatcatgctcctcatgtggtagcatcgtagaaaaaaaaatgaagccaatagaaagacatgaagataacctgtatacagttagataattgtttagtattaaaaactttattattacaaaaacatcaaattgcctaacgtacagcactaactccaattagaataatttttttaatagacctaggtacccctctaagccaattaacaaaaatatttttcgcgttacggggtgaagggatattaaaagcaaaaaaaaccacacatctccaaataaactaagcaacatgacactcaaagaaaacatgttagattgtctcttacgcatagcagaaagaacagtgtttgccaccccccccccaaaaaaaattactatatagaacaggttgtctatattgatcatccacttccttggctttcccaaagcaaaatctcacttttatgaaagttaatttttagccctgagaattgttcgaacacacataggattaatgtatcatcgatatattgtaaaatggacaaaccatcctacactaaatgtggaatggctcctctaatttaaccatcgaatttagctcgctcaatgagaatcgctaacatatcaatcataatattgaaaagtatatgcgacatttgatctccttgttgtaagcctttgtgcgtttgaaaattattacccaagtcatcattgacttttatacggacacttccccctttaaccattttagaaatcagtgacaccacggctgagaaaaacccttcatgtataatgtttgtcggaggaattactatttaactttatcataagctttttcaaaattaattttaaaaataaccccatcatatgtttcttgtaaaactcatggtctcatgtatagtctcatgtaaaaccaccaccccttccattatatttcgacctggtaaaaaaattgtttgggttgggcgtacaggttcagaaatgaatcacaaaattcacaatctcgatgaagttaacagaaagccaacacttacctgaagtttgatttcttcggttcttcacacattgtcggcagcgggctcaggaataacctgaacctgacggtgtcgacaaaacagtgagttcatcaacctgcacacaatttcaggctcgctccaccaccagatacatcccagtataatgagcgtaatcaccataagaatcggcgcgaacacaagggcagataatcctgcagccatctgaatgaatgggatctctagcatcatgatagctagaataagggaaagtctcgctgcaactttcgccaggaaatgcagtttaggacggtctgacatggtggtggttgcaatcgagcctgctgctagaaggatcatcacgcagacagccaggggcggatccacaatgggggcggaggg

SEQ ID NO: 89976 - DNA, 1953 bp, Oryza sativa
tttgttaatgctgcatatcgaaattgcattttgatattggttctttgacaactgtggagtagaatgtcaagacaagggcagctcatctgttgaagtatcctaatgcgaagatgctatggatcggtgaccctacatagctcagcactgcgacatggcagaggtacattaatataacaaacgccagttgtgtagcttcagatcagtatatcaagaacagagctaaatttctaattgagaaaagaaattctgcattgcatggcacacaactcttatggttcaatgtaaatgattcagtcaggctttgcatcttcctatagttcatttttttaaaaaaacaatgttctttgatgggtctatttgtaaatgcacagagcagatgcgctttgttcaaataaacaagatagattaggtcattcctaattaagaagttttttgctaaaattttttgagtttagtttaaaccagatggcagtggaccggaataaaccatgtgcaaattatacataatgtgtgtggtatccatgaatcttaggaggtagagtttctcactactgtcattgggagctgaataacttattcaaaagaggaagtgacctgatgaaataattcttagtagtagcacacatggatggtaggaaccattgattttttggtcatgtcagcattagttacatagcgtactgttttatgacgtttagtttgatttcaataagcccaaaaggaaattaacataaagactttacttttcagatgacataattattgtgagaaatcattttagcatgtaagaagaataccttttagaagtgtataaatagacgaaaataatgcaaatgttgttattctggcagctatgcactttttattatcggtgcgatgttggttagagatatgcaagtagctttatgatgagcagcttttaatccatttgtcatagatgggctagcaggtagccagtctgtgcatatccacaaagtgagaacattgagattcttagctcaaatgcaaaggatctgagattgtcctcttatccacatgataaaagctagagctcaagtgtaccaattcaagtcaaaggtcacattgactgtgaagtgaaataatattcatgtttgtaactgggaaaaatagtattgactagaccaagtatagacatgaaatatttccctctgtctggaacttgtcttgctttgatccatgctctatatactttatcctgacacaccaaatataaccacgatttgtcaccttccctcctgttctcttggtcttaaaaagagcgaaagattagctttacactgcactgcagccatgtatgcatgtatgttactttagttcacagatagagtgttaccacatcaaccgaaaaagatatatttctttaactaacaacctcttataaaagaaaacactctagtatcagcaaagaacatggatcatgtgatctgatcgtctgagtaactgatacaattatcctgatgtagtatttgtcaaaaaaaaaacattaggtatgcacaatcaaaaagcataggggttgtgcatcgtctgactgttgccctccttttttaatagatttgctctttcattgtgaacgcaatggtatatcaagtcctatccttttactctctttctctcattttgttttatctgtgaacataacaatatatcaagttataactgtttactcaatttattttctaggaaaactttgtttatttactatgagcatcaagacataaagattgtgcatctacatgacgagctgtatcaggggtgctgcaaggaaatattttgaggggaatgttactacgaacgtagcatgtacactaaagtccttatcaatgcatacaattgctatattgatatgatgtgcactctattaggagtggattcattttgatcccaaaatggccaaaatggacgctaagaatgctgagatgaatccgatgaatg

SEQ ID NO: 89977 - DNA, 642 bp, Oryza sativa
aatttatacttactacacacaacacaatgataacctattgcccagtatatgtacaaggcggcctgagcctatatttgggctcagaaactttggttgaggcgttttcacccctgtattctctgaacctgaaactaaactaatctatctatttcatgcacctctttctggagttgcattaagcaaaccacttggtaaccacatctctttggttatttcagcctcaaaccagaggtgatcaagacatgtgcaggaagcaataaaatgcaacttcttgccaagcagtgctttggagctacgagaatctaatccatgtatcgtgtcttggggtgcgactagatcttacttacagtcttacacctcatctgagtaggtaccttgagcatcggcgacatccttgctcgcattggaggtcgcctttccttttagttcactgcacacaagttgtgtcaagaggagcccagcaaggagagctgctgccataagcatcgtgaacacagcgctccaactactcgacgagatgtagcctgtcagcaatggcccaatggcggcgccaacagacccggtcccgtcaatgatggctgtcacagtagccaatgcccgggaatttccattcaatgagctgtgagtgccaaggtcagctga

SEQ ID NO: 89978 - DNA, 713 bp, Oryza sativa
tatatgatggagaagtgggactgtagctgggtgaagcaggactatatgatggagaagttgggctgtatcctggccctggactgtataccggagaagatggactgtaaccaccccctgacgatggagtgtagcctggtgaaggtactggtgagaaagccattcctccaacatatggcgagaactgagcatctgtaatggggaagccctgatgtttggacttagcaggtagctcggtgacatcattccttcatgatatggtgtcccagagatgggcgagcgtgctggtgtcatgccaaagtccaggccttcaacatagcttgggagttgaagttcgatggcctgctgcagcatctgatcattgagatacaatgcacagcctcctgtaccgataggtgcaagctggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttg

SEQ ID NO: 89979 - DNA, 983 bp, Oryza sativa
gaattcctgcagcccatcaaaggggacaaatcggaagaagcccgagaagaatacgaagggaggggatagtaagaagcaagatgacagttcgaagccagatgataaactccctcccccattcaagaagcattccatattttttaagtacctcccgtactggaaagatctggaggttcggcataccatagacgtcatgcatctagagaagaatgtgtttgacaacatagttggaacattgttggacatgccgaagaagactaaagatggtctgcaatcaaggatggacctagtcgagatgggaatcaaggaagagttacaccctcaagaaggagaaaagaatggcaaagtatatcttccaccagcctgtttcacactgacagcctgtttcaattttgcaggatatgtgaatttgtcaaggattttaaataacatgttggagggtatgttaacattttttttaaaaaaagtggaggatatgtttgccttttccattttttttagtcaacatgtcgatgaaataaggaagtcaattagtgcactacttgataataacaaatcaaattttgtacaaatttgtttgtagtaattaatttagcataatagtaagtagctattagtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtggacgataacacttttttttacattagaggtttgaaacgatggccaatagtactcctaagaggatatgtgaatttgtcaaggattttaaataacatgttggagggtatgttaacatttttttttaaaaaaaagtggaggatatgtttgccttctccattttttttagtcaacatgttgatgaaataggaagtcaattagtgc

SEQ ID NO: 89980 - DNA, 1245 bp, Oryza sativa
ggttccaaatttccctatatttatacccataggtgttcccttgtccaagtagaactagggaaaccaatatggatacaatccgagtagtccttgtcgtttccatgtagaactctaatcatccttccttatgcggaactcctcctatatccgaaggttgtttcggatacaatgcacagcctcctgtaccgataggagcaagccggccaagcataatgttctcagtgacacctctcaggtagtcagattcagcatatacagcagcatcaagcaagatatccaccgtctcttcaaaggaacatctcataagaggccctgtgtcattacggttgataccatgccttgtaatagccatcagatgccctctgtatgtcattgtatcacaaagaatggccagatgtctgtaattgacataagaaccatcgaaagatatgaccacccgcagctcatccaagagagctcgacgaacagcctcgattccaagaacctcaattacttcgatcaaatggttacttgttgtcctagtagcatcaacatcttcatggcacatgacagccaagagattaacaccttctgtatcaagcatccactcattatctgctttgaagccaacattgtcctcaaatttattgaccttcccatatttgataaaaactttgttaatatctggaattccacgaagtgccatctctgtctctgtcaacatgttactttcaatcttcttgaggaagacatcatcctcagcagactcatcctgtatttctccctttggagcttcatcatttgtgatgcggacacgaaggatcagtttatccgcattatcatcattaaatatgcatgacaagtcatcatcaaattcatgattgatcttctctgcaatatcagccatgctcaacttcttatcaaccatcatctcacgattcagctcgatacgcagcagccacggtgaaattttatctgggtcaatatcctcatcaggcatttcataataggaccggacaaattcaacatcttcttcaataatggttcccagtggatcaggatcataccatatctctgtagcatgtgtcacactgcgcagagtagtgtactctaaggcacattggacattcttagccagttctttcttcttgttcacctcaggctttaggtaaactgacaatgatggagtttttatcttcttagcaacattaatgatctctctcagcctgggaactccaagagtgacattcttggcactgacaccag

SEQ ID NO: 89981 - DNA, 3369 bp, Oryza sativa
agactaattagactcaaaaattcgtcccgtggtttctaggcgagttatgaaattagtattttcattcgtgtctggaaactccttccgacctccggttaaacattcgatgacaaaaaaaattatcgtttcacgaactaaacacacccttaattgcgcgctttggctgagttacgttgccctgtgcttctgtcagcgcaggcgagcgatgcacagtaataatgcgtaaaaccgtgcagatgttccaagagtacagtatgccatgcaaacggttcatattctgaggcgcttgttgagaaaacatttcggaagcttggtttgtcacttcgtgccttgatcgtttgggccgagatttaagccgattttctttggatgggccagcttcccagaacttcggtgcgaaaaagtggcccatagataaattccgtcgcagaaatgcaatgcacggttgacgattgatagagatcgcagaaagtagcacgcacgaacagatagtggtcaggcagaggagttgcatctcaattttgaaagtagcacgaacagataggggacagacagaggaattgcatctcaattttgcatcatacgtttcaggaggaagacacatcttacaccgttccagtttaaacttaggtagatagcacaacgaccatagaagtttgccctagttatctacatcaacttaaccaccaagccacaagaagaagaagaagaagaagaagaagtgaaacaagtaaccattccaatcacaagagcaaaagacttatgtcatactaatcatcgtcaggcgtggtgttgcagctgcagcaaccgcgagtacgccccctccggcctggacacgagatcagagtggctgccgtgctcgacgatccggccatcctgcacgacggcgatgcggtccacgcctcggatcgtcgacaggcggtgcgccaccagcacggtggtccgccccttcatcagccgctccagcgcctcctgcagcacgcactccgactcggcgtccagcgcgctcgtcgcctcgtccagcagcaggatggccgggtccttgagcaccgccctggcaatggcgatccgctgcttctggccaccggacaactgcacgcctcgctcgccgaccgccgtcttgtagccgttgggtagctgactgacgaagccgtgcacatttgctgtttttgccgcctggatcacctcctcctccgttgcaccgtccttgccataggcaatgttctcaagaatgctggctgcgaaaagaacaggctcctgctgcactaggcctatcttcagccgcaaggccttcaagttcagcctcctaatgtccttgccgtcaatggtgaccttgcccccggtcggatcatagaaccgctcaatgagagcaatcacagtgctcttaccagacccactggctcccaccagagcttgactgcgcccagcttggatttttaggttgaagtccttgaagatttggatgtcagggcgagccgggtaggcgaagtcgacatgccgaagctcaatgtccccacggacattggtgacacgctctgactctggatcatcaggctcgattcttgtcgccctgttgaggatgccaaagatggagcggatggattcacctccacggacgatctctggggcaaggctgactgtctcggcaacggagttggcagtcacaacaaggacaacaaagaccttgatgaccttggagaaggtggatccatgagaccggaccagatgagaaccataccacagaatgagtgcttctgatgagtacaggcagagctgtgagaggccaaacagaaggcctgatgtctggctgcggcggaggatctgctgttcaggtatgcgcaattcataactgaacagagaaaggatcttgttctgagcattgaatgctgccactgtgcggatgttgctcactccttcaccggcaaccatgctgctcttggcatgcgcctttgctgtgtcaccagcgaagcccttcatcgaaagttgctggaagaatcataagaaacatgtcagtattaccctactgttgacgagtaataccgaattacctaaataccattaacatttacaattttccttggggatgaacatggaattataaggtaagattcagaatagatcactggaaaaggaaggccaagaaattacctgggcaaagttagcaagcacaagaagagggaaggtggccaggataagcagtgctactctccactcaataataaaaccaacgatgaacgatgtcataagggaggtcatgttctgcagaatcactgatatcctctcagctattgcagacttcacatcagctgcatcaactgctagacgagcagccacaagacttgagttgttctcttcttcatcgaaccaaccaacttcattcgtaagtattgctgcagaaagtgacggagttttacaaaaattcaagatgacacaacaaatagagcattagatttagcatagccagaaatgcataccggaaagcatcatcctcctaaccctggttgtaagattttctcccatgatgctgaagaagtaatgctgcacgagataagctacaacagcatataggccagtgccaatatagatgaacacatacaattttgttttcttttccatttcattggggtccctgtagtagaacacatcaagcatttctcccataacaatggcgaatgttggaccaatgaatccagagaggacagaaccaacagcgcccaacactgcataaggccattcaggagcattcaatttcaggagcttgaagaagtaacctcgtggtgctgggtatttacggtcattatctgcatttgaaatcatctcaatgcgaccatttgccccagtactgtactgatagctcaggttccttaaacttccagacctgaggctgagagattttgtggaaagtgaactggtcaggtgcatcgagcgtgacctgcgggtagatgcaccaccaaggtctctgttttgtgccatttcttgaaaacgaatcagggaggcatacgctccagagctcccttttgctagaagttcatcatgtgtgccagtctcaacaacttggccctgctggatgactgcgatcatgttaacatttcttatagtggagagacggtgggcaacaactaccgttgttcttccagtcatcagccggtctagagcttcttggacaatgttttctgagcctgcatctagagcacttgtagcttcatcaaggagcagtatcttagggttcttcagcatagcacgagctattgcaatacgctgtttctgaccaccagacagctgtattcctcgttcccctacctgtcaaaaatagaaataatcagtgttgagtgaattagacttgactacacatacatcccaaaaaaaggt

SEQ ID NO: 89982 - DNA, 602 bp, Oryza sativa
aggggaagatgggccgagagaaaatcggcccatcgaccccgggggaggcaaactagacttttgcggagggatttgatttggaaggatttggattcggaattgaactcgacgatagatcggggattgagatcttgagatggcacggacactaggcaacaagcaaagaaacaggtttcgcaattagggtttttaggagataattttcccgctaggcgccacgacggaacgggcgctacagaccaacccccctaacaagaatctcgacccagagattcagcacctaaaggagcagctccagaaactcggcgcggagaagatcttctcgctcccaggttgcctcatcttcagaatgattgctccattggactttgtagaacttgatggtcttccttcgagtctgacgttctgcctcttcaagaaccttgatcggtctttccttgtaggtcagattcttttccagcacgatattacccaggggaacttgctcttctggaactcgaagacatttctttaactgggatacgtgaaacacgttatgcacatctgcgagaccttcaagtaactcaagctgataagccacttcgccacgtctggcggttatg

SEQ ID NO: 89983 - DNA, 703 bp, Oryza sativa
ttataatttggaatgaattcgttatactttacttattttaagtatatgatgggttattcattggatgcttattattgtcattaattttgcagacaattgtccttccatggcagctgccattagaacagtatttcccaatacaatccatcgtgtgtgcaagtggcatgtactgaagaaagcaaaggaatttatggggaacatatactccaagcgtcatacattcaagaaagtatttcataaggttcttacgcagacactaacagaggaggagtttgttgcggcttggcacaaactgattagagattataatctggaaaaaagtgttaacttgcgtcacatatgggacataaggcgtaaatgggcatttgatatttttcccataggttctttgctgggatgactactacacagagaagtgagtctgcaaaccatgtgtttaagatgtttgtgtcaccctctagctctatgaatggctttgttaagaggtacgaccggtttttcaatgagaagctgcaaaaagaggactcggaggaattccaaaccagtaatgtaagtatccactgtgataggtttgttgacctctttttatggatatgtgtaatcaacatttggtgtcgcttggtgcaggacaaggttgaaattaaaacaaggtcaccgatagagattcacgcatcccaagtatatactagggctgttttccggg

SEQ ID NO: 89984 - DNA, 1300 bp, Oryza sativa
cttgtggagtggaattgaactggcatgtttgataggtctgtttaagtttcagcaatcaagtcaaatgtcagctactggcatttggaagagttggaaactatgctactgttcaaattcaaacagggatggtggctcgccggttcgttcaaaaaaaaattcaaacaaggcaatattcggattagcataccctgtattcaatttcctcctctgtataccaatttggtgtgtcccagaaattgtatggttcattaggctgtccccagcgagctatacaaactggctgatccacaatagtagccccctgtaatgatgcaaagtgacatcaaatgaacaatagagaaagttggtgtttgacaatgtaaaagagatatgatgacatattagtaatctaagtagttccaagagcagattagtaatctaagtagttccaagagagtatgtgggcatatggtagcttcctaagtgactgaatttggaatatatcaaattgaaagagcctctgatacctaaaatcgttttttccaactgacacctaaaatagtgaacagtggacatattatatactccctccgtcccctaatataagggattttaatattttgcttgcattgtttgaccactcttcttattcaaaaaaattgtgcaaatataaaaaacgaaaaatttgtgcttaaagtactttggataataaagtaagtcacaaaaaaaaataatttcaaatttttttgaataagacgaatgccaaacaatgcaagtaaaatgtcaaaatcccttatattaggggacggagggagtacttgatactgaaaatagaagtactgttttcactatttgtttagtggtaacagttataaatttccaggatttcaccattgtgaaaccagagttcaaccgcatagttgagagcggaatatggtagtccaggaccgtgatcagtgatcatttgtgtaaatagatttaagatggataagtgtagaactcaaaaggaagaattaaagaatttatagttaggtaggaaagaattagtgataggaatcagacacgcattgaaaaaaaaattgatccaggcatctgctttgaaagatactgctaccaaaaaaacttacactgagcaatactgcagtttccaaggaatagggttccttgaatgtcacataagcagtagaaccatattctcctgatctgttgaaaattgttaaattcgtcataaaatgataagatggatgatgagaggatccatacatccaaataagctgaattcttaaattgctaaatcaggttacagttaaagggctgcagg

SEQ ID NO: 89985 - DNA, 1326 bp, Oryza sativa
tgccatggcttccagcggtggtcggcgagcgagcaggcggcggcggcggcagaagaagaaagaaggcaagtcttatcggcaagggaaggctaagcctttcttccaggtctccctctctccatctaaatccgtttttggaggaggaggagggggctatctcgttttagctaatctgttgtgtgtgttggtgatggtttcagttcagtttcagtttcatgtttgtgatcagtgagagtgatggtgtgtcagtggtggtttagatcatgtgttaattagttctgtgggcgtgtctttgtgttggatcttggggttgggttttcagaaaatactattgctgtggtgtgtgtgtgtgtgtgagtgagtgagtgaattaatgagtctctgaaaattctggaataataagaatgtaagcagatgatgtatgtgccttggtgctacttatatatgtgctctcgttttctgatattacagatacatgagacactatatattcatgctactatttgacagattcagttgtttgaaaagggaaaaaaaaacaggctagttaaacatattcagtaagacagttatctgaatagatgagctttattgcatccacattttctgaagcaccatgtctcttcttctataaattcagttgtttgtaaagggaaaaaaacaatataaacatattcagtaagacagttaactgaatagatgagctttatttcatccgcattttctgaagaatcatgtctcttcttcttcttcttcttcttttgaaaattcagaagcaccatcccatagtcgggatttcaaatatgagggagattttggggttgtttggatcgtttgtttgatgttgtttaggattgaaccttgtttgtttgtttgtttggtctgacagaatccccgatatgaaaaacaaagttttctcaaaaagagctatcccctttcctcaaaactgatagctaattgggttccataattcttattgttttggacaagcttaactttcactaataataacctttaaagtatttagtttgaacatactacaacacaacgtatagattactctcaaaagttactttaataaacttaaatatttattacttatatatatataccgcacatcctataccgcacccaggtgcgtaataaataaaatgctccccctcacatcctacccccaccccacccacccacccactccctccccacccccacccacgcctaccgttcccagaggtactccgtattagaatgtcgttcccagaggtactccgtattaggatgcaaccaaccaaaacccaccatccgggaaactattttaacagctcg

SEQ ID NO: 89986 - DNA, 770 bp, Oryza sativa
cccccttaatcatccagaattccatatagaagagctttccgatgcatcatgcggtggcattgacatcgcaatagcaggggaagtattgcaagctactctggcttcagaattatgtgaagattgagaactgcactgcactgacgcacagccctaagtggagtattcttggtacaagtttctgagattgtactaatactaacaaatatttaaacacatcaaagcgtcagtgcaggtaccctgagacaagataatgatagttgtaacgacaatgcaggtataacaacaataaatatcacgacaacgcaattggtacaaccctcaataagcataattaacttctaacagaactatatgtaacatcaatataacaccagaacatggtagagttactgacaaaaatgttttttaccaggtacgcacaaagagtcaacatggggttcaaacccttaatttcaagacatgatcttacacgcaggtatgaagaagacgaatcccagatagaaaccgctaatctgaggaaactcagcaccataaccagaatatagaagaaaaaaaaactaccactcgcttgatttgagcagcaagttcgaaactacgaacctttgacctttacacgaatcatacacaattcaaatgtttcttcagagacaacagtttccaatctgcagtgccaagcaattcatgcctcaattcaattgccctgcaccacattgtcaacatgagtagcaacaagacaagtacggacaatgcgccactggggctgcaggaat

SEQ ID NO: 89987 - DNA, 1153 bp, Oryza sativa
caaaaagcatggtgagatacgattaatcagaaaacaaatgggaattcaacaattaatagcctgggatctaaggtaccatagaacatactagtaaagggattaaagtaacagcaaaaaataaaaggacatgcatttatagtgtgcaaaaaccatacaaaaagagaataattaccctattaggtcatgtttgccgttgctactgaagttgaagcactctatgattaaagggttctcctgcaacagaatatacctggttagtttcatacaaatcattggtcattggccaacataaatagaaaatgcaaaaggatgaagaaagttctcatgccttacttccaatctgttggagattcaagatcactggcttccacttgggattgaggtcgttcttccttacttccgtcttacaaattggaacaggcactccactctctgatattctagatattagtaaaaagggatcctgtaacaagcaaacttagaatggtaaaaacacttacaatacacagaataaacaagtcgtgtttaggtacagagaggcatggacgaactgcaggtacaacaatggtaaatacatacaaaataaaaatgaacaaggtaatagaaacataagcttacactttttgagagaaggtccttgatttcaagatctgaacagcggaataccatctccattattgcttttgaaccagcactttcttctgcctgaacatttagttcaccaaatttactaggatttggtaggttatgttcggaaacgccaagctttagagtcaacagtctgttttgtttagtgataacctgcaaaaacatcatgatcttgtaaaaaattaaaaacgccaagcatctaacataaggagtaatcttcaaacagactaataatacaggcttttgaattggcgttactcttaatctgatacaagtgtaactttgcaatcatgaaaagagatgtgctcatagtaaaactacaggaatttatgggtgttgttttgtagggcaccaaaatggcagaagctatatatacatgcatgtgacaggatgaacctggtctataacagaaacagtacagaacagttaagttttccttcacaggttaagtttccttttacctttaaattatcaaaacaactccaatagtgtataaatttcatat

SEQ ID NO: 89988 - DNA, 1257 bp, Oryza sativa
ttgtattagttgacatgactgctaagtttcgctcattattcctattactttggtgttgcctcttagggaattgctcaaggctgtatatcgggcataagctcgtttgccagcatattagctccactaatttttacccctctaacaggtatttttttcatttgtaaataaatcctagtttataacccttgtttcctttaatttactccatagcttttgctttcttgcggcagcatgggtcctttcagaaacagcgccattcaaattcaaaggtttcagtatcatgtgtgctggcttttgtacggtaagatttcaactgaatatgttcagtgcacactttttatgccatactaagaatagagtatatctactctgcagctcattgccttcattatcagcatgaggatgcgagcagggcaatctggtgcaagtgagatgttggccattgtgcagcatgagcaagcatgatgagtatgctagtagattgtaaatttggccaacctgaaaccattgtaaatttacatactgtacattgtaaatttggccaacgtgaaaccatcccattgtctactatcctgatgggcgaatgactattcccctattcctctgcaaatctccatcagggaagggaaggattcttcttcagatagtaaattgacaactgctatgtcatagaagccagcccagcttgttgtaatatcacctagtagtgtatattgctggaatgatggcctacatatttcggccggagcttcagacatgagttaatgccaatggtagtacagatttcaacagcaagtaaaattttctagaattagcaggattactgttagcatcaacacttgttccattacaacggattggattttacctcgtgttaccaatactactaccacccccagaagtctagtttcagagcttccaattaacaatccacgcccacggtatcgacgcagcgtctgaatgcaagggcccgtggtcacctcccgtcgtggtactcgcagtcggcggcgacgccgtggacgggcttgccgaggcttgcctcgcggacgtcgaggcggcagaggacgcggcggtagaacttggagcggacgaggaggccgaggatgtgggcgcgcgcccgcagcacgaaggccatcctgacgggcaccaccgcggggccgaggcggccgttgttgggcttgctgtgcagctccgcgccggcgccgtagagcggcacctgcttccccaccacggacaccgtcaccacgcgcccgctcc

SEQ ID NO: 89989 - DNA, 564 bp, Oryza sativa
gactgctggcatcacggtcggaatggcataggagattagtactccactatagtcgtgatagaactcatgttagtaatgaagagcacagtacgaataatcgggacaaccctactgatccattgtacagagcccagatccaactcttgattcacccgtttgtttgtgagttgttacgcagtaactagcaataactaccatcgatttacgccagcctaatcaggcacggaaacgtccgcatcacctacccaatccattcagattcaccaaacgtaacgaggatggcataggcaaattcaggtagaagtacgagcagaaaggcgagggttggggtggtggaaagggcacgtacgtggccggtggcgacggtgaggtcgtcgtagaagaggtggaacggcgtggaggtgacgtgcaggctgaagaaggtgccccggttgcggaagcgcagcctgaccgtcgcgttgacggacatcatcttggtcgggacgcccgtccggtccgtgccgccctggatgtggtacgtctcgaacaccacactctacacacacatggagaggaacagcaaat

SEQ ID NO: 89990 - DNA, 729 bp, Oryza sativa
aagccagtctccaaagaactccagggttaagcatgcttggcttggagcaatttgggatgggtgaccgaccgggaaattcttcccgggtgcacacgagtgaggacaaagtatgcagaaaagatatgtgttggtctgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggagagggagagaggacgttcctggcttggggttgatcgacgggggcgtcgatctctcttaagggggtgagggtgtaacatcccggcctagggcttaataggattaataaaatactcatatcaacaagttacaacctatgaaagctatcagatgtaagcgggcccggcctgggagagggagagaggacgttcctggcttggggttgatcgacgggggcgtcgatctctcttaagggggtgagggtgtaacatcccggcctagggcttaataggattaataaaatactcatatcaacaagttacaacttcttttccggaagccaatctccaaagaactccagggttaagcatgcttggcttggagcaatttgggatgggtgaccgaccgggaaattcttcccgggtgcacacgagtgaggacaaagtatgcagaaaagatat

SEQ ID NO: 89991 - DNA, 2074 bp, Oryza sativa
atccatgtatgagttctataacgatgttgtcacacttgacacatcgtatgtggtcggtaaatatgatatgcctcttgcaacttttattggggtgaatcatcatggccaatctgttttattgggttgtggcctgctttcagatgaaacagcagaaacctattcatggctatttaaggcttggatagcatgcatgtctggtaatcttccaaaggctatcatcactggccactgcaggggcatccagagtgcggttgctgaggttattcctggagtccatcatagaatatgcctatttcatataatgaggaaggcgacagagcgattaggtggtctgtcggagtacgcagctatcagcaaggctttccaaaaagctgtatatgattctttaaccatagatgagtttgaaggaaattggaatgctctgattacatacaatgggcttcagggtaatgactggctaagatcaatttatgagtgccgatactcatgggttcctgtttttcttaaagatacattttgggcaggaatgtctgctacacaaagaaatgaaaatatcattcctttctttgatggatatgtagatttgaaaaccacattgaagcactttcttgggaagtatgagatggccttgcaaagcaaatatgaaaaggaggcccaagcagattttgagacattccataagcagtgcccacctgtgtcaaaattctatatggaagagcaactgtccaaggtatacacccataacatcttcaagaaattccaagatgaaattgaagcaataatgtactgccatgtatcttcattaatgttgatggcctcatatccacattcgatgtcaaggaatggattttccttgaagatggtaaaaggactatgagcaagatctttacagtgacaaataacacagataaaaatgatttaacttgtatctgtggaggtttccagtttaatggaatattgtgtaggcatagtctctcagtcctcaagtttcaacaggttcgtgaaattcctccacactatgttcttgataggtggaaaaaggatttcagacagttgcatgtgatggggcgtccttcaagtgatgttgttccaaacaatcgtgtggatcgatatgattatttgtcaatgagatgtctgcagctagttgattcagcagtcctatcagataaatatcgtcttgctttgagattggtgagggagatggagaagtttatgttaaacagcaacacgcatgatgatacacaaccaaggatcaagtctcgcattcctaaagcaaataaaccaaatacagtggttggtcaaaatctggtaaacgttggcacttacaatggaaatgataggcccaaagcaacaacagaggtatctgttcaacctgtagttaacattgtaaagatgcctattatgttggaagcattatggtaaataactatgagaataatcatcttaacccactgcctatctgattgatcttattttgcaagatgcaggcttcttcattaacacagggattggatgtccagaaggtactacatttagctatggcatgagtaaattttggtgcattatcctcttataggtgacatttgttaataaggatattgatttctattttttttttaactatagggaggagcagaaaagggcatagttcctgctggttacattggactgccagctaatgttcagcaattcgtaggcagtcaaacagcgattcgcccaagcattgtgtatatggttccggtatgtcaaagttacaaataactatatctgctcaactgtgccttgatagtatctacagcaccagaggaccaaattctaggatatttggttgcttttcttgcacaaacatatgtggattcatacaactcatctttatttgttaatgcataagccccaagtactcatcatttttcaggatatgtgctgtgaaattgattctttcttatttaatttttcagagtggtgttgacccacaggcatttggaaatggtgttctgatgcctgttgtgtaccagcagatgttccaggtttgtatatttttgtgttaggacttgagaagttaatccgttcgtct

SEQ ID NO: 89992 - DNA, 779 bp, Oryza sativa
tcctgacaccatcatctttttcgccactttttggctgatgtactttagatgtccaatttttttctcctctgttggttcattaggtgagcaaggctgcaggggagaagtggcgagctatgtctgagcaagtgagtttttctctgcagtgttcaaaaattagtacatgttcctattaagtgtgtgcatctgttatttagcatacatcatccatgagtatcactagaggactgtttaataattgttctggcctgtttgttaggaaaaagattgaattgctcctaaagtactagttgaatgaaaattgcaatttgtttttgaattctactcagtgaagcgcttaagtacacataagtaccatgggtggctattgatgtgacaatgtgccatatgtttttggcccttcgtgttaaattttattaggagaaggcaccttatgtggacaaggctggccaaaagaagcaggactacgagaagaccaaggccaacttcgataagaaggtgatgatagaataattgtgcatcctaattatagagcccttcaagcgttaggcactaattggacttcttgaattacttcttcaggagagcacaagctcaaagaaagctaagacccatgatgatggagaaggctctgacaagtccaagtctgaggtcgacgatgaccaggatggtggtagcgatgaggtaatcattaaaggaacacccggtgccctattttagcttgaatgcccaatgaatttttactactgctagttgtgttgctaatgaacatttttaat

SEQ ID NO: 89993 - DNA, 710 bp, Oryza sativa
ttcctgcagcccctgaaaaagggatcatacaccatcacttccctgtgaattacatattgaaaccatggagaatgggtgtgaggttttaccagattatcaaatttggtatatttcaatatgtatgaccacttgtccagctagttgaaatggaatttatgattttgagagcatattggttaagtactttgtacctgtgcaggtgattataaagaccctcacagctagcctatccctgattcttcaaccttttggtgcatattgtgatggagaattcaatttgagatgcgggtaagacaattttccattttcacctcttgtgtcttgagttcagcaaagcaaaaggcattcacctttataatttgaatttcataatgcttggaaaaattttataataggaataatgcagagacagataactgcatagaagagtaatgcaatcttcttgatgactctacctgtgtcactgcataagctgttatcaccttgtctttatccccagaatatatgtgaacatctagcagtccacttcaatgaattattttatgcatgcttatccattttttcaacttcattgcttttgttcaaactgcagatacccatactttgccgctgtccttaacttcagtcaatattgggccctatactgtttggtggagtggtacacggctactaaggacgaattggcacatataaagccattggcaaaattt

SEQ ID NO: 89994 - DNA, 1291 bp, Oryza sativa
aaggcaagccggtcggtgaagacgtagacgcccaacaacggcggcataaaggccagccgtgcaagcggaaacaccagtcggcggcggcgaaggcaagccggtcggtgaagacgtggacgcccaacaacagcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgttaattttgatttctccgagcagatgactctgtacgtttaaacactctgtccgactagtcataaccatcaagcaccgggagtcggcctaggcacttcccaaacatgcatatgagtgacatgagttcgtcattaatggaacaaagtttcacgtatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaattgtcacgtcctgataaattcatcccgaaataaaaatcatcttctaaaaggaataatagaattaattaaaattcgaaaagaaattggcaaacgctaaaaatacgtacaagaaaaattcaaatgtggcccggagaatttttgttaaattctccttggtctaaaaggagccctcaaattttacttgaattttcagagcaccggaaataattattaagcaacaacaacaattaacaaagtttattaaaaagaaaaaaaacctaaaaataatctctcttcctcctttgggccaagcccagcccgaagtctccctttcctccctctctttctctccctctccttctctccctccttctcttgggcccctcttcccctcccggcccactgcctccccctcctctctctcccgggccgtttcctccc

SEQ ID NO: 89995 - DNA, 1266 bp, Oryza sativa
aacctatgggtcactgaaagcctcagagtttgaagctgattggaagaagattattctggagcatggacttggagaaaatgaatgccttagttccctatatgagcatcggcagctatgggcacccgcctatctcaaaggccaattctgggcagggatgtcagtttcacagcgtggagagtctattgtttcatactatgatgggtttgtgtaccccaaaacttccctgaagcaatttttcagtaaatatgagatcatattggagaacaaatacaagaaagagttgcaagctgatgaagaatcctcccataggactcctttgactgtaacaaagttttacatggaagagcagctggccaaagaatacacaatcaacatgttcaagaaatttcaggacgagttgaaagcaacgatgtattgtgatggtatgccaactaaagttgatggacaatttgtcacctttgtggtgaaagaatgctcatacatggaagatggaaaggagaaggagggaaggaattatgaggtttacttttgcaagcaagagcttgttaattgtgaatgtgaatgtggtttctttcaattcactggaatcctatgtagacatatattatctgtgtttaagttgcaggagatgtttgagattccaataaggtttgttcttgatcgctggaaaagagactataagaaattgcatgctgatgcgctttgcaaaaatgatgaaatgctacctgatgtgctacctgatggcataatcgagcgtcatgatatcttgtttacacagtttcgtcaggtgcttaatctagggttcatatccgagggtaggtaccttgtagctctgaagttactgagacaagcagaaaagactcttctggatgatggagatagaggcaggcaggcagggcttctctcgtttgaggctgaagcacctgaaaatgatgaagggatttttagtcctgagttttcagagggtgtaaagaattctcagtcaacaaatgcaaagcgtcgaggtcgtccaacaaagaaactaattgaatctgattctgataccgtattacggccaaataaagagcaggtctatattcattcttggggcctaaagagcctaagatccatatttcactttctgttatatgaatatgccttcattgattttttttttttatttctgctgagcaggattttctacggtcatcttttgtcactgatgagtctaatatgattcaaggggcaccctcagcctcacaccttgaaagtcctcacttgggagtt

SEQ ID NO: 89996 - DNA, 711 bp, Oryza sativa
  unsure (1)..(711): unsure at all n locations
gtttcttgacacccactaccctgataagcccgagccgcctttcccgccacactgtataattggttctggcgaggaaaattttgtcncaggttgttcacgcttcaatttgttgcctcaacttaaagctcctaaccggatatgtttagcttctttcgttatgggctgaagtgatcaattgatggttttgccaacgctgacatgagaatggcaacacgttatggtcctcttttggtgcctgacaaaatttaatctctaccatttgcagctctggagtggctggaaaaggatccaaatgtaacgatcaggaggaaggattgtattgatggttatcttggtgcatttgagaaagatggctcaaatgttttttcagattgggttgcgaagtttcagatcaaaaccgtgagtgatttggttctgctactcttcgagtacttcagaagaaaaatagtgtggttgatatgaaccgtgatttggcttgatgcaggtattggttttaggaatatgcacagacttttgtgttttggattttgcaagttcagctttggctgccaggaacattggccgagtgcctccgctggaagatgttgtcatttattcagagggttgtgctacgtataacctcccagttgaagtagccaggagtatgcaaggaaccttggctcatcctcaggtattggatcactgaaaaccaattaacgaggggctgcagga

SEQ ID NO: 89997 - DNA, 8399 bp, Oryza sativa
acgagttcagccggttccacgagctcgccgacggcacgctccagcgcgccgcctacttcctggaccgctacctgtcggtgacgcccgagtcggacgacgcgctgcagctccgcctcgtcggggccacggccgtgttcctcgccgccaagtacgaggaccagtacaccctgaggaagatcgacgccagcatggtcgccgcccggtgcggctacactagcgagaccaggcacaagatggtgtcgtgcatggagaccgagatcctcaacgcgctcgactacaacctaagcggcccgacggcgtacacgttcgtggagcacttcaccaggtactacggcgacggaaaaaaagagaagctgttgaaggaggctgcgcatcggttcgccgacgggtcgctgctgacgtatggattccactgctacctgccgtccgtggtggcggcgtcggcgatcttcctggcgaggctggacgtgctggggcatgagccatggagccaggatctcgcggagctgacagggtacaaggccatcgacttgatgggctgcgtgtgcgacatgtacagtcaaatcgcatgtcctcgctttgctctcttccaagagtacttcttcgagaatccatagccaatgtatccataggaagaactgttaggaaacgataggcgaacaaacgataaaaaacaatagatcaatcacaaaagacacgagatttaacgtagaaaatcctcccaaaacaggagagaaaaaaccacgggcgccagccagcaaaatatcttcactatatctgaggtgaggttatatcgccgcacggcggcttacaagagatatatatatagtggaaccctaaaagggatgatgatccgtacggcagaagctggcctttattaaatgtaaataaatttggatcacaactcaacgagaacaagagtctgtaaaagcacatgcatgcaaagcatgatggcttcaattttgcactgttgtctgtacatcgatctgtaaaaccaaatttgtgaatttttggttgaaatacatatgattcatctcaattcaaaatttattactattttttggtactctgttctagtgttctgtgatctctgtacaacataatctatctctgtcgttccgttttttttttactgggtttgcattcgcgaactagcgatgtcccgatgtctagctagtatctgttgcgttaggatgcacgtacagaacggcaaataaccgcttagatcaaattgctcggattagtgctttcctagtgaaggaaaatattgacttactagagtcctcgcgccgggactaatgtctttggtctctccggttgttttcccttttattctgtagtactccgttgagtttctctagtctcactcagttgtcaccctgatcccccaactgtaatcttcggtactgcttttctctctctaatatattcggcagaactcctgctgccattcgtcttaaaaatattgctcggattagtatttcttccatttaaaatataagatgttgttaacttttagatataaagtttgatcatttggctcaataaagaatatataaatattatttatttgagtcccgctccggtgctttctacctggagtagaaagcaatctgagccgttgatcatatttagttggagggttgagatttagttctactcccaccagagttagtagtagtagaaatttggaagagtatattcgtccaggataataattcacgtaggggtattatcgtagtttatcagtatctaactcaccctttccctgcgccaacccgggccactacatcgcgctcgtcaccctccgcgtcgccgaggagatgcggccgccgccgccaccgccggcgcgggccgagcggcacggcacgggcacggtgcaggtgacgcgggtgaagctgctcaagccacgggacacgctgcttcttggccaggcgtaccgcctcatcaccgtcgacgaggtcaccagggtgctgcaggcgaagaaggaggagaagtcgaggagggcggcggcgcagcatcacctggaatccaagcccgccggcgccgttggagttgggatcaattccagcggcgacgaccacacgaggcctattaggcctgcacatttgtatattgtttcctgtagatgcagttggtagtaagacaagtgctagagatttgccaagttaggtgccaacacctgaactcgagttcccctgcaatgaacaaggtttggtcgttgaagaactgaaatgattgacagaacagatcatcaaagggaaactggagcatcatgccatgtttgtacatggctgcaaatatgttctgttggggataactaccctaacctgaatttattttcctttcttgatgaatcctactctctcatgtcctaaacacaactttggtgtcctaaattataatgctatcaggaaagcaagtgcttttcgagccaaacctactcatacaatttccatgtatcacccatttacaaataccaatcataaaaagtttcagaagcttggctagcacatctgtccaaaacaacatgggtttgtggctgtacaacaaagcaccagaaaaaaaaatcaaccattactggttggttgcccggtacagatttcagtagacagaatgtgtaacatcccggcctagggcttaataggattaataaaatactcatatcaacaagttacaacttcttttccggaagccagtctccaaagaactccagggttaagcatgcttggcttggagcaatttgggatgggtgaccgaccgggaaattcttcccgggtgcacacgagtgaggacaaagtatgcagaaaagatatgtgttggtctgcttggcctggagcaatttgggatgggtgaccgaccgggaaattcttcccgggtgcacacgagtgaggacaaagtgtgcagaaaagacatgtgttggtctgtgagggcagtctatgacctatgaaagctatcagatgtaagcgggcccggcctgggagagggagagaggacgttcctggcctggggttgatcgacgggggcgtcgatctctcttaagggggtgagggtgtaacatcccggcctagggcttaatagtattaatagaatactcatatcaacaagttgcaacttcttttccggaagccaatctccaaagaactccagggttaagttctcgggtgcacacgagtgaggacaaagtgtgcagaaaagacatgtgttggtctgtgatgtgaaagaaaaaggcccaaattccatggcagagagccacacaaatcaacgctgtgtggtccttctcctggagcttggagatgacggacatgtacaggtcgcgcacgcagcgaggcgctggtagggcacgccggccgcggtcaccgcgtccgcttccttcacgtcgagggacatccgatgtgtgcaaacagagcgaaacgattttccccttcaatcaacgctggcagcgccgccactgatgggagtagcgataaccctttttttaggagtagcaattgtacttgatgcgagcgatgagacagagaaatatcccatgccaaaattacccctaatctgtattaaaagattactaatataccctttaaaataaagggtcgagattaattctacttgtagtaaaatactttaagtagagagcaccggagcgtcactctatttattttattttgttgtgacttattttattattaatggtaattgtagtttagcatatttacactatttttttaataaaatgaatgatgaaatgttatgttcaaaagtacacaattatagcgaaagggcctgtagcctaatggttacaagagcctcagtagtacctgaggtcctgggttcgactccctatgggagcgaattttctagaatttaacggcgttgtgttttcagtgataggcaacgtactcatcgacaacgatgctcctgttgtgacttcgtcaatctcaaggatttgacggcccaataggggcaaggtttgcgtgcatgtgttcatagggggtgattgcgcgtgcgctgtgaatgtcttcaaggatttgccaagttacacaaaacgacaagtagccaggttacacaaaacgacaagtaataaacagatccaaacgtaaataaaacgtaaaatacttacagaagaggcacttagtcctcacaccgaaagagaacgatagcagcggaaaaaggcgatcctagcggggcttcagctccactccacaggcaaaactcaactgtggtatgagccttggtcctctaactttgagccgcggaaaaaggcgatcctagcggggcttcagctccactccacaggcaaaactcaactggggtatgagccttggtcctctaactttaagccttggtcctctaacttcatcttcagccttggtcctctaactttaagccttggtcctctaacttcatcttcagctcagaagcactacacttctgaaaagggggaaataatagcaaggctgagtacaaccaccgtactcagcaagccacaccaacgatgcattcgtgcaaggggagacaaagaggggttttgggggctatttgcgtaaaggcggttgtaaaacattttattgagcaaacagtaaacagttgagtaattaagataatattaaatctccacttatcaacgctacaccacgttgaacaggcccaaccaacccacctgaactacagtgcattgggtcgatttattaagtgtgagactaatcacggtgaatctggtcgatcgcccataaccgtgggcacggctattcgaatagttttactctggccagaggtgcacaactgtacccacaagacacaatccaccggcatgtcaccgtgtcatcatgtgcccatgatgaacacgtcaccacgtcgagtgattgtgacaagacccttcatataactctcccctaaccatccacaccacgctaaggtttcacccccactcctcgcaaggcagcgggcagtcccctcgtgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcactgtaagtcttccagggtttcccgtgaaccggtccttaattgccatggtgcgactagtaaaaccatgcacccacagcccaccattcagtcgcattttagttggataattacgaccaatgcaacatggtcgggtgtctcgagtacgcagctcgttctgatactaacaaggtctaatactgcaattatcccatcaactgagctagtggcaattaagtatggctaagcatatagttctaactaggtcacataagtaacatgagctagtcgatttattacccaatgttgacaaatgacagatatcaagtaaacatggcacaagcgagccgataggtaaaccctgatcccatgtaattagcaaaacatgcatatttatttgcaaacagtaaaacattaataaattgggatcaacatgctcaaggggaatgtgtgacttgccttgcttcttcacttggatcttctgaactcttatccttgcgaccgcggactttcgaaacaacggaatctacgcgctgtcactcaaaacgaagaaaaactctaataaacaccaaggaaacaatacataaaaagtaaacaaacatatagatctcaattttagatgaattttgcagtttgaatggctcaatttggagtttgtatgaattagatatgaattttagaagtttttgagccattaaatgaatttctataattattaccgatttattgcgcaattattaaatatatttttccaaaggaaatggttgttgctgacgtcaacaaaaaggaggggcgcggaccacgtccacaaagcacgaggcccactcgtcagcgggtcaaatgagttactccaccatggaccgagtccacggtggcggtgcacggccaaaagggcggcggcggctcacagccggatagctgagaggcggtggcgcacggccaccggccatcgacagcgagcggcggcgcgggaaacggtggaagggagaggggtgctcaccgaggacgcggcgatgagatgcggcggaaggcggggagagatggtgaatgtggcggcggcgtttcggcaatggattggggaaggggagcggtggacggggtgcggcacgacgcagcgaagctattggtggcggcggcgcagcgcgaggtggaccggagaggcggcgcggcgtggctggaggtggcgatggcaaaggtggctcgggttggcggtggaatgggagtttcggtgaggaattggggaaacgaggtggaggccggtgtgcggctgggagctgcgtagctgatggtggtggcggctcggtgcagcgactggtagggcagcggtggtggctggctggagagcgctggcgtgcggcggcaatggggaacggcatggggagagcgagggagtgcgcggcaagcacggggaaaatggggaaaaggacgagggaggtgcgggatgcatttttatagcgcggggaggcgatgaggaggccggggagtggcggatttggggtggcaatggccagcgacgtgggcgacatcgtgggcgaagtgggggctcgatttggcgccaaaaattgaggaaaagtgggggatttggtggaggaggtggaggggaaccgattttatgcggtttgggcacgagggcgtgagcgggaggacccggaattggtggcgacgtgggcggcaacggccgtccatggcggcttttgctccggggaccgaaggtagaggaagggcctgacatgtggggtcgtcgggcccacctgtcggggagggagagagggaggagaacccaggggaggggttaagcagacttaggggtagaggggagccgagctgggccggcccaagagaaagaagggggcgcgcaggccgcgggagagaaggaaggcttgggccgaaaatggcccaaagagaggaaggaggattttatttgttttctatttaatttaattggttaaataaactttgtattattataattacttcttgagctccgaaaattcgcaggaaatttcaaagggttcattagggcacagaatattacaaaatattctcggccaatgatttttaaagaaaattttcaatttccccaataattaacttgattaaattgctttaacttttattaaatttctagaaaatggattattaaatgatttttaatcccgaacgaaaatcgggccgttacattgcgcgtgcgttgtgaatgtctatgttgtactgtgtaattctaataaaaaagggccggcccagtcttcgaagatgctcatagaggtagggtttgcgtgcgtgtattcataggggtgagtatgtgtgcattgtgaatgtcagcgttgtactgtgtaagtctaaaagaaaaggtacacagttatatttagaaaacagcatgtatttaaaaacaaagggagtacttaatcaagttggcactattcatggctgatcattaatcaatagcaaatttttttattggacattatagatttatcgcagaacactctaaaaagaaggctttgttgtaggacactttggttttctggtaattagctaaaatactatgtgacaattttttaaccattttttgttcaattggagaaagacaattttggaaatgacgtttttacccatgacaaattgcacactcaaccttgttatattttcgtcccaggcaatgttttttttaaaacaaaacattttggagacaatcaacagaatggaaatttacaaaaattcaaaaaaaaatattcgaacaaaaagtttgtagtttgaaaaaaaaagggtagtgacacctctatcctcgccaacttggacaatcaggccgacttagactgggaggctaccatgcatctatgatagtagtaccagtccgagtatacataagtttgtacacacataacaacagttgatcagagtagataacttcattacattactatgatagttcttaagaaggttgccatcatggctagaccctacatgtacaaaacttcagtataaaatatggaggcgaaaagaaacaacgtcagtgcaaaagctaacggcggaaagcgtctaagcatctaagcactctaagcatccaagcaactaactttttccataggcatggtttgggaatttagcacaaaagacttcatgtttcgttggtgaactcctcgacgattgggtcaacatcttctccttcttcaaaacctaatatgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgg

SEQ ID NO: 89998 - DNA, 1581 bp, Oryza sativa
ttccgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcacgcaggatcaagaaccttatggatgaagctgaagtgaaagatcgttctcgtcgtaagaaagcttgcattctttgcggggagaaccattcccgtaaagattgcagcatgtacaatgtagggcatgatgccacaggcgctgatgttcgtcgcgttccaaaggggaagtcgaaaaagaaaaataatccttagttcgctattatcctcgtggtggactccctactttgaagatcgttatcgttcaatttatgtttagtgcgtctgtaattttaatttgaactttcttgcacttttattacccgaatctatttgtaatggccttgtaattttcattttgaactgcactgcactattaatatcgtcatgtatttgtattgcaattgtaatttaaatttcgaactgcactgcacttgtaatatcgtaatatatgtgtcgtgggcttgtaattttaaattgaaatggcatgcaaatttgttaattgcattatgttgcatacatttattgtactgttaccatacgtgcattgtactaatgttgttttcgatctgcaggtatggctgatcaaaatgatgggcagctgatagacaaggagatcgataggaaccatcgatcgcgacgtcttactacaggaactttctgcaatgtgctaaagatgcgaggaccggatcaatattggcgtattgatcctcgttgggttccaaggtgtgtgaaaatatattgtttttactaatacaaggtgtttatattttcatgtattaataacttgtgctctgtcatgttgtaggctgagagcagctgggttgttgacgtttgcacggttggtcgagccttcacgtgcaaggtccgaacgaatccacattgacgcggcgcttctgagtgctcttgtcgatagatggaggcctgagacgcacactttccacctaacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctatcgcggagattccacagtacagttgggggtcggcggtacttgcggcgacatatgccggactgtgtgatgcttgcgtgaggaacagcaagcaaagttcactccct

SEQ ID NO: 89999 - DNA, 2079 bp, Oryza sativa
tgttcggtggactccctacactcagcacgatgtcaatgatcgtgcaccgcacggtctcgcggatctttgcacgcgagatatgcaactctggaggacgacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttctggaatttgagcaactagttcaatatttttaaaaagttagcaagtagttcagtatgtctaataaatgtgcaattggttcacctagttccttttcttacataaatgtggaactagttcagtatttataaatgatgtgcaactagttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggtctgacgacgtggcgagtgtccttcgcaacttccgttcacgtgctgccgcactactacgtcgtgtctcctgtcggagcgcggcagatgtggtgcagacgtcgggccgacggccatcaccaccactacaccgacgttccagcgtggatcggagtggtccatcctcttcacgtcgcgggtacgaagcggcccacacatctcacggtcgtccttcctttcagcacaccccagcaccggagtacaccagggggtcaaccggatcaggggtacccacgtcgagcacggcaccaccacgtccgcaggtattccaaactccgccttatgttcacccctcgcagggagcatctgggtcgacacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggatacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaata

SEQ ID NO: 90000 - DNA, 1265 bp, Oryza sativa
ctattaaagattttaggaccacaggattttattttatttatgcttcactctctatcttataagatgaccaaactgagtttttttttaccttttctattcaggagctgaagtagcaatgtactgtgcaaaacgatttcatgttatgcttcgcgaggaagaaagctttctcaacaatctgccctatgcaattacatctgtgtgctccaggttttttttatagatatttgttccatgtactctgcatattgcgctacataagttcactcccttttcctttgtggaaaaaagagtgggacatcgttgtacccattgtcttcatagttgcaatgtcttgaaaaatctagtttcgtttgttggacaagcaaacaatgaattatgtaatcagtgttccttcttaactgcagacttgatgatgaattggaagcaccaaatgtatggagggcgtcactttatccccatcgtagtagtgagtcgagaagcgagtctagtgactgtttccagttcctcagtactggcagttgtgctaacgtgtggcgttcctcagaggtgatatatcaacttatgattgttctttacacatcctactgcacagaagttaatcaaagatttatttctagtcatatagtgtgcgtatgaagtctgtatttatctgtttcaatatacccagtcattatgtcaagtgcctgttttacacagtcagaatccaaaagcttgttaagttattgctgcactgtggttgttatctacttatactactacccgaattatgttttttttttatatgtcactatactgggctcatcatgtcttttgtacattccttcttttatgaatgccatttttttcgctagagtcatttcacactttttatagtctttttatttcaaggatctgttgaattctttgtattacacttcagttggtatttttgtccccccaggcagtttcttacaagctgccgtcatatgaaggaagcacagcatgtgtggtaatcattagaggaaatcagatcactgttggaaatgttggcgattcccgttgcgtgctttcaaagaatggtcaggtgtagtaactttttccttgtcaaatgcctcattgcttcattctgtcatacctaatggctaatgcattaaatctgtgcctaattattctgttttctgtatttttcattgcattaaaagacaattgatttatccactgatcacaaaccaaacgttccacttgaacgtcagagaattctaagagtaggaggacaagtatggagg

SEQ ID NO: 90001 - DNA, 2630 bp, Oryza sativa
cctgcagcccctgccaaaatttgataaatcagggaaagaaaagagaatgctttacagaggatagccaattagccacaaacaagaacatagctccaaatacaacaacactggtaagaaacagtgctatgcatgtttggttttaagtcttccggcgaaaaagtttggcttaagtcttggacgactaaagtagctatgttcgcccgcatttttgctttctccttggaaaattcttttattgatcctttcattccatatcgtctatgaggtttgggttaaagctgcaattattttactttcctttctccttttgatttgatggagctgaaggcaatctaacattcaattaccaattaccgagctatatatgatcaacagctacaggagtaacgaagttcattcatttgttggtagaactgttattcccgttgcatctgacatatttttgtaaattgtaatcacacagggggaggaaactctacgcaccacttgcgagaagctcgtcgagaattgcctggaatcgaggaacaatgcgacggccatactggtccagttcaagccaggcgccgaccagccgatccctgccttgcccaacatccaggagggctccgacgaagtcgccggcggcgccgaccagccgatccctgtcctgcccaacatccaggagggctccgacgaagtcgccggcggcaccgaccagccgatccctgttctgcccgacatccaggagggctccgacgaagtcgccggcgtcgccgccgaccagccgatcgctgctctgcccaacatccaggagggctccgacgaagtcgccggcggcgccgccgtggctgagcagcatcaggacaacccagagggcggtggcgagcagcaactcgacctcgatgacgcgcttgacggagaagcactggcgttgctgtttggccagccttagctagttcgtgcaaagaatctttagctagttgcacagagttttgatcgagaatagaacaggattagttcttagttagtcctcgtgttgcctctcgagtcttgaccacgttacattttttttgcctgaagattttgcttttcacgcacgtctgttattgttctgctctgtattcattcctgaagattttgatcgaattaacgatacctaattcgtaaatgatcactgcctttcatgacttctctagccatctgcatgcatgtcttgaagattagctgtgatgactgtaatttttttcaggttctctgtctaagtgtttctggaagtgttttgatgctgtgtcctgtgtgcctaggagctgaaagtggaatgtcctaggggcctgatgtttattcagatattggaaaccagagtagttttagtgtatagtgcgtcctggcagaatctgtttcttttgtttttcgttgtttgattttgaactgctgtagatgtctttggctttccagtaaaagccggatcaatatgatcaatctttttttttttgaaaaaaagctagctagctagctctagctacgtgatatatgtgctgttagtggtaacttcttcctaagctattgccatcaagataatgcataaacagtttgtcattgaaccaacttcccaacagtatttgcatacttaaacatcaatactgtgcttttgcattttttttcttgagtacatgactatttcatttcattaaactggtaaagacatatgctttacccctttttatttcattaaactctataataaaagcttgcttttatgggccggaaaactctggcccattcatatgggtaagtttttacagcccacgtgagggccattccaaccgccgccgctccacttcccaatctcccgtagcgagtgtgccgccgccgccgccatggccgcggttcggcttccttctcctgcgccggtggctcatcctcctgctctccgcgcgcgctccctatccggcatggaagtgctcgggcggcaagccccagcgaggagggaggctgtggtcgggcggcagccgtagcagaggacgaaggactggagctagccgacgacgacggcgagctcggggtgggggtggggggcggcggcggcggcgcgccgtggacctcagcgtagcgcctcgtagctcctccgaccggggaggagcagcatcagcggaagtccatggggtcctctcgagcgggacggcggcgcgaggaccaatgcggcggctacggcgaatagaaaccgctcgggagcggcggcggcggcggcggcggagcggaggaatccctcaccggcctacgcccgcgtgtgctccgcatccgaccgcacacgtggacaccatcggacggccaaggcgtcgcgaaaggggcccagggagcacgagcagcacggacgggtgcccctggaccgtcggatcaggcgctgcagccacgtagatccgatccaacggaggtgatgcgtccacgcagccttcctgtgcgaagttggtgctgcctttgcatttgcgcttttgcttcgcgaatcgcaacaactcgttgcaagagcagcggaattgcggagaggtgaggacttgatctctctcacattctctcctcgtcgtcgtcgtcgtcctcctcctctgctttcctctgctccaagacaacgcgtaagattcctccaccttctcccatgg

SEQ ID NO: 90002 - DNA, 775 bp, Oryza sativa
catggtggtgttgttccggatcatgttgcatttgtaggtgttcttactgcttgcagccatgctgggatggtagacgaagcaagaaaatactttgactccatgtggaatcattatggcatcaggccaacaatcaaacattatggttgtatgattgatctcttcagtcgtgctggtcgattggcagaggctgagggaatgatgcaaatgatgcctattcaacccagtgtcaccatgtggggaagcatgatgaatggttgcaaggtacatggcagggctgatattgctgagagggtaggaaggcaggttgctgagcttaatcctcagtttggcgcaatatatgtgataatgtccaatatatatgcggagattggtaggtggcatgcagtggagcacaccaggagattgatgtggcagactggattgaagaaaattgtaggctcaagtggcactgaagtgcaaatgttgtgctcctgaatatagtttcctctagcatctgtctatggaactttttgaagtgaaaggaggagaatttgttagacgaatgttgtagaaatttgacaaccatgaatgacttaaacacagttctaccaagtgttcaattgttaactctgtatgttgcgtggaaagaaagaggtaaatataccaactgacataattcaattttgggcttatccatttcctgaatctaggcactatataattatttggtgaattggtagaatatatttgtggattattccgttgttcattagctaatgcctttcagttgcaatag

SEQ ID NO: 90003 - DNA, 860 bp, Oryza sativa
attcctgcagccagacgaagttacaagcccatagacccattacaggtgttgcaacaccttgtttcttcagttgttgccgactgagatggaatttggcaatgaggctggatccattggaaagagaactttgagagctttccatcaagtactcacgggccaaaaacggaggtcgtatgctgattcgccggccgtttgaagtcagcaatgtagtaggtggccgaatcggattccagcacttggaggacttgatcttcatatcttcttgttcatccatgatgtgagtaatggttgtatctgtagtagccatggtcacatcatcctctccttcttcacggaaaaccgtcctcggtttttccatatggtgctcttcacgtagtccatttaaaacaatctgtttcttccaatcaaaacaagccaaactcgagataattttgttagcagtaacatttctctctagttttcttgttttatgcacatgtacagaaggttctaaatccgaacatatgtaaactctatgcaccaaatatattcctctatcattatattcgccaaagatataagaaatagcattagttggacatggcaaatcagatttagcaaataatttctccttcaaattttcgagctcacaaaaatcatcaaaccaaacataggtatttaaagaagatagcaattcatgttcctctacttcatttacaatgtgaacaatatgcttaaaatcagcacacaaagaaacactagaaatagaatgttcattcactagttatggcatgtagaaatagaatgttcattcactagttatggcttggatataagtgaagcattatcacacaactcttctttatcacaaggaacagcaa

SEQ ID NO: 90004 - DNA, 700 bp, Oryza sativa
ttatcaggcttcattccaacagaatgcatacccggaaacacctccagaaccttatcctgtcttccatgtctactgcatacctcagccattgcattccatgacacctcatttcttcgaggcattttatcgaacacttcgaaggcagcatcaagaccgccacagcttgcatacatatggagtaccgccgtggcaagagcgacgtcgagcaagataggctcgacgccccagcgtcggagcgtcgcatgaacccacctcccgctctcgaggtcgcggctctgagcgcaagcccccatcacctgcgccacggtgatgccattgacctcctgcccgcgcgccacggcctccctgaaaagcgcgaccgcctcccgtgcctccccggccgcggcgtgccccgcgatcatcgccgtccaggtgaccacgttccggtggcgagcggcgtcgaacaccgcgcgcgcggaggcggcgtcggcgcgggagacgtaggcgtggacgagggcggaggccgcgtacacgttggcgccgtggccggatttgaccatctgcgcgtggaggcaccccaacgttgtggttgccgttgcggttgcggcggcgcacggcggcggcgagcggtggtgcgcctgggcgagcgccttgagggcgaagggaaaggtgaagtggtccgccgcgacgccctcccgcagcatggcggggctgcaggaat

SEQ ID NO: 90005 - DNA, 708 bp, Oryza sativa
tccttgcgtatgccgggcaggcagcatttttggtcaagaacccttcaaagctcagcacgacgttctacagtagtactccagagccactattttggcccatgtttatcatagcaactttggctgctattgttgcgagccaagcattgatatcagccagcttctccatcattcgacaatcaattgctttgggttgttttccaagagttaccatgaagcatacctcaggcaaacatgaaggccaagtatactctccagagatcaattactttttgatggttgcgtgcatcttaattactgttgggtttaagggtggaccagagatagggcaagcctttggtaagcaatctaatcatatatactcttgccatttctaattgttaatttctcttttactttttgtatgaaaatgttgtagttgcagagacttcaaactcatgaaaaagggctaaattgcacccaacacataacattataaatgtttttaacatacatatgtgctcgtgtgtggttggttgtcaaaacacagatgggtattgcataaaattaaaaaaaaaagtattctatagaaaagccatgtctaaccagttggaattatcaagttactagaaacaccctgctggtaccatacaaacatcaaggagagcacatctctatttggacagatgtaaatgacaatactatgtgctaaaaattaaggctgcaggaatt

SEQ ID NO: 90006 - DNA, 637 bp, Oryza sativa
aatcgccagaagaaattgtttaattaaacctagagctaatcctaattaataaatgcaatcaataattggaaatggcatggttgaccttttcttgagttccccatgctctaatgtgctaacaggatttttagtggaattttcagagctagaaatacttttcaccaactaaaattagcaaaccgcaatattttaatccttggaaattctttttcccttttctcctttctttttcctcctttttcctctccttcggccgtcggcccactccacccgcctcccgcctgcgctcggcctcatcttgttgggccggcccacttcctccctcctgtctccgggtcaccgacaggtggggcccacctgtcggccccttcttccacctccagctgacggcggcaacctccgccgagccacccacgccgccgcctttcccgctcctcctgcgccccactccgcgccctgcgcccgcacccacgtcgccgcccacgtctgcacctctcccgcacgcgcgcgcactcatagaggcgggattcaattcgaatccccccctctctctccccacctcccccacgtcagcgagaaatctcccccccccggccatgttcgcctccccctccgcctataaaaagccttccccaag

SEQ ID NO: 90007 - DNA, 702 bp, Oryza sativa
atttagaaacgggagataaatcacattgttcatgcttcctcgcatttgatatgatctgactctcaatgctacgagcaaacatgaataggtgcccaatatgattatatgtcacattatcaagcaaaacctgaatttcagatttaaggccattaaaaaatctacgcattgtattttcattgcactctttgagaccactgtagatgatacagaccttaaattcatgaatgtactttacaacagttctatcaccttgtttcagatgttctaatttctcccgaagagtacatttgtaataagatgtcacaaagcgttttctcatcatggttttgaattcatcccaagtttcaggtttattactaacataactccaccaaaataatgtagaagaggtaaacttattactagcagccttaatcatttgagcatcagaaaaatcatatttgtcaaattcattgtctactgctagttcccaatcaatatatgcaacaaaataatacttaccatcataaaatggtaacttagattcaactcgcgcaaaattatagtgatgtacctcgtatgcatcacgtggagatgttgtcatatcttgtagacggtgaagaagccgatgtctcgtattcgcttgctcaatcctgccatggttagtagcaaacaagaaacacacacaagaatatgcacgctcctatcagggctgcaggaatt

SEQ ID NO: 90008 - DNA, 1564 bp, Oryza sativa
gagagagagagagagaagcagcggcggctctgatcaccccagagatgcggcggcggtgtcggcggcggaggcggcgcagacggcgagacgacggcgagagacgacggcggcgaaggagaaggcttatgcagtggcggcgaaggagaagccgagatcggaggaaaaacttctaagtgttggtggagaagacgagggcacatcgggaatatatatacccatagatcttttctcccggttggtgagaacaaccgggactaaagatatctttactcccagttcgtaagaacaaccgggactaaagatattttcccgctatttccaaattctttttaaacccggttagggttaagaactgggactaaagataatagcattgaatattgaatttcattacatatgtgtttctaaaatagtaaataatgcattaaaattatttaaagtcaaaaaattaatgacaaaaccttcgaaaaattattgttgtctgtagtaaattaagtggataatatataataagcacatgaatgatttaaaattgttaaaaattctaataatcatatataattagcatatgcataatattaaattgttaaaaattctaattaacatatgtaaataccacatgcatgatttaaaattaataaaaattctaataatcatatataatttgtatatgcatgatttaaaattgttaaaaattctaattaacatatgtaaataccacatgcatgatttaaaacttttaaaaattctaattagcgtatataactaagatatgcatgatttaaatttgttaaaaattctaataatcatacataattaacatatgccatacaacaattgatttatatgggtattcaatatatccaaaatagtttacatcgtgtacacaacaattacggcaatacatcggcggtaacgatttacggcacgtactttctcctcactattgttccttccttgtgatcgctacgtgagtaaggggtgtcttcatttgataggaggatgctagggtcaatcgtcaccgtgaaaggggggttgcccatcaaactgatcgtaatcctcgtcagtcttgtcctctactccgacgatttttctttttgtctaggagaaccacgtagcgcttcggctcgtcaagccctttgcccttctttcctttgctagacatgtccgtcacgtaaaaaacttgcgttacatcattggcaaggacaaaaggttcgtccgagtatccaaccttgttaaggtcaaccgttgtcatcccactgtcatcaatcattacgcctccaccagtcaacctaacccattggcaccggaacagaggaaccttgagaggtccatagtcaagttcccatatgtcctcgatggcaccgtaatgcgtgccagttgtaccatcgtgtcccatggcatcgatacgaacaacactgttctggtttgtgctcttcatgtcttgggctctcgtatagaatgtgtacccattgatttcatatccctggaatgtcacgatcgagccagatggtcccctcgccaggaaggccagttgttggttaatcgtctcgttgcccatgag

SEQ ID NO: 90009 - DNA, 637 bp, Oryza sativa
tagtagcttaagtagactccccgtagttagccggcgccgccccgaccgttgccgtcgatcgccgtgtgctcgccgccgtcgccgcccgagctccgtagcacccgctcgtcgccggcctcgctcggcgtagttccgcccaatccgatgctagcgtcgagtcccgaagccgcatagatgctctcaccgccgggaatcgacctctcgtgacctcgtcgccgtttccctcttctcccgccgccggttgtcgctgccgcaatccgccgccgtcgagcaacctctggcgaatccgagccgttggctcgcctccccttgtcacgtgcaaccgcccggtgtgcacgcttttgcccgtatcgccgtggttcgctccgccgctcgccgccgccgcccgccgtccattcgcggccgggtcgtcgtctacctcccgccagcccacgtggccgccacgtaggcgccacgtcggcgccagcttagccagaccgggtcgggccgaccccggtcggtccctccgcgtgcgcgcgatccaccgcgagccgtgaggctgcgcgtggccccgccgtacctgcgtccaccgcggaccgcgcgcatgcaccgcgtcccttccccgcccgcgcgcgtgcgtcgcgtgctccctccgcac

SEQ ID NO: 90010 - DNA, 1428 bp, Oryza sativa
ttggggctgcatatggaagataaacacaatggccatggtgcatgcagagatggagatgaagtccgtcgcgttctggaatccaattcggccacctgagatagtgctgaattcaaacggtcgccaaatttccatatggtctctgttttgggcccacgagtacttgatggaaagctctcggaattctctttccaatggatccaacttcattttcaaattccatctgagtcatcggcaactgaagaaacaaggggatgcattgtctgtaatgggcctatgggcttgtaagttcgtctgggaccccggcccaagtggggcccaaggggggctgcgccccaaacagagggaggaagcccttctgacttcctccatcccttaaatagctagcaaccccttcagggttagttgggttttgttagattaaagtttagccattgctacttccttgcagcgcacgtgtcggctagaccgtccatctgcttgttattcagaacctcaacttatcatctgtatttaattcctatttgcaatatcagattgcttttatcttgttcttgcttgtttcttcgatttgcttggaggaatagggttgatttgcaccggcaagatcaataacccacggagaggtgtatcgatcgctaaggcgcaacgcaacgtcttgtacggttgtagtcagatcgtcaacgtttctctcaaatcgtagttatcttaactcacagaaagatcgggccaacaacagccttgagtatcgagtggaactcagggttcatcaggtggtatcagagctttcgttgctcggtgagtttttatctacctataaccagaaaattgccctaaaaaaattgcatccttacctagacatattgtgccattgcgttgttcttatcaatttttgctttgttgagttctgcgttacatcgtcgaatcgagttgctggtcttagcgtctagtccgtttagagttttgagttctagtcatgttttgttccacaatcgtcgccgccatcatgtctctattgtcgtcgggacctaagaaaacggaatcggcttgctgccacggttctatttttgtagttttcagaagttttttgtcggtcagttttggagttgcatctaggttttgcttaagtttctggtttgcccgtgaatagatcggccgtgcttgttgccggcgtagagaggaggaggaagaatttccaaatctgtttttggaagtacgagagtttaatttggaaagaaatagtagatcagattgattgaaaatcagtttctctttttcctagtggtgccgtatccatccacacgtcgcccaccaccaccgtgaggagtccgaccccctccctctcctctcggtttcggtttcggtttcaatgcataccgtgagttgctagacaccttggtgaatttttgtttggtgtcagtttcgtgatct

SEQ ID NO: 90011 - DNA, 3914 bp, Oryza sativa
tcgggactaaagatgatcaaatcgccaagttccggtttttattgcaaccggaactattgtggaattcgcccgaccgacgaaagatgatttctccaccagtggcgcatatcctaatacaacgaatctagacaaaattatgtccaaattcgtagtgttaggatgtgttacattaattactagctacattagtttttttaatgaaacggagggagtatgtaattatataattgttgaatgtatactcaattaataaatcctgcgtacgtcactggcatcacgggccctgcctgttgacgcatggtcagttccgaggcagccaagctgttgatcaaataaactatatgtatatcaggacttcagctgcctgtgtgaatatataaattcaggaacacgtacaaccacggggatgtgcctgcaatttgaaaccacaaaaacgcacgcgttgcacactagctataggtttgcacttatataatacacttctcatcagtaaacaagagaacggcatgggtctcctgacactttatgcttatcaacgtgtgacagtctcaaaataaaatgaaggccaactggctaattggccatccataatgtgagacaaaagtactcttataattgtcgataaggattttgttcttatttctcagataagctataagtattatttttgtctcacattaattgtaaggtcgaccatgttcccatttctctaactagctataagcacacttgttccctcccatgtgatgctccctgtggcagtgctcgagacacattcgtccctaggcatgacccccacaagcatgatccttttgtgggctatgtcagtgcacctcgggcgccccctcccccccaagcgatgctcggggcacattcgcccctcgggcatgaactctagaacttggcctccgtgggcggttctcggagcacatctgtcacctgttcccaagtatctggggtataccaacctagcctaggaccggtacaacacgcgacaagacaacacataccaaccctgcaacaagcctttatctctcctatgcgaaaaggcgtgtgctataggcggcactgttgagtactatgtcgcacgtttagttcacagtcatcgcacactttcttccgacggcaggcgcacggcctgacaaccgggcccagtcaccaagaagcaacaagaccaaaaagacaccttacccctatgcagggtccatttataaaaaacatgccaccgtgatataaaacgaggaccagggtcactgaaaaagagagaactcttattagttagattgattattttatgatgtactccatgtgtccaaaaataaaacaatctaggattgattggaacatcatctagtacataaccaatttaggtgatgtcccaccgaatcctagattagtttattttggaacggagggagtatatcctatcttaatgccaatggctatcgctatacattgtggaaatggaaacaagaagagttcacttgtgtgggtcccatttatatggactagttggtccatatacattggtgatgccctgcatgcatgtactattaagatgttaggacatactttcttcatctcataaaaaagaaatcttatactccctccatccataatataagggattttgacattttacttgcactatttgatcattcgtcttatttaaaaaaatttagaattattatttgttttatttgtgacttactttattatccatagtactttaagcacaactttttgttttttatatttgcataatttttttgaataagacgagtgctcaaacgttacaaggaaaaagtcaaaatcccttatattatagggcagagagagtacaacatgtaacatatttttagtactatgaatccgaatagcattattgattagttggttcatatatattggtgatgccctgcattcatatattgttcaaatgttactccctccatcttataaaaaataaatatagtaccaactggcactaatccgatgttttgaggtagtggataacttaccatctttcggaagaaatactctaataccccgatgctttgttctggcttctagccaccccggccccttcctctaggtctagtccatccccattaatttagacaatgatcagtagcattctttgccattattcacttccatgggatccttttgagcacctccactgattctcagtttaatttgcaggtgccatgacctagcctatccgccactgagtttcgccatgactgtaatggatggggggattcctaccagaagcaagaggttgttgttggatctaagcagcacaggcatagacatcatcttacttggccaaatcaatgttgaccatcatctagctagctaagctagaaatggagcttgcaagtgattaacttgcaagtgattaattaattcctttggactttcttaattatatatcccacggaagaatctgcaaatcgatgaatgcaacccaactttaggctccatttagtattgcagtgcagtatgatatagtctgatacaaataggggcggatccagcgtaggtgctagggggacttgagtcccccctaccccgctggatcaccactaacaaagggggagatgaaaggaaaagaataggaagaaaattaagagtaggggggactgaaaaaggaagaaggaaatgagttcccccttaaatcttgttctggatccgccactggatacaaccacacattttcatatttggaaattattttcttttggtgttcgatactatgaaaaccattttttcaggcgatcaaatcgctttacgcagacagcccgccacttagcatgtgtttacgaaaatcatattgttttgcaaccaggccgccccaactgaaaatacagtcagcctgtagttaatcagcctcgtagtagtaaattgtttttctattagtagttgtaatatcacagtttgaaaataggaaataaaaaaagttgagaactatgaaaaactggaagtatggtaacatatatattttaatttatttatctaactagtttaaaactataatttgatccgtaaaacaatgtacggcgattataagtatatcaacttaaaaataagcacaacgcagcgtatagcacagcaaatacaaatcgaaccttatacacaatgcactaattaattaatttcgtatcatgctgtatctatgctggtgagaatgctaatgtgactgcggtaaatatataggccgccgccatatttgtgttcttgggtaccagttgctagtagatttctaggatcaaaatctccaaagatctactgagaaaaatgtctgatccatgttgcaattgccgtcgatcatcacatcctccccaccgtcttcgcatggcgatggcggcattgtgtgcaagaacccgtacatgaaatcatccatggccgggaccagatcagcattggtactagccgctgacgacgacatcgccggcaacgtgtccatgaatgaccagtcaatgacatcatcaccgccgtcgtagtcggcagcgccgccgtcggtggagggcactgacgacatggccgtgtcgtcgttgctcgtcgaccgcgcaggggctgctgcttcttgccgctgcgagatcgagtacgacgacgacgacccgccggcggcggcggtgttcgccggaaacgggcggttggcgtgcctcgccgcctcggcctggatctgctcgaccgtgagagccgcgccggggaagcggcggcggacgtcgggagggggggactccgggaagttgagcgagccggcgccgcgcgagccgcggaggcagacggcggcggcgtcgaacgcccgcgccgccttctcggcggactcgtacgagcccagccatatcctctcccggctgttgggcatccggatctccgacacccaccgcccccacttccgcagc

SEQ ID NO: 90012 - DNA, 556 bp, Oryza sativa
ctccgccaccattgatctcacccacccatcgatggtaggcaagatgcgacaagcgcgcagctatgcccgttggtgatgaagggaaacgatatgggctgagtcggtgcagagacggcctcaaggttgccgagaggcactgtgatggcccagaataattagagggaaaatagaaggaaaaaaatccactttgactctcttaattgtacgccgaatctaattcgtacccctcaactagaaaaccggataggacgactcccaaactattgaaaccagtgcaatttgacttcctcagcagttttggagggtagttttgctgatgtgtcgctgacgtggcagtgttgacccggtcttcgtcccacgtggcgcttacgtggcattagaatttaaaaaatatatgtgggacccatctatcattcacacacaaatatatattgtggggcccgacgtcgacggcggtggccttggcgagcatggaaatggagcatctcatagcccgcttcaacgatgcccacgctgtgcatagcaacaactatctgctgctggacgccgtcgccac

SEQ ID NO: 90013 - DNA, 2646 bp, Oryza sativa
  unsure (1)..(2646): unsure at all n locations
acctgcagcagcaagggttatatttgatttactggaacagaaaagcttggtttcatggacagccatgatgaagggttgcttaccctatggacatggagatgaggtggttcaattatttcacttgatgcagaaacatggggagaaacctgattccatgtctcttgtaactgctgttcaagctgtctctgagcttggccatctaaatggtctaaaacaaatccattgttttgtttaccgttccctgttagagaaagataagattactgcaaattcattgataagtgcatatgccaaatgtggaagactggatttgtcagtaggtttgttctttagtttggaatacagaaacttggatacttggaatgcaattatcagtgcttatgcgatgcatggattctatattaatatgcttgaaatgtttaagcaaatggaagaagaaaacattcagcctgatgagttaacattctctactgtgcttactgcttgcagccatgctggtcttgtcaaggatggttggcgtatgttcaattccatgacctcagtatattcagttcttccacaggaagagcattatggttgcatggttgatttattgggtcgtgctgggcatctggaagatggatacaaatttataaagctatctaccttgaaggataaatccactatattttgtgttttgatctctgcttgcagaacgcatagaaatacacaactggcacttgctattagcaaagagctccttgagcatggaccacagaaaccaggtatttatgctctgatttcagaagtgtatgctcaggaagggcagtggaatgaatttaccaatacaagggccagagctaatttaagtgggttaaagaaacatcctggttctagtttcattgaattaatggagcaaggcatgtgttagcgaagagcctgcggacggcatgctactctttatagtgtgtaaactatacattatgaccctttttaacttcttactttacaaatgggcccatgagataactaatagcaaactaattgcaggaatggactcctccctttgcatgaagaacagaagcgcacaactgcccatctcgcatctctctcctctcaaatccttctcaaattggcctgaaatcaaaggtttttccgtgggacgtgtggacatcgtctaggaaggtactctcccttgattgtcctcattttgatatttccgtagttgactcgagcattggggtgaaaccctagcattgatttagattcattcattggattaattttatcggattgattaaacgcacagtcaatttgtgattgagtgtagcaggattcaggtagatcagtttgtatgaacttttggtttagttgaatttcatgcaatgactgggcacaaaaaccggttcactcagctgcaaaattaaggaattgcatcataaatttcagaatccttgcattggagggaaaagaacaagtaatccaacatgcttcatcctatataaggtgcccattcccttctactccctcatcccaaaatataagggattttagctagatatgacacatcctaccctatctagattcgtagtactaggatgtgtcacatctggtcaaaatcccttatattggagacggagggagtattgtattttctctccctggacgcacacttgaaacattaaagtttcaacttacagatgcctgactggaatcgagaactgatgcttgcatgcaagcagcaaaatcattgaagattgttcaggtagtgggtgcatggtcgtagtttttagctgaatcggtatttacattaacaatttattcaagctctcatttgttttttcacaattgatttcttgaactgacagctaatcgtttggtgtttcttcctcaccaatattcaaccattcaggccatcactttgctatcaggttacttagccgagagcaattgggcaatggttcaagaaatgggagagaagacaccacaatggttccttcgctatggccagttctccacgtgcagcaagtataactttaaaaagcacagcagccaggaatacatttgccgtatgtatcacttatttattaccgttcaccatanagttagtccattctggttttgttatgcccttaaaaacatttccttcaatcttaaagataatattgaggagattggaggtactaatgctgccacattggagataaacaactcttcaagttggggactgggattcttgggactggacagagaagaacatgtttgatcttgaggagcttgatcgcagtgacgtagtcagcaacctcgagtgtcatctgctatattctcatcgcccaacttaagatccaaggagaaggattgctctaaataatgtacttacaatattatctaaaagaatatatctagttattagggccgtatgcattgcttgatgcatatgtggagaattttttactctactatcttaaaaggtatgtatggatacttttgattagtttaggttggttatatgcatttagtgaggaatttactttttgtgatatgatggcttttgttttgtgacaaaccaattatcttttctcttgatcatctggcaaaccatgaaatcgtttgtcttgaacccaatctttatttttgaccaatggtcctttcctgagatctgctggg

SEQ ID NO: 90014 - DNA, 880 bp, Oryza sativa
caaccaagcataactatgtatactgatatagataagaaagcaaataaaaacatcctaacaatgaaatgagtcaaccatttcccaatgtccaatattgaccagaagcacaatgggatagcatagaacaagttctagctagaatgaaatggatggaagcaacaagaaacatatagaaagttataaagcatagtaaccatttaggatagtttcagcaaacaaacattgcagaagcatttctcaggcgtcataacttgccatgacactgcctccaaataagtaacatatatcaaatttataacattcttatccggaaaaaaataatgtccatccaaggaaacactgcctatgtaagcgctgaagcattacacaacttgactatttatgcccgtatatcaatgaaaaagagatgcagccttcaatccagtcttggttccataagcaatatttcaaagcctctctccagacacatacaacagacagaagtactgtgtcctacaagttcctttgggaaaagagtcactcactaatattatcacttggcaccgtcccttcatcaacactctcaactgcagcagcaatacttgcctcagttccagcattatccatgtagcgaaaatctggataatttctgctgttcaacgaatgcaaccagagagctacagctccctccttgtgctccattgcagcgatatgagggaatatatacttgagcttaaactcttcagcctcctcagaataaggttccatagaaaccgcctcatgtgaatccttccatttcttgttatatgaagtgaacatgcattcatctaagtacagcccaacctcaggcgcagtaggcacattaagattgacatccctgtaacagaaacggctgcaggaa

SEQ ID NO: 90015 - DNA, 2856 bp, Oryza sativa
gtcaaggacgccatgcacggcctcagcgtgagcttcagcggcttcaagtactccatcgggagctcccatgccgtggtgcaaagcatcatgaagcatccccaacgactcggtatctgaacattctacgcttcagtttcggatttctgaccaacgcaaggttcagagtttcgtgacacggcattggtgtgcaggattcaaggaggtcacgacggcttgctgcggctccggcaagttcaacggcgagtccgggtgcacgccgaacgccacgctgtgcgacaaccggcacgactacctcttctgggacctgctgcacccgacgcacgccacgtccaagatcgccgccgcggccatatacaacggctcggtccgcttcgctgcgccgataaatttcaggcagctggtggatgaccagcactagctagagcgtggcagtgtcaccgtgtaacgtagtactactaattgttgtacgtcgccgactatgtgtctgtttgtctggtgatattggtgcgtaggatatgctgggctgtgttcatcagtggcttgtgctttaggcggtggtgtagtttggatacacataccaaaatgtcatctccgttattattgttgcccttgttggtatttgcggtgtttgtgttcccaagtcgggaataatttgagcctggagcggatgagccaaggacatcgcactgcttacttggtgccaaatcggaatacaaactctaaacatgtaggtacatacacatatccggccatgccgttcttggtcccagttggtatgtcctcagcttgcgccagttgtgtatctgtcctgaagtcgccgtctcggctcttcaccactgccactccaggttaccgatctgcaggccaaatggaattcttcagagggtgaaaacaccagtttgtttgattgcgctagagaatgaacagcaatacagaatggacgtggacggcaattgaattaacaagttggtgctttggtgatcatattcgagaatcgacagtatatttctttctggtgcatattcttgtatatatatctacggtcacaaaggctgaagcatccatcacccgaagctgaggagagcagagagcagagagcaggtgtgccaatgggcagccatagtttctcatacgtgctggtggctttgtgcttgcttggggtcgcggcggaggcgacacagcttgcccccgcggtcttcgtgttcggcgactcgacggttgacgtgggcaacaacaactacctgaacatcaccaagcaggcccgagccaattaccccaagcacggcgtggacttcaccggctcgacgccgaccggccggttcagcaatggctacaacttggcagaccagctaggtgcgtacgatcccagatgaatatatggtgccctctatttagatgactaaccagcatgtgccgcgtggcacgcttcgatgatgaacagctcagcagctcggcttcccaatgagcccaccggcgtacctgtcgctgacagcgaagaccatcgtttcgcagatgtacaagggcatcaacttcgcatcaggcggatcaggcctcggtgacaaaaccggccaaggggtttgtttaacttgaacaaatcagtaacacacgttattattctgaaaattctgaaccatatgacacgtgacacgtatgaccgtgccgcccgggctgaaacgaacttgtttttttgaaggccggggatgtaatcccgatgttccagcaagtgcagtacttctcgaaggtggtggcgatgatgcagaagctgtcaggctcgagaacaaccaacactctcctctccaagtccatcttcctcatcagcaccggcagcaacgacatgttcgagtactccttgtccggcggcaacggcgacgaccgcgagtttctgctgggtttcgccgcggcgtacaggtcttacgtgagggcgttgtaccggctaggcgcgaggaagttcagcgtcgtcagcatcacgccgctgggctgcaccccgtcgcagcgggcccgccggctgtcggaggatggcacgcgcggatgctacggcccgatcaacaccctctcgctgcggtcctacccgacgctcgccgcgtcgctccgggacctcgccgacgagctgcccagcatggcctactccctcagcgactccttcgccatggtctccttcatcttcgccaacccgcgcacgaacgcctggagtaatcaaacggcccatggacacgttaatgtctttgtcttgatggtgtgagtctaccttgagcctgatcgatggattcttgatttgtccctgtaggtttcacggagctggagtccgggtgctgtgggtcggggccgtttggagcgctcgggtgcgacgagactgcgccgctgtgcaacaaccgcgacgaccacctgttctgggatgccaaccacccgacgcaggctgcgtcggccatcgccgcgcagacgctcttcaccggcaaccggactttcgtcagccctgtcaacgtcagggaattggctctgctgtgattgcgcccaaaaagaaatttcaagctattcggcagtttgcaaacgtaatgatgtgatttgatctcttccacctaataataaactatggccggatccatacgattgctcggttagaagttgaggtcgtttccaccacggtcgtgggcagagatgtacacgggagatctctctgttctcgtgtggttttgtatcagaattcagagatttctttatacacggaaaggattttaaattgacaagaaggcacttgtttgattacagggaaaaaaataaatctctctctctctctctaatttccttttctttcgctgaaccgaattttcgaaaaggaaaaattacaccgagggctgcagg

SEQ ID NO: 90016 - DNA, 682 bp, Oryza sativa
atctgtaaatacataccttcacctcgtcgtacagcttcttctcccagatatagagcttttgcagagtcaaagacaagttccttgctcccaccaccttctcccctcctccgacatccaacaggtcgctgcctccgtatcctgaatgcggcagcgcaatcactgacaccatccgagatgaaactgtttccgaacagcaatcaaacaatggctccaatgatcaggcacgaggtaatcgggagatgcatgcgtaggttatacaaagaacagagatagctcaccatggtacactgagctccggggatggtagctccgcctcccgacttcaagaatcggcgcgagcgccctgaccgcgtccgccgctcggacaaactgcgccttgatctcgccggcaacgtctgcaccatcggcggctctccggggagtcggaacggacgcggcgacgttgccatgcgcaggcgtctgttgccgcgccacgccgccgccgaccactcccttgtcgacgactggattctcctcttcgtcgacttcggcaatgctgctgctcacgccgccgatagagctgcgtcggctgcgagcgccgccgctcccgtgcgcggagtactcgctggaaacctccttgacgaccgcgtcgtcctccttcagctcagggatgccctcctcctcgcgcacctcccgggagctc

SEQ ID NO: 90017 - DNA, 775 bp, Oryza sativa
ccgcctcgtcaagacgctgctgctcaaggtgctggcatcctccttccatgtcaacacatactttgaccggattcaggaggcattgttcaaccagtttgtcatcgagacgctctccgggccgcccctagttgacgaaaaccaattccttgctgagatgcatgagcttcaacgcgcaggagcaaccatcccagctgagctccgttccactgtaccaaccaagaatctttcagggcaaaggagtattcggatgtccggggtgattcctaagggagaagggagcaagcagctgtcaaaagagaaaggagagcaccagattgaggaggggatcaccattgacaagcttcataaactcaaccagaaaaatatctcagcttggaacatgaaaaggttgatgaggattgttcggtttgggacgctcacgacaatggatgagcagatacagcaggcaacgggtgagggggatgagtcagcgacacagattcgtagtgaatatgaagccaagattgctgccaagaagatctttcacaatgtggcgaagcctggctccaagtaagtgtcttcattgtcagtagtatagtatggttagattccctaatctcctgcaagtgccatcattgctagttcttacaatatagataatcagacaagcaactgcaatttatctgtaatgtaggaactgttagttcgtgcggtggtcgtgcggacagtcagtgttatttcattggagatgctagtatgctaatatttcatcctatatatctttagtattaagtta

SEQ ID NO: 90018 - DNA, 696 bp, Oryza sativa
ccgtcatggcgagcgttgggagtgggagcgagcttacgaagtgccttgagtgctcagagaggggtaggaaggtgcccggtgtcatgggccgggagggtaaggtacccgatcctgcccttcaggaggagaaatctgttgaggcttcccgggaggaagctgcagtgggttcaaatgaggatgcaaattgtgatcctgcaagcactggcgatcgtagtgttgatttacctatccctgataatgaaaccaatacccaaatcactgaaatgagatcaaatggtgcagaaaaatgtgatgttcaactgtcaggtggtactctctgttctgaagctgtaccagctagcaatagtgagactgtttgccccatcctgaattcagattccaacacgaattcagattcagttgatgttgatccttcatttgtggctgaaaagaaaggtagtattgagactgttgttactgaagatggaaagaaacaagctatggatgttgttactgaagatgaaaagaaacaagatgtggattatgaaggcagcagtctagaagagatgcccctgagaagtgcattttcttacactcatgaagtcaaagagaggtttaatagaattctcaaaaaatatgttggaacacacaatttccacaacttcaccaccagaactaaagcggaggatcctgcagccaaaaggttcatcatttcct

SEQ ID NO: 90019 - DNA, 754 bp, Oryza sativa
tacgacagtgcggcagtgccttcgctagctacgaatataggaccggggcgaggccagctacggatgctacagtcgagcggccaccacgattacgagatgcaccggagcgagtgcagggacgccgaggtgtccatggacgcggcgtcgaacatgcaccggcggtcagtagcctcgatgccgtagtccatgagcgggcggcgctcgagctcctcgtcatgccggcgcgcgcattccgggacctccatctcccccttgctcacgtgctcccacaggtactcgagcctgctcatgtacctcagcttctcgtacagcctgcaagatccaaaattccaaggaaaccacggtaaacaccagcgcctcacccacgaatcgtagtgcagcacacacggagtgattcgttgtatgtacatacccggagctgaagaggaatcgccccaaggtggcgaagaagaggcgggcctggaatcccgggtgcacgaagtacaccgcgcgcagccgctccttggccgcggcaggcagcgcctcgtacgccgcgcggatcgctgcgacgccggggaagttgtcgccgcggtcgacgagggagtggacgtacacgaccacgaactcccgctccccgatctccgggagcacgcgcctccgcacgtaccccctcaacgccgcctccgcccgcccgcccagcgcgcgcgctgccgcgacaaaggaaacggggtcacttttccgccggcaaaagcatcggaattggggctgcaggaat

SEQ ID NO: 90020 - DNA, 1266 bp, Oryza sativa
cctggacatggactcgatctcctcgaggacggcgacgacctccctcatggagggccggttcttgtggtcggcggcgaggcaccggagcgtgagctgcgccgcacgctgcgcgcccctggacgagtactgcccctcgaggcgcgggtccatgagccgagccagcttccggcggtcggacaggaatggcttggcccagtccaccaggtggtgctgcccgctgggccgcccggcgtcgagcgcgcggagccccgtcaggagctccagcagcacgacgccgaagccgtacacgtcgctcttcacgtacaggtggcccgtcgccacgtactccggcgccgcgtagccgtaggtgcccatcacgcgggtcgtcacgtggctgctgccgccggccggcccgtccttggcgagcccgaagtcggagagcttcgcgtggaattgctgcacgtacgcatgatcaatccgcgaggaaaaggagatgatcgagttagacgacggcgtgtactctggcgggaggcggcagcgtgcagggcgttaccgtgtcgaggaggatgttggaggccttgaagtctcggtagatgacgtgcttctccgacgagtggaggaacgccagcccgcgggccgcgccgatggcgatgcgcagccggaggctccacgacagcggctgctgaggcgacgcgcttccgccctctggttgacacaaaaagattgtcatttttcagctctcgttctaccgttcagttacagtgtgttcagaaaaattctggtttgattttccgatgccagctttgcaatccaataatgaagtaaattccattgtcattccaattccaacctggcaacccaattatatctatatatctatactcttcatatcaagctagcttttgatactctattcacctgtataaattatgcactatcagttgactctgttctcagaacatccactaatcccctctccatgtgaagcagaacaatgatctcaatttgtccccttgtgaccaccatcaggcatcgttaattagcagcccaagtcaagttgtcagctcttaataatcatggccataccgtcatggatctgaaagcaccatgaaaccttttgtcttaaagtttacttactgcgtggctcacttctgaagaggtggttctccaagctgccttgggccatgtactcgtacacaagcagtagctccttgtcctcccagcagtagcccagtagcctcaccaggttgggatgtgaaagtctccccagaaaattcacctcggact

SEQ ID NO: 90021 - DNA, 1323 bp, Oryza sativa
ggcttctgtgatggtactcaattgtcattgcccgctcttatgctgttccatctaattgtgatctaagatttcgtatcaaattaagtaagttcagaccgaagatatgtaagtactgaactcgttttggatattgatgatttagttttctataaacaaggcattgtaggcttgttgtagctttatacggttccctttgctttgacttttcaacttcgaggattccagcaaatgctgttaatagtagcataaaccgtgtcgaccatctgctggtgctccccgattctgacagaatattttcccctttctaacaagtaaaaacaaaagaactgaacctttataccattcgtaccatgagagaacatggatgcctataattttttttacatttttttttaaaaaatcaacttgtacaaataattccgtataaacacttatctagatttattctgattttttttatggacggaggattacctcccatcactccccatctccaacagcacacatgccaaactatccctctcgttggcaacattgtcttcccgcattcatccaccactgcggtactccctctatcaacattgtcttcccgcctttatccaccactattaacattgtcttcccgcctttatgcaccactgcggtactccctctgtctcataacatagcaatctaggactgtatttgatatttcatagtacaacaaatctggacacacccctactcagattcgttgcactataaaatatcccatccaatcatagatcacacccctactcagattcgttgcactataaaatatcccatccaatcatagattactatattataggacagagggaggacctcttacctccgcgttgttgtgcggcaacaatccccacaacgatgaactgctacttcggttagtgcgacggcaccacaccggacaccaccacaacgacggcaccacctcgtccttgccatgcattggcatgagctcggcagtggcgacgaaggatgcacaccagtaaccatcctcatcatcgttgatggaggcgagggtgtcagggtgagcgaacaggctgagaagctagacgacggaggcaactacagctagcacaccatagtgacggactcacaattgccgagtcggaacttgatagtgcactccctgtcactacaaacacggagcatgtcgaaggaggagaggacgagcgagatcaacatcaagtcgttggtgattcacattgggagggaaaacgtccctacggttaatacgcctacccggtggccggtacacgcccatctgcttcctgttcacacgatcattggaggcaaggc

SEQ ID NO: 90022 - DNA, 692 bp, Oryza sativa
catgatttgcaaacaaaggcagcatatcctgtgcaaatcttgaaacaccatttgtttgcaaatcttgcagatccgtggtgtccgttccttgccaccctgcttcttaccagtattgtcatccttgcttcttctaattcttttgcttctccccctcgaatgaatatcagttggtgggtgtatatcaatttcagtaggaattgtgcaaccaagaaaagactcaaactcctcatgtctagtatgcttgacattagacaccatttggtccaagggtgcctcaaggttgaacacactagatgttaagaagtcaatgccttcatctgagtgcttagccttttgtatgagatcttcaaatttgttgcgtgcaattgatattttctttctcattgccgcctccgaggagtcaattggcttctcttctataaggttgccttgttagtcatacacattctccctacgataacgatgtggttaggaaaccagtttcaaaaaaaaatagtgagtgtatgcactgtacaatttttttcatgaactgactaaaactaaaagattcaagcaaagagtatatgcacacattaccttttcactcttttctcccatctcttcatgatgtatgcagttggtaactcattttgattttcacctctcaaaactagaataatatgatgacacgggatcccatcggactcaaatag

SEQ ID NO: 90023 - DNA, 1248 bp, Oryza sativa
agctcatttctgtaaagagagttcttgggttgaattcacctacggtatatcacctgcgggcaactcctcatacatgttttcctcagagtgtatttctttttccagcgcagatgggtattgcttcagttgttcacctatatgtgttccctgcaaagccctattcgctattaggtaatcatcgttcacctgaaaacatttcagtgctaggggactatgccgccactgaccctgtggaccctgatgagataaaagatattagtcggcctaccaaattgaggcttccacagttggaaccagatgagataattgtgacaaatgttaaagagagtgttcgagactttgtaattggcagtggagaatatgtgagttcttgcaaactagtcctaccaagatttaaatctattctgttcttttatttttttacacttcataagattttcttcgtagagctcatatctactgctttcacccctccgaggtgtgggcttctcactgtgtttcaccatttcttttttatctgcttcacctagtttgcacgtgtttgccaatattcttattatgttttgtgtttttctttatctttaggtgataaaagatctcaaattcacgatgaagcaagcagtgcgaccagtcgggaagcgctttgagaaattaatgaagaagaagggcaagttcgggcaaagccgtgatgacaattgggtgagtacctccacgccacagagagcaatccatgggatcgatgatcctctcatatgcgggagctctagtgacagtgggatcggtagaggaaaacggcaccgcagggacgtaagctcagctggtgttgtggacagttgggaaggcagcgaccagacatcagatgggtatgtcatacggggacgccgctgggaaatcaagaaatcatgatattcttttgtacaggagctacggaatacaagctgggttgctgactcgctggtaaattttggtgctagcgtacagctcccgtagattgcttagctacttgtgtgattgattgtttgatactgtacaggtttctcgttttctatctataggtgcggtcagagtattgtaagtgcagaattccacaaattgtgccatgcttcaaggggccaagtgtaattgagttcctttacaaagtgcaaggtattgtaccagaacacaagtacacaactccctctgtaatttcgtgaaagtcgctgacacgaactggatgtacgccaaggtaggacacttcatgtgcactcg

SEQ ID NO: 90024 - DNA, 1362 bp, Oryza sativa
agcaagatttcagtggacaattttccttctgatttttgaattttgttagcagaatttattttgctctctggaatttttatagctcttgggaagtactccatgagaagtaaccatgaggtactccctagaatatactagggagtatatacctccctattaaaccggaaaaatactcaatactacgccacgaactgcattcaactctttccactcttgcacagttgtacattcattcaagtgcaccggaaaaatactcaatacaacgccacgaactgcattcaactctttcaactcttgcacagttgcacattcattccaagtgcactcttgctcattcattcaattgtatggaggccaagaaaaaggcaacacagaagatcagtacattgcatactagcaccgaaacgagcacttcacctatatgtacctaatgtacctgctacttcaacacaactatatctattatgatggatcaacacaggacatttgcctgaactgcatcgacaaacaacggtcagttagcaaaactccaaagtcagaacttccccacaaaaatttgatctgcaagcagcatttgcccagaacattctgcattgatctgataaattataaccacctggagaggagacccttgtattttacaagctgtgttcactgtagtgtcagatggaacctctatgccaatgcctatgaaactttggctctttctctagacaacctttcctcttcggcatgcctcagggtctcatccaaagctcgcagggaattggaagagtaactttctagggcttcaagaacacgcttcaaactaacctgcacactgtttgcctcaagaaaatggacctggtacgtttgtgctgttggaagaaggctttgccggcccggtactagagctagctttctgttgagtgtgtcggcctccttgttaatctccagggtcttcctttccaatatcttgttccatttttctctttcccggattgcaatcagctgttcagtttgctcaacattttgtttctcccataggctccgtacactagacacaagagcttgcatgctggtaatcacctccttctcagaaatccgatccatagcttgggaccagctattacagatgacaaacacaaggggtgcgcccactcttccaggagaatacggaggaactccatcagccgtctcctcctgctgatagttaagacagagtgccagccatccattcagtgccttgatgaagctcctctgctcattcacccaggaggaaaaattgacgatccatttaatcaactctagttcaagctccattgccagatctcgactggttccaccagaaattattgaatccaagtttttgggctgcaggaa

SEQ ID NO: 90025 - DNA, 618 bp, Oryza sativa
atttgctgttcctctccatgtgtgtgtagagtgtggtgttcgagacgtaccacatccagggcggcacggaccggacgggcgtcccgaccaagatgatgtccgtcaacgcgacggtcaggctgcgcttccgcaaccggggcaccttcttcagcctgcacgtcacctccacgccgttccacctcttctacgacgacctcaccgtcgccaccggccacgtacgtgccctttccaccaccccaaccctcgcctttctgctcgtacttctacctgaatttgcctatgccatcctcgttacgtttggtgaatctgaatggattgggtaggtgatgcggacgtttccgtgcctgattaggctggcgtaaatcgatggtagttattgctagttactgcgtaacaactcacaaacaaacgggtgaatcaagagttggatctgggctctgtacaatggatcagtagggttgtcccgattattcgtactgtgctcttcattactaacatgagttctatcacgactatagtggagtactaatctcctatgccattccgaccgtgatgccagcagtccgtggaatttttgccggtttagatcagcttttgagcatccccatgaacatcata

SEQ ID NO: 90026 - DNA, 673 bp, Oryza sativa
agaacttagaacaaatttgtggcagtttttttaacaattttattaaataaaaagggagtcctccgggttaataatacttgtcgttttggacaagagcacagtcttaaaaaacaactttaaccactattttctattataatatactatatagaagtgttaacaaatatatgattttattgaaggatttttttaatactaatctatacatataatcatcatatttcgaagataaatattttaaaaattatccataataaaaataaaatttaactatatctttatctaaaacgacaagcattgtaggaagctctatgttgacagttattcattttatacgtgcagggcctttgtaccataacggtatgtaccatttgttctacaagtacaacccgcatagcgcgctctgggacatcggcaacctctcctggggccactttgtctccggcgacctcctcaactgggccgctctcgacaccgcgctcgaccccacctcgccttttgacgccaatggctgctggtcgggctccgccaccatcctccccggcggcctcccggccatcctctacaccggcattgacgccggcaaggagcaggtgcagaacgtcgccttcgccaagaacccctccgatccgctcctccgtgagtgggagaagcccgcgtacaatccggtcat

SEQ ID NO: 90027 - DNA, 1387 bp, Oryza sativa
gggagttattttgtgatgtatgttgataacatactgatatttgggacaaaccttaaggtgataaatgaggttaaatcattcttgtctcaaaattttgatatgaaggatttgggagtagatgatgttatcttaaacattaagctaattagaggtgagaatgggattacactcttgcagtcccattatgtggagaagatcttgaatcgctttggctacattgatagtaagccttgtccaacaccttatgatcatagcttgttgcttcgcaagaacaagagaattgctaggaatcatctggaatactcccaaatcattggctcgctgatgtacctggctagtgcaaataggcttgatatctcctttgctatgagcaagttgagccgttttgcctctaatccgggagatgatcactggcgtgcgcttgagcgagtaatgcactatctgaaaggtactatggaattggggcttcactatactgggtatcctgcggtactggagggttatagtgattctaactggatctctgatgtggatgagatcaaagccactagtggatatgtcttcacactgggtggtggtcctgtttcgtggaggtcttgcaaacagaccattttgacgaggtcaactatggaatcagagctgacggcaccggatactactactgttgaggcagaatggctgcgtgatctattaatgaatctgcctattgttgaaaaaccagtgccgactatccttatgaaatgtgacaatcaaacggtaattgtcaaagtgaatagttctaaggataatatgaaatcgtctagacatgtgaaaagacgattgaagtctgtcaggaaattgagaaactccagagttataacgttggattacatccaaacagctagaaacctggcagatcccttcacgaagggactatcacgaaatgtgatagacaatgcatcgaaggagatgggtttgagacccatgtgagttatactatggtggtaacccagtctatgtgatccgagatcccgtgaattagaacctaggaagaacaaaccattagtaaactagaggagagtaccaatctataccctctctaagtgaagatgcatgtactctcgtgagcagcaaggcaggttggctatgccttaatgagttctgttggctttaattagcaaagatgctgtcttgcagagcattcttgaaagacatcacctttgtgagcttaactgttagtcacagtccgtggagattttgggtgaatattctaggaagcttagtaaagacctaggagtatgacttatacgctccacccaaggggtagtctatagacggtctagtaccagataagactcttagtaaaacttgcatgcacaagacttgcaattcaaggcgtagtccattg

SEQ ID NO: 90028 - DNA, 3223 bp, Oryza sativa
attcctgcagcccttgtgatgtatcagtttcttaattatttattcaccttttgaattatggagtataatgatttcgcaggcattaccatgtattctgcagaagacagaagctttagtgacaacatgaatcctactgtaggattcaatattagaaaggtggccaaaggtaatgtcacaataaaattgtgggaacttggaggccagccggtattcccaagcatgtgggagagagattgctgtactgtttcggcaattgagtaatttattttcctgtctaattactaatttgatgcatgtgcaacatggcactatactcagtagtagttgtcatgcactcatgcttaattggctgttggttacatacgctaaccaattgtttcgaagacattttgattaatttgacctctgctgaaattaggcaaatttccaaaagcacatttcagtaggcgagaccatatctgccctcctaattttggctgtagattcaaacagaatgctaagtggtcctttatctgcaacttgaataattatattatctttttaattaatttaaaatcatccaggattattgggacaggaacattctgatgtggaaccatttttctagaggagaaagactacactgcagaggatgtcaaatttaagaactcaactgttggaattaatggatgggccttagcccacacgaagattaattctttgtaaaatcacaaaagcccacctcatgagatggtatgcatgtggagttttgtaccaccttgcttattctaggagagggggacctccttaaaagggaggatgcccttctagccacttgaagcatgtgtggtggagagaagagggggaacacacgcgcgcgcttgctggcctggcctggcacggcaggcggcgtgcgtgcacgtcgaatgatcagcaaaattggctccttatgcttacgcagatgcagcctccttttgcagttttgttttgttgcggaaaattcggatttgttttcttttggaaacattccgaaaaatccggtgcgtgaaaacggcgtggagtccggataagtttcgcacgacttatccggttcggttacacggagtggagatcgtgcgggcgccttgatcaagcaacctatctctatataaaccgagccgccgcctacacgcaacacatacgaaatcaatttatggtttgcctcctactctgtgctgcaccgtcgctcgtagactactccatcccgctcgccggcgtgcactggcgatcaggagagcaggtctccggaacctctgccttggacgtcctgcatcgggagaaggcggcaataaggtttttgaaagcgcttcgcgggactgacgactcgccttcctcttcgctcgcgtgctgcgcgccttcgtcgacgcccgcaaccgtgagtagttcctaccgagcaaccggtctttccgccaccttggtacgtgttcgacatgttgcgcatatttgatatgttcatgttttactgcttagtttacatgtgtagatctaatgatgcgttcatgctagtttacatctgcaatgtcataatttatttatgaaataaattaaatcattatgtgcttataatttcaataactccccaggtgcttaaattttgcttgttccttttttttttttttttttatgaaacttgttcgtgttccatggagggatgcctatgcgatgagtgcaggaagctgatataccagtgtggtgcatgggtaagtgcagacaaatgcagccttagtaacaacagatatatgtgtgcctcatacaattccaggttcttgatggcaggttaaatcacttcatcatttaagagttttagcagcagttgatatcgtcgtcgatacgaggtgctttgaagcggataaatttttttatgtgaccatgacagggaagaagcagagtgatgtggagctcaatgattttcagaagtatgcctgtccatttttgcatggtgcgtgaattctgatttttattagccttcagaatttttttactcggattgttggaaatgttaaaaatctaagactgggattggtttgagatgcttgtgcacgatagggtgattgatcttgtcagctttgtagatgttgtacatttctttccagaatatgatgaaacctaaccattgttgagtgtttgtcacagactttagtctatttctgtctcttaaataagcatgttaagtatacacctgggtcctgaaaacctatttcttgccatttattttcagggaagttaactgttggaaatgatcactgttccttcataggcgtcattgtcaacataaaactgccagtggtttatgcatagataatggtaattaaggctggccgttttcaatagactgatgtaagtgtatccgttcttgcacccaatacagaaacctggaactggagtattataacgacggaaaattttggtctgtgacattcacattcctttgtagcagtttgtgtcttcctgcgaattcttgaggtgtctgtcatacacaaaagtgtctaatactcagaaattgatgttttggatctgtccaaacatgtattgccttaacaattttttggagagttcaggccatgacaggttatgtgtattgcttgtggtcttctgttcgatgaacaaactaatctctataatttgtactgattgtgatcgcagttgtgcacttttgttgtgatcatggatgttttcatgcatagagagaaggaaatatttatttatatacctacttaaaaaatagctagggagtgtttctgtcttgatctcgtttcatctgttgtctgtctcggcagcgcctgtttagtccggttggcgagtcgtgagcgattggagagcaacaaacgagagctgagtcttgacagtctaacaaaaatgagtccatgtctgctttttcttggtaacacagggacattattgctatatagaaataaaatttttggaggcaagtttaggaaatcaaggtcccacatctcgttcgcatgcaattttcctgtcatctctctggttactgcacggacacagcccagctcttttttttttcagaagaagaaccaaccactataatatatcctgtagttctcttttatggtgaatcttaaaatctttgttctatacttcgttaccaaaacttatattgtattaacataaattgtattaacttatattgtattttttattaaatattaccgtatcgttagcacgggcaaattactagttatgt

SEQ ID NO: 90029 - DNA, 1549 bp, Oryza sativa
gtttttgagtctaataaagtagtcgtgtctaaacatagatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccagtagaactcctacattcagatctttgtgaaataaatggggttttgacgaagggtggaaaacgatatttcatgacgttgattgatgatgctactagattttgctatgtgtacttgttgaaaacgaaagacgaggctctagaatattttaaaatttataaggcagaagttgaaaatcaactctagactattttaaaatttataaggcagaagttgaaaatcaacttaacagaaagataaaaaggcttaggactgatcgtggtagagagtttttctcaaatgagtttgacttattccgtgaggaacatggcatcatacataagaggacacctccctattctcacgagtctaatgggattgccgaaaggaagaaccgcacactgactgacttggtgagtgggactgtaacaccctgcctccaaaatccgcattagtccgctctacacgttgagcagacccacgttcgcatggtatcccgattacgctttcgtcctcgcttcatgtaaaagggttaacccggggataccatggttggagcaccaaggcttataagcaggccctcacccacctaaacttccaaggtggtactaaaccaccactacacatccacttctgggccacatgggccaaactcacactactgacaggcttcaaacaggctggggtgttacagggactacctaaggcatggtggggggaggcattgttgacctcgaatcatgtgctaaacagagttcctaacagaaataaggacaaaacaccatatgagatatctattgggagaaaaccatcactttcttatttgcgcacatgggggtgcttggcgaaagtcaatgtaccaataacgaagaagcgcaaacttggacctaagactgtagaccgtgtctttctgggatatgctcatcacaacattgcctatagatttttaatagttaaatctgaggtacctgacatgcatgttggtacaattatggagtctcgtgatgctaccttttttgagagcttcttcccaatgaaggatacacatagtagttctagccgaccttctaaaataatttatagttcaatctcaccaccagaacaaactgaacatacacatgaacatgtcactgaggaggatgacagtgaagctcctcgaaggagtaagagacaaaggacggctaagtcttttggtgatgatttcactgtgtacctcgtggactgacactcctatgtcaattttagaagcata

SEQ ID NO: 90030 - DNA, 655 bp, Oryza sativa
aagggagcaaggtgcaacggctgttcgatccacgtcgcggtcgcatccacgtaagtcgtgatgtcatatttgaagaaaatgttgtttggcagtggcttggagatgcaggcgagcaagtctccgttgaatttgatgttgaagaaatcgttgagccaccagccggctcggcgacatcgctgccaggcgcgataccgaggtaccaggcgccatcacccggcaaccgtcctggcaaggagccggtggtggtagaagaggaagcttcctctccggcaggcacgatggaggcgtcaccgtcactgccgaccactcctgctacgcctatcggtgaacagagtacaccgcactctgctggcgaaattgacaccgatggtgctcctgttcggtacaggcacattgccgatattatgagagatgcgcccagggtggacttggttgacgatgaacaagatggtgaggcattgcttgcagagatggaggagctgtcagcttaccatgaagcagccggtcacccggcgtgggaggacgccatggctatggagatggatgccattgagtgcaacgggacgtgggaactcaccacgttgccagctggccacagggcaattgggcttaagtgggtttataaactcaagaagaacactgcgggagaagtgat

SEQ ID NO: 90031 - DNA, 646 bp, Oryza sativa
aattcctgcagccccagctactcatcgacctgcttcttaacctctgctagctcgttggctgccattctgtacggtctcttgtaaattggagcggttcccagtgccaagtcaatccggaattcaatctctctcttgggtggcatggtagtgaggtcttcgggaaacacttctgggtactcgcagactatgggaatctcttccaatttcctcgaattcttctcctcggtgaccactgggatttccacctcaatctgattcaaagagaccccttgctttggtgagattggtgatttgtacactactgtttctcccttctcgttggtcaaggtgactgtgcgattcgcacagtcaatgactcccttgaacttggtcagccaatccatcccaagaatgacatctaggtctttggattccagaagaatgaggttggctagaaatggtgatctttggatttctattgttatagaagggctgaattgtaccgaagtggagctattccctggggtatgaacccgcattggtgtgctaagttcccctcttattaacccatgcatcccgacaaacttctttgaaatgaacgaatgcgttgcaccagaatcaaaaagtactgttgcagggattgagttaacaagaaacgtacccagta

SEQ ID NO: 90032 - DNA, 673 bp, Oryza sativa
aattcctgcagccccacggagaagtatgatggcagcatcaatccctccgagttcctctagatctacaccacgattatcgtggcggcagggggcgacgaccgggtcatggcgaattacttccccatggccctcaagggtcaggcgcgcggctgtttgatgacccagcctcccgactccatccactcctgggaggatctgtgccagcagttcgttacgaacttccagggcacatatccccgcccgggagaagaggcggacctgcacgctgtgcggcggaaggacgaggagtccctccgctcgtacatacagcgcttctgtcaggtctgcaacactattccatgcattccggcccacgcggtcgtgtatgcgtttcgaatggcgtgcggcataaccgcatgttagagaagctcgcctccaaggagcccaagaccaccgccgagctcttcaagttggcggacaaggtggctcggaaggaggaggcgtggggaactctccagacaccggtgcggcggccgcggctacccccgagtctgccccccgctctaagcggcgagataggagaggcaaaaggaaaccgggccgctccgatgacgagggccatgtccttgcggctgatgggcccgcacgggcaccgcgcaagggaaaggccaccagcgacaagccgagctccact

SEQ ID NO: 90033 - DNA, 690 bp, Oryza sativa
gaattcctgcagccctaaggaactcgaactccttaagtgtgtcttacccgataaatttgtggccgggtgcattattgcgaagctacctccatcttggagaggtttcggtactgcactcaaacacaagagacaggaatactccgttgaggggttgatagcgtctcttgatgttaaggagaaagctcgggaaaaagatgccgcgtctaagggcgatggtgggcagtccactgccaatgttgtgcacaaggcccagaacaagagcaaggggaaacacaaagctcaacagaccaccaacttcaagaagcagaagaagaacaacaacaatcctaatctggatgagaggacttgctttgtgtgtggccaacctggtcatctagccaggaagtgtctacaacgcaaggggatgaaggcacctgcagggcagacttctaagtctgctaatgtgagcattggcaacactggagatggaagcgggtatggtaatttacctactgttttttcagttaatcagtctactaattggtgggttgatactagggccaatgtacatatttgtgctgacatctcattgttttcttcttatcaagtcgcacggggttccaccgtcctaatggggaacgggtcacatgcttctgttcatggtgttagcatggtagatctgaagtttacttcgggaaagatcgtgcagct

SEQ ID NO: 90034 - DNA, 1026 bp, Oryza sativa
cataatgatttgaccattattggacaccacactaaatgttccacccaatgctaagtttatctagagactttggaaaggtacagagaggtacaaagctaatcttgtacctttcagtacctccaaagaacagaaacaacactcttaaaatctatgctcttccaacatcttcaaacttgatgctcctcctagaggcctagaagctaagatctaggtccatggtggatgactgacccaaggtgaggcggaccatgtcctcgtgctcaggcatcacgtactcacagagaacaccagaagcagatgagctagatatggcaggaggcagtgaaagctgatctatgaggatatcccgcattggcatcatgttcagcgttgatggtacggcagtgctagtgatacattccggagaagcagatgagtttaacatggttggatgtagcatgtgctgctccatgtggatagccggcatctgcatgaggttcaccattgatgtggtggcactagtgataccggtcagagacggcaccgttccaacatgctggccacctgcagctgacggaatgtggatgcttggtatctcggatgaccaaatgagatcagccatttcctgcttgggcatatattgcatggtgacagcaaaatgatgtgggtctgagcacaccgctgctatccgagaagcatctcttgctggtggaaacaatgacagtaatggtggtggtcccatgggttctgggtagctaaatccaggaggagggaggaaccccgggatttccgatgacctgagggcaaacaccagcccacaatagatgcatgaaaggggattcccgttaccatggaccgccacaggtgaaacaacgccgtggagcctctggatatctggagtttccctcatgaaatgcatgatatcatggttgatgatcctgtggttggtaaccggttccacggtagctggcatagtgttctccatggcgagcatctgggtggtcggcggtgccggcgccggtgccggtgctatcgtagggattacaa

SEQ ID NO: 90035 - DNA, 1250 bp, Oryza sativa
acttgatccacgagcgtaggtcgtgcctctagagtggctatgaatccatgttcaacgactcccacattgagacgtttcaagctcctgctgcaattcctcggtgcatagggcattgcagtagcttttcctgcttaatgcatctaccaccacattggcttttcccggatggtaatgaatgctcatgtcataatctttgattagctccaaccatcttcgctgtcggagatttagatccagttgggtaaatatgtatttcagactcttgtggtccgtatacacttcacagcggttgccaatcagatagttcctctagatcttcaaagcatgaaccactactgccaattccaggtcatgagttggataattcccttcatgtggacgcaactgccacgaggcatatgcgaccactctgccctcttgcattagaacacatctaagcccgtggtgggatgcgtcgcaatagacttggaagtctttcatctggtcgggcagaatcagaactggggtggatactaatttcttcttgagctcctcaaaactcttgtcacactcagctgtccatttaatcttctcatctttcttaagcaactgagtcatgggtcgggcgatcctggagaagttttcgatgaatcggcggtaataacccacaagtccaagaaaactacgaatttgcgacacggtcttaggtggggtccacttggtaactgactccacattcgatggatcaactgccacaccttgagctgcaataacgtgacctagaaatttgacttcagacaaccagaagtcacacttgctgaacttggcgtataactggtgctccttcaacttctcgagtaacagacggagatgtagctcatgttcttcttcgaactttgaatagataagtatgtcgtcgatgaacaccacaacaaacttgtcgagaaattccatgaacacattgttcatcagattcatgaagaatgcaggtgcgttggtaagtccgaaagacataaccgtgcactcatatagcccgtaccgagtggtgaaggctgtctttggaatatcctcttcccgaattctcaactggtggtagcctgatagtaggtctatcttagaaaacactttagctcctttcagttgatcaaacaaatcatcgatccgcggtaaaggatatttgttcttgattgtgacctcgttgagtgcgcgatagtcgatgcacatcctcttcgtcttatcctttttctccacaaaaatgaccggtgcaccct

SEQ ID NO: 90036 - DNA, 1428 bp, Oryza sativa
cgatgcacatccggagcttgccgttggcctgggggacgaccaccgggttcgccagccactccggatggataacctcgcagatgaagtcagcctccaagagccgcaccacttcctctcggatgaaggcctgtcgctctggggcttgatgtcgcactttttgccggatgggtcgcgcatccggccgcacggcgaggcagtgctcgatcacctccctggggaccccgggcatgtccgatggcttccatgtgaagacgttagaatttgcccgcaggaaggagacgagtgcgctttcctatttggcgtccagggttccaccaattttggcggtcttggacggatcatcgccaagggggatctccttgacgggcacctcattagccgaggtgaggcgcttcttggaggcacgggacgcggtggcctccggggcctgcggctccgtggccactgccaggttgtcggcgcgttgctccgcgcaggcgagggcgactttgacatcgccaaagacggtgatgggaacagcagggcctggcatcttcatctggaggtaggcgtagtggttggtggccatgaacttcactaacgtaggtctgcccaggaccgcgttgtagggcagattgaggtccgccacatcgaagtcgattcgctcggtgcggaagttggtggagtcaccgaatgttaccgggagctcgacgtgtgtctcggagtcacgccaatgatcagcagcgacgactggagcttcatccccggggccttgagcgcatcgaaggcggctggggagatgatgctcaggctggcccccccgtcaaccaggacacgcttcatcctgacgttgtgaatggtcggggagtgtcacgcccagaaattcccgaatagaattcccaagcagaatgtgcattaaaacccccatccaggaccggccgggctacacaaacgacaatgttgacatacagatccacgtcttacaaacattataaaagtcttacataaatgtagcggaaaaacaaaagataactggagctaagccttgacttgatctgcagcgggaacaccactccacaggtatcctcgacggcacggacgaagcctactcctcggagaaaccaccatcggacacatactcatactctagggttggggaaaatagagcaagactgagtactacccactgtactcagcaagtcataccggaataggggtatgatgcagggatttatcaatggatagctataaaggttcatttgcataacactggcatttataaacagaggtagaatgcgaaaatagttgtaataattaatcaatattaacctaccccccttaaacggaatctcgaccccgagattcggaggagctggcgaagaggtgcggatgggcggccttcaactcatcttccctttcccaggttgcttcctcctcagaatggtggct

SEQ ID NO: 90037 - DNA, 690 bp, Oryza sativa
cggtaacaaaagcttgacaatggaactgaccattctttacctgtggactatcatatattgccttggcaagggtagtcttgcccaatcctccaaagccaaaaattgatattacccttagttcttgatcactgtccactcttagatatgttaggaccctgtccctccgattgttgattcccacaagtagatcatcctgtataaaaccaataacttgcctagggtcaagggacaaacaggttgagattgaagtggtggtattcttcgagtcagaggcatcaacaatagcattagcaccgctatatctcgcatacctgtcactaacatctcgagcacgaaccttaagctcttgcacttgcatgacaattcgatggcggaccttcagagtgtacataagatgcttcatcctatatataaaccctacaataccattaccacaatagccaccaaagtggtgttggaactcatcaatgcagtcctcagcgtcataagccatctctctgacttgcttcatccagatcttcacttggacactgtggctgcttgtggctgcaaggttctggaggaatgcgttcatgctctcaagttcatccttgatgtattgcaactcacctctgaccccaccaagaagtcggggctcttgcgaaagaaaagagcccagtttacccagcagtgttttcacagcaccctcag

SEQ ID NO: 90038 - DNA, 822 bp, Oryza sativa
ttcctgcagccctgtatcttggcaggcttgtatgaacatatgcaggagtgattgtaactgtaaaggttttcagtacctaaaaggggaagggacatgctttccaaaatcattccttttcaatggaagggcatacccatcacactttgtgtcaccacgcaatatgtatcttaagatccctataagcatgaatatttcaggtatgccagtatcccaatccaatgtgcttgattcaagaaaacatagccttaattgtgatcagatggatgaaaaaactagggaactatttcccgatgtgcacaagacaagtcagggagaaacaagatggttttacttgtatgggtttgcgggtgcgatttttattcttgaagttttctttattggatttgcatggttctttgtttcaagatgggatctggatgcattagaaatacaagcagtcgagcaaggttacaaggtgatggcaagtaatttcagaagatataattataaagagttggctaaggcaactagaaagtttaaatgtgagcttggaagaggaggctcaggtattgtctacaagggaaccttggatgatggtcgagtagttgctgttaagatgctggaaaatgtaaggcaatgtgaggaagaattccaagctgagttgcgcataattgggaaaattaaccatatgaatctggtaaggatatggggattttgctcagagaactcacacagggaatggcttggggggggttttttaccgagtatatcgagaatgggtcattagctaacatactgtttaatgaaaacattttgctagagtggagacagcgatttaatatt

SEQ ID NO: 90039 - DNA, 2232 bp, Oryza sativa
agcctatctccaccatgagtgtctagagtgggtcatccattgtgacgtgaagccagagaatatcctgttggacggaaattttgagcctaagatcgcggactttgggttggcgaagctcctaaacagaggcgggtccaatcaaaacgtgtctcgagtgcgagggaccataggttacattgctccagagtggatcagcagcctgcaaattactgcaaaagttgatgtgtatagctatggagttgtgctgcttgagctggtgtcaggaaagcgagttctggatttggctacaagtgctaatgaggaggtgcatgtagtgctcaggaggcttgtaaagatgtttgccaataacttgagtggaaatgaaccatcttggattgcggagtttgtggattgcaggctaagtggccagttcaactacacgcaagtaagaacaatgatcacactggctgtcgcgtgcttggatgaagaacgaagcaaaaggccaacaatggaatctatagtgcagctgctccttttggttgatgaatcttgtagcagtaatgttctatgtcctgagatgccaacaaggtggacaactggacacgccaaggcaaatgcaagtttttgtattcatagtttgtagttctatctcattgtatggaaattcggaaactcttgtacttcaaactctaggcattcatttattcagatgtgctgcatattccttcacaaattataataaagtatgctattcaagaatatctgttgtgatgtacgcattgtctagtatatttaccatctttttgcctcatgagttccagcaaagtcataggttcacagatagtgctgaaatggggctcctctcctatctttacaatacagcagttgcaattcaatcatggaaaaatcacagaatgaatattattggataccaacaggtattaaaggactttctagttgatgatattgctcagtttgagaatggaaaatatgtttgattgacattgttattaggtcgacttcgactaagtactactatattaattagctaaatatataaacttgacttcgactaagtactactatattaatttgctaaatatataaacttgttagtatttgatactagtttgatgcttacctgtgcataatggattttgtttagttacagtatgccggtgacaattttgaatatccatacatgtgactcgttgacctagcggcgttctccaggcgtttctttataaggtaaggtgtgctcgtgttcagctccatacaagtctacgggaaaaaatggccttttttttttcaagaaatgagatagcgtggcttcacaaaagagaaagcgaattaacatcaagaacaggaagcgaattaacatcaagaagaggaggcgaattagcatcaagtgcacttggcgaggagcatcctgtaagtacatacactctttacaagctactgagtcctctaatcctctgagagtgtctcacggtctcacggcgtcgtcggctgcaccacctccttcttcccagccggctcctgcacaggcacagcaggagcaggagcagggtcgaccggcacacccgagcgcgagcgccgccgctgacaccagcgccatccggaatccattctaatccttccatttcaaaggtaatgctccgccgcccgccgggtgtttgtcagattgtcacgcttattcagttgttctgagcctgagcattgagcacatcaggtttagcctgtcttggatggcgatacaagtggcggtttcttgtattaatcaccaacgccccccaagaaagatttggagtcgattatcttcattcctagctcatcttttttcttttatttatttattaattattttgtggggatcctagctcaggttcttgatttggccacatgcttgccaggatccaggataggacactggcgctggtgataggctgatagctattttctgcacattttataaatgttgatgtttcttcaaacattagatatgtgctgaaatgatcaatggatgctgcaaaatgaaatggtgatctgattctagttagcttgcatagttcaaattgacctttttttctaaaatttattgtggtgtaggattttctttaaagttttatatggttcagttcagcattctaatggtatttgcacgaatcgaatatatgcagtatgttgatcttgttacatagcttgaaaaaagtatcatatgcaaggagttacactactacatccatgaaaatg

SEQ ID NO: 90040 - DNA, 1390 bp, Oryza sativa
ttcagaaagcgtcttgaagaaatgcggtggtatgcctgtagctatcaatagtatagctgggcttttggcttgtaggcctgttaagagcttagaagaaatgcagaacttacaaaactctcttggatctgagatggattctttctcaaccatggagaaaataaagcagatactactattaagttacaatgatttaccctaccatttgaagacatgcttcttgtattttagtatcttcccagaggactacaagattaaaaggaaaaatgttgtccggcaatgggtggcagagggatttgtatcagacaagcggggacaatctgcggagcaagttgctgagagctattttgcagagtttatcaataggagtatagtccaacctttagatataagtgacagcggaaaggttaagacttgcaggatccatgatataatgttggaggtcattgtagagatgtctgttgaacaaaattttatttcacttatgggggatcaacatacaatgatttcctatgacaaggttcgacgtctttccttacatggccatggtgcatataatctatcaactagcttggaattatcacatatccgatccctaagctcctttggggatatgccaagagctttgcgctttgaccgtgcaagattgctcagagtgttagatctagaaagctgtgaatttctgaggaatcgtcaacatcatcatatttgtgcattgttccatctaaagtacctcagtctaagaagagctcacaacatagataggctcccaagaaaaataaagaaattgcagagcttggaaactctagatttaaggggtaaaggtatagataagttacctgctagtttcattgaactggagaatttggtccatttccgttcaggttctacctacttgccgcatggctttgggagaatgaaaagcatactaacattgggattgatagagatctcagatgacacatcttggaggatacaagaaattggctgcttgatgcaactggagaagctctgcatatggtcacgcgatggcatgaacaaggagaactgggagtccctactcaccgtcattgagaacttaagcaggcgcctcctgtcactctcaattgaaacggacaggagaacttgttctttgccacttgatttctcatcctccccacctcttctcctgcgaagcctcctgttatatggaagtttggaagcattgccaagttggatggcatcgctggataaccttgtgaaattaactcttggtggtactaaattagaggaggatgatatacagattctccagaagctcccacgattgttttctcttagactgtggtttgcatttgccgtagagaagtttgttgttgcgccctgagggtttcccaatcttcagttacttgcg

SEQ ID NO: 90041 - DNA, 882 bp, Oryza sativa
attcctgcagccccttgaggatctttcatgatctcctgaaaatatcaacacgagtcgtcacaaatgcacactagaaaatttttcatcattgaacattttcgacaagaacattataaaaaacggataagcgaaaaaatcatccgagtttaaatttatttatttaccatgaggatcggacagatgaaaggagcagggatacaaacttctggtgatgccggtggaaagtacgggcaagaagagggcttcctcatcagtggcctgacgactctccacacatcgttcaagagatcgggccgtttctcccttgccatttcagcgcatctaacaccaaggacagccagctgtttggcctccttgtaaggccagtctccagcagatttatcgatcagcctgtgcaggttatcactctccaattccgctgcaactttcttggacagattcaacggtgccatcccggtcaatagccgtaggatgatcacaccaaatgaatacacatcggagagtgttgtgagctccccggtggtgatgaactcagggtccatgtacgacagcctctccatcaggttgggtgggcaggtcccgggctgcaagaacaggctcgataggccgacgttgcagagcctgcttctgtagctggcgtcgtcgtcgatgaggatgttgcaaggcctgagatcgccatggatcaaagcagcagtaggaggattcttgttgttcgagtggaggaagagcagcgcgcagcagatctccccgatgatctgcgtgcggttttgccatggtagaggtgttgaattgttcgcgcaaacgatgtggtcctcgaggtttcttccgtttggtaaccattcgtacactagggcggagattttcgagcatactccgataaat

SEQ ID NO: 90042 - DNA, 1855 bp, Oryza sativa
ggcgcgttggcagcaggcgtccgcacaacagtcccaggcactgacgcattgggggaggttggccggcgatggtgaagctactcttcttctgttgcggcgcggcggccgccgccgtgccgggccactttgcgagcacgcagcgacggcgcgttagcagcaggcgtctgcacgatagtcccaggcaccgacgcattgggggaggttgtccggtgatggcgaagctgctcttcttctgttgcggcgcggcggccgccgccttgccgggccactttgcgagcacgcggcggcagccttcgacgccgcgtacgacgacgtcgtgggcgcgtaacgtgggttcatgcggtcgcggacgcgtgtgttcctcgtcatccaccgcgccccgctcgagccgcgcgtccgctgcccctactgcggcgcccgcgtctggagcatgaccaccgccgggctcgcccgcctctcctcctcttcctccagcgacggcgagcgaagcaccgactctgactccaaccacagcgacgacgagacattcgccaccgccgatgtgagcctcccacttcctctggctggccgcgtgtcaggccggcgccttcgagacagaccgcccatgtgacgcatcaagcattagcggtagttttttttgttttaccggtggattgggatagtattatttggagtgagggcaatttagtcattcttgtaaaatattttgttctaacagtgtggactaatagtgtgatggcatttctgagagaaatagccttgtatgatggcattttcaggaagttgcgcttgtcgatggtatttttgggattaaggtggttatcgatagcattttatagattttctcaaagaagaaaccttctctactccctctgtctcctcacatctctactccttgctctgtagccaccacatcttggatgaatccgtcgtccctataattgctcgccgccatcgttcctgttcgccgcccgttgtccttccaatatggagatatttaactatttgccacttttagatttggcatttaactatttgccacccatatgtctatgacacgtgggtctacatgtatctatgacatgtggatccagtggcaaatagttaattgccacatctaaaagtggcaaacagtagaatgccctgagagagatggggaagagagtggagaaagggagggagaggaggaaaaagactggactgttgacatgtggggcccacgtgggttcctcactgatttagctgggttgagcacaatcgacttgccacttcagctgaaatatgatgcaatactgccatagagcttaggtactctggggttataagttaatgggtatggtattgtgatgtaaggaagaatatgatttaaactcctgtacctaaaagttaacttattgagaaacctttagaactcatatgagacggaaaatgtactcctctacattttggcacgtttggcatagctccagctcggcgcgggccagcccagcttgcccgcaaggccgccccgcaaaaaatcccgcaaggccgccccgcgagaaggccgcatagctagatgggctggattgacccgcgtccgcgtggccgccagtagcccactaactccgcgtccgtatgttcccaaccctagttcggcgtttccacatgcgagatcgagcctggagcggctcgccatctctgccgccggtccgccgcctcgctcgctcgctcgccgtccgccgcctcgctcgctcgctcgccgtccgccgccgccgccttgctcagttgctcgtcgtcctccgccgccgcggcgccagcacgcctcgtccttcccctctctcggctcaggtgagttcttgcctcttcattttttttt

SEQ ID NO: 90043 - DNA, 615 bp, Oryza sativa
attcctgcagccttatttctcaaaatgctctcatcatggagagatcacaagttcctggtcatatgtccccaagtgcagagtctccaagagctagatctctgtctccagtggcaaggttcgtatcaagtccgtctactatccttgagctggatgttgaaaatcagccaagggaatcaagtcaaccaacacctcatgttgtgactcatcgttctggttagcacctaatacatttgttctaaaggactggaaatttgatcctgatgtagcacgtgcagaacttttaaggatgattgttttgcaagaacttccttccagctttgttgaacaccttggttttagaagattttgtgcaagcttgaacccgtactttagggtggtttctagaactactataaagggtgattgcttggctgcctatcaagaacaaaagttagctttgcttgaggtactgaggaaaacaaattctcgggtttcactgacggctgacatgtggtcatctaatcaaaacctaggttacatgtgcataacttgtcacttcattgacaatgaatggaatatgcaaaagaggatcataagattcactcaagtgcgtaccccacatgatagtatagctct

SEQ ID NO: 90044 - DNA, 1556 bp, Oryza sativa
gttatttttgttttcatctcctttactcttccgtctggatcggcttgctttgttgtgttctcaggagagaagagcagtttgccttagtcgtttccatgctgagcagacctcgagagtgcgcttgctgaccaagatcgtcgcatccaatattggaggacgaacgttgaggtagcggaacttgagaggactatgctggaagtgaagaaggaccaggccgtggaaacactccgaggtcgcgaggtgtggttcaactcgtacctgaagagttgctgcacgtccatgacaagagtctgtagagagctccgagtaccccatggggatctcgaggaatcggcggccggatacatctcgtggctgaacagtgcctgcgccaagctcgaaggcatcggcaagcgtatcgacgaggccctgaagcaggagtgccgtcaatcgagccgatatgccggggggcatgtattggcttgcatacgagatcatcgtctgcagctgcacctcgagttcctccacgaagggttttctcgttctcggagaaatcctacggagatagatcacttggcgaagtcgatggtgccgctggcggagaaggtcttccagtccatggaatggtgttggcctccctggtagtctccgtatcttgtgacaaatgtcttagggaaaagtgtaatataattttggatttttacggaattgtaagaagtactttgtgaaatagaaaagaaatctatctaactaagctttcttactctatacgtagtgtgtaagagtgtcttctcacttcgcgacttcgatcagtcgtttgagttatacactctcgctagcccccagccttgtcatcggagaattcttcttggaagataaggctcttggacctttgacctgccttggttgaacaagccctgatcctagcccccagccatgaagtttgaaaattaatttccgattacacggcttggttaatacgcacggcgagaactcttacacgaccagatcttacatggtctttcgtctctacaggatccgacaaggccttatccgctctgggcgtccccagccgatgttcccttaggttccttggaggccttgtcaagacggcgtaaagggacatgaggataggttttaacgctaggtgtcatctgggtaagggatcatcaggaaggaacacttttattgtaatctgtacctgaaaataggctttattggagctgtaagatgtcttacaagtatggatactattgacatatacatagaatttacgtaattgatcaatgttccaggaatttgccaactcgcccccatagccgtttgcaatcttgaatgcgcctggccgcaagacttgtgtgatcgtgtacagtccttcccatttgggtgagagcttgtttcgccctgcttggctttgaacccgtcggaggacgtagtcgccgatcgaaagcgtgcgtgctcggatgcgcttctcgtggtaagggcgaagggcctgttggtagctggttgctcgaacggcaactcgttcgtgatgttcctcgagtagattcacatcgtcgtttcggggctgcaggaat

SEQ ID NO: 90045 - DNA, 2273 bp, Oryza sativa
attcctgcagccctgggcgtgtgctcgaccatgtcgaggctccgcttgtcgcattgtattgccagcttaacattcccttgaatagtgattattcccttcggtcctggcatcttgagcacttgatacgcgtagtgagatgcggccatgaacctcgcgagtgcagttctcccaatgatggcattgtatgttgtatcgaattcagcgacatcaaaggtgatctgctccgttcggaagttatttgcttggctgaatgtcacacgcaacgtaattttgcccaatggtttggacgatgactgaggagtgattccatggaagggttgaccggtgggtgtcaactcgcttcgtgggatccccatcgcgtccaaggtgctggcgaagagaaggttgattgagctgtcgccatcgatcagaactcgcgcgaacttgatattccgaatagttggttcgaccacgatcggatatcgctctgggatgacagcggtcttggggcggtcctcttctgagaattctatcttctgttcagactacttcatcttgggcgcagctccctgtcatgttgaacaaacttcacattccactttcttgtattctcgctttgaggagtatgccgtggaacctccgaagatgtgcgagacatggagatcggagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtctgtccgacttgtgtatagggcaccatgttttcttcgtgtcgctgccttgtgggtctaggcgcttgggagggtccgcgtattctgttgcgagaacttccgcttgagctttccttttcctactcttgcgatttttcttcttgcttgactcaggtgcgtccttggctggtttcttctctcctccggtcttcggtttgtcgttcttgcgtctcagtgcgtcgtccgcatgagcacatcaatcgacaattttgaataatctccgagtagtcatgacgcacctcgttgccaactcctgggtagtatagcgatctctgaaaccggacttgaacgtgcggattacagaagcgtcggtgatttcggggattgtatttctgcactcatcaaagcgtcgaacataatccctcaaggattcacccgagttctgtgtcaacgcatgtaggtcgtcttcgatcgtgtggcgcttgtaagttccctggaagttggcgacgaactgctgccacaggtttgcccacgaagaaaccaagtagggtgggagatgcatcagccatgaacgtgcagagcctttcaatgcagttggcaaataatttgccaacgcgttgttgtccgcttgggcagcgtagagtaccgtggagtaaacctgaaggaattcttctgggtcggtactcccatcgtacttctctattgctctaggtcggaatctctcaggccatcggacatcacgcagcgaacgactgaaagctctacacccagcgctgggggcggtgggttgtcagcgatcgtacgtccttcgtggatgtctatctgatgatgaggatgaggaagatgacgacgatgacgatgggtcacttggttccgctgtacgattacgagggtgtcggccgggttctcgagaatcctatcgtcgtctcccgttgttgtcccgacgccgatctccatcgtcgtcgtcattatggcgacgtcctcgaccagtatcgcccagcacccgccgttcgcgatcgtcgtgatcgtggcggttgtggcggttatcacggtctcggtcttcgctcgaacggcctcctcgttcttcgttatcgtgacgtcgtgaagagacgcgatgtcgggaacagttctcgctgtctcgtgcgcgtcacgcctctcggcggccattcaagtgatcgcggagatcgccggtgccgcgaggtgaaggggtggctcgatgaggcgattcccgctgttcagggttttcgccattagcaccgccagttggtggctgttccgggtgcgctacagcagcggcctctttgaacgcgttgctgaggttggtcactgattcccgtagccgttctgtccaccgtgcgagatcgtcgttcagaacgggatcgtagggggtttccctcagtattgcgttgacggccctgatgtgctgggccggtgtagtcacttgattttccgcttccgcattaacgcgcactgacgtgctggtcccgtcaatagccaatacctcgcgtggcgt

SEQ ID NO: 90046 - DNA, 1099 bp, Oryza sativa
attcctgcagccctttctctcatgatcaactctacgttgcactctctaggggtgtctcgagggggacaaccagaattttggccaagccaaggatagacattgaccccactggaaaaagcacaaagaacattgtatatcgagatgttttattctgaacaggtatgagattctttatattcatgtcaacatgactttctactttcctgaaattgaaggttcactcatctaatgatttaattgtgcacctgtcacttgctattaatgttttaaaacttgctcctgtcacttaatggtatttcaattaattttgccaaatattacattttgattgagtaattaatattatatctgcagattgtctaaggttgattagagaataccatgttcagattcttctgaaggcccagttctttatattattcattggactattgagcttggttgtttctggaggaccaggttgcatggatggtgagtatcatattgtttacaccaagtgttcattgatatggaggaaaacctgatgtactgatgcacaagagtatttcaaataatcttgccaaatattattttctgattgagtacttaatattatttgtacaggtagaatgtggttgcattgagagtaccatgttcagattcttctgctggccctgttctttatttttttttttcactggactattgaacctggttgtttctggaggactacggagcatggctggagtatcatattgtttacaccaagtgttcgatgatatctggaggatcatattgtttacaccaaatgttcgatgatatctggaggataacctgatgtggattatgagcttggctttgtcttgacaaataatagatgagttgctgcttgtaagagaggtctcgatgatctgctaattgccactgtttagttacatggggtgaaataattttgtgcaaacatgactgatgtatatgaaaatacgtctctgattgggatcttgtaaacttatttgatttgggaaggactgcaacacttgaaatttttattggaaggacaattcagaaacataattgggaacatttgctatattattttatgatcttatcgggctgcagg

SEQ ID NO: 90047 - DNA, 910 bp, Oryza sativa
attcctgcagccccattccgtattccttgtcgagatccaccaaccgttctcgagtgatcgagaaggcgcagaatctgcgacggagctttgtcgacatttgtcgtactcgccttagtcgatcttggtatagaaccatagagacatggagccttcgtcaatgtcgaatagaatccatgtgtcccagcaaatcttttggaaatgaaagaatgcgaggcacctgaatcaaagagaactgttgctggatatgagttcactggaaacgtgcccaacacaacctttggtgctacctgtgcttcctctgcagacacatgattggcgcgggcctggatgaacctgggtccagtgcgattcagcttcggacacttgctagcaaagtggtcgtgcttgccacagttgaagcagggtcctggctttcctacagcccccttcttgggctgttctgactgagctgacacagctggcgaatctgactgagctggtgccattagtgggggtggagtcgagttgtggttgtgctgcttactgttgttgtgactgccaccgttgtaatcgttgttgaagttactcgggtgatagggacggtgctgacagacgatcagggtggaaggcccacctagctgtcccgtcatgaagcgaggcttctgtttgttcccctgaggaaagctgatctgagctgcctttctttttcggtccattttgttgcgttgctcttcctggcggatagccttgtccacaagcttctcaaagtcctcatagactctggagattagctggttggtcaattcatcatcgagcccaaacaaaaacttctcctgcttctcagcatcggtgcgcacgtccttaggagcgtagcgcgcgaggcggttgaactcgtgcaggtactctgtaaccgttctggggctgcaggaat

SEQ ID NO: 90048 - DNA, 678 bp, Oryza sativa
tgaacaccccttcaccccagcagcatttgacggcacaacaacataggcaaaaactgatgcaaacatctcagcaacagcagctacatgctcaacagcaactaagaccatcggctgctgggatgctagcacaggtaaggtaatttttatttcggaggcttttttgttgtctgggttacggtttatcatctcagttgtcacagcacccaaaggttatgtagctattaaaagcacatttcttttcattttctatgctgctgtcttaaaattattccatttcatttacttcaaagcattgttccttccttttctagtgcttgattctccatacttttcctgtagagcgcaattcctcagctacaagatctgcagggccaatcccaacaaaaattacaggtaattctaccactgattgtttcccttttctatgtattctacttgctgaaacagtaacaatttcttacaaaccttttaacttgttgtaaaaccttataggtccctggccaacagcagatgcagtacaatcaagccttgtcacaacagtatcagaataggcagatgcaagctgggcgcatgcaacctggcatgtcccagagtcaactgaaccaaggaaatcagctaagaagtcatattagccagttcactggagctgcaaacagtgcaatgtttactgctgcacag

SEQ ID NO: 90049 - DNA, 1197 bp, Oryza sativa
ttgtcaccacaccaagttgctacactagcgctgttctcttcttttgtgtacaagtgggatttctactttcttcgcacgtgcggtgcgaaaccccattactccgtttcttcgtaccacatgaattcgtagtctttaaaactccaatgtccaagtgtagaggtaaagcggttggactaatcgatcgtcgcttgctagcaacagagcatatccaaccagaatcgaccagtcgtcgacacgtgtgaatgcacgaggttgctatggctttacgtatatcactttattttacattagttctgatattaagtttgcactataaacaatatatactagcaagttttaacttagctcagtttggattacgattggatgagaagtgaatgtactttgggaaattgaaaggcgaagggttgtgattgtttagagagagaatttcagtggagaagttattatatttcgcgataaattcctaagtctaaaaattgttatattttggaacaaaagaaataagttatattacccaatctacttgcactcattgatatcacacgactaatactacaggcttataacatatcatggcattctctggcgctcagctcctttcatatggattaaagcaaataccaaacacttgtaaaatttttctttggcttgcctttcgaggaagactgaacacaaatgatagtagggtaaagaaatgctgggcatctgatccacattgtgctatctgccctaccattgaaacaacatatcatatcatattgcgctgccggctagcttctgaggtttggaagaaactcaacatctctgaacaggcaactcaaagcacagacgttcttcacttcgttgagcaagtcctgacaattacgcccccgcatctcaaacctggatggccaatatgctttggcgcctgcgcacacaacttatgaaaagcatgcaaccatagaacattccagcagcaagatcttaccacggcaaatgtgacacatcaaatcagagaatatctatacttatggggaaatcgcatcaagccacaatgtcggcctccaatatgcagatggatagacttactagcgtagctagcttttctacttcttccatgcttcttcctattcttctgtatttcttcttcttcttccttcttattttctcttcttcttctcttcctccctctccgtctggagtatacatgtacga

SEQ ID NO: 90050 - DNA, 1970 bp, Oryza sativa
tgccagcaaacgttcccagcacatctggacacttctggccatgtaatacttatacaatattaagtcatgaattcaaatttaaaaggtttaagaaccaagtgttatgatcaaagttgtggagaatcccggatcctaaggtttttatgttctaaggtttcacacaacagagcatatcttaaagacttgaacactaatattgtttataaataatgaagagttaaattagtaatctccatataaaaataaataattcaaaaactttataggcactatgcacgaaaaagtatgtatgcgcagacatgtaatcagtatatacttatattctctggaatttaaacaggagtgtactttatcaaaccttaggaccataatggttatgtgcgctacaagttataataccaaaggatttctgcactttggctattaaatatggggttaactaaaatctactctaaattttaaagttgaaactataatgcctggttaccagtcaaaaattctattttttttgtttgaacatttgtctaacaaattttcccctgatttgctcaacattccatttgttcttcacagtttcctacctaactgagaatctgagatcacaacagccctcatgttgttactttcaaaaggaaaattctcatttaagaaattaggtaccaaacagctgttgttggtaagcagggtcaggaatccggctgctgctgctgctgaagatactcatggatggaagaaaagaggacaagattagggatgagagtgagattgggaaggaccaagtttgtcatcggagacctaatatattccctctatcaaaccagcttcttatggcttctgcttcataggtgaatccatcagatgccatttgaggatctttcatgatctcctgaaatatcaacaagagagtaacatatcacacatgcaccattaaaattttgatcactgaacatttcaaggaaaacagaaaaggatattcacaagttgtaggcactacatggaaaagaccttgggagcatatatccagaattgaagctacaaaaatgatgattacagatttatttaccaggctgattggacaaatgaaagcagaagggacacaactatctcctgttgctgattgcaagtatggccaggtggctgcaagaggcttcctcgtcaggggctcaacaactttccacactttggttaagagatcaggccgtttcttcctcgtcatttcagtgcagctaaggccaatgagtgctaactgtttggcttgaatgtacggccagtcccctgcagatttatctatcagcaagtgcaagctatcactctccaatgcctctgcaactttctctgatagagttaaggggggcatttcggtcaagagccgtaggatgataacacccagtgagtagacatcagagagtgttgtgagctctccggtggtgttgaactcagggtccatgtacggcagccttgccgtcaggtttggtgggaaggtcccaagctgcagaaacaggttggacataccaaagttgcagatcttgcttctgtagttggcatcaatgaggatgttgcaaggcctgagatcaccatggaccaaagcagtagacttgttcgaatgaaggaaaagcagagcacaacaaatctccccaatgatctgtgtgcggttgtaccaagagagaggtgcagaattatttgtgcaaataatgcggtcttcaagatttccattaggtagccattcatatactagagcggagacctccgagcatactcctatgaatgtgataatatttggatgtctccattggcgaagaatagagacctgcaataatctcatattactaatggaatcaaccaacacagagtatcacaagtggaccaggttacctcttgttgaaataacttttgggaactggacagcttgattaacaccttcatattgtgtatcatgcctttatatgtgtgcccatattcagtatcaccaa

SEQ ID NO: 90051 - DNA, 654 bp, Oryza sativa
taacgacagccctcttgctgttacttacaaaagaaaaaatacactccagaaactaggtttctgacaactgctgttggtaagcagggttcggctgctgctgctgaagatacccatggatgaaagaacggaggacacgattagggacgagattgagattgggaagggccaaattcgtcatcggagacctactaatccctctatcaaaccagcaccttatggcctccgcttcataggtgaatccatcagatgccacttgcggatctttcatgatctcctgaaatattagcaggagagaaacatatcacatatgcactgtaaaagttttggtttctgaagatttcaagaaaaaatagaaaaaggatattcagcagttaaaggagaattaggagcatttatccagaattgaagctgcaaaaataatgattacagatttatttaccatgctaattggacaaataaaagcagcaggtacactgctatctcctgatgctgattgcaagtatggccaggtggctgcaggaggcttcctcgtgaggggctcaataactatccacacctcgtttaagagatcaagccgtttcttcctcgtcattccagtgcagctaaggccaatgagtgctaattgtttggcttcaatgtaaggccagtcccctg

SEQ ID NO: 90052 - DNA, 674 bp, Oryza sativa
agcccttgcgacagatcttcagtgagtttagtggtggtaccaagcctgccgaagaaggggagggcttgtatacagggactggagatgtcaaataccatctaggaacttcatacgataggcctaccagaggtggaaagcatatccatctgtctctggttgcaaacccaagtcatttggaagcagtcgatcctgttgttgctgggaagaccagagcaaaacagtactattctaatgatcttgacaggaccaagaatttaggagtcttgttgcatggtgatggaagcttctcagggcagggtgtagtgtatgaaaccctgcatctcagtgctcttccaaactacactactggtgggacaattcacattgtggtcaataatcaggttgctttcactactgatccaagggcagggaggtcttcgcagtattgcacagatgttgctaaagcattggatgctccaattttccatgtgaatggtgatgacttggaggcagtggttcatgtctgtgagcttgctgcggagtggcggcaaacatttcattctgatgttgtggtggatattgtatgctaccgccggtttgggcataacgagattgatgagccttccttcacccagcctaaaatgtacaaggtatacattttttttcttacctgattaagtcgggctgcaggaatt

SEQ ID NO: 90053 - DNA, 953 bp, Oryza sativa
caagacaacggcggcggcggcggccttctccgggaatccatagggcgggggcctggggccgccgccagggagcagcacggaagcgggaggcagcggcttctcgacggccggggcgggcttggtccagccggccgtgggcgccccggatcggacgggcgcggaggcggccccgccgcccgcggccgcggcggcgccatcgaaccgctcgtgctccttgcggagcgaggggaggttcagcggcggcgggacggagagcttgggcggctggggcttggacacggaggagccacgggagcgggagagcacgaccatgccgccacccccacccccgccgccgccgccaccggatgaggcggaggggcgcgaggggcgggctccatggtgcgagggcgcgggctggccgtaggatcggttgaggttaacggagacgaacttgccggggtgcgacatcggaggcgggggcgcgcccgcatgaaaccctagccagccgcagccaaggtccggcgcgcgcccgcgtgggccccctgggagtgggggtggtattattactacccacgcggccgcgaggtgcgggaggtggcggcggcggcggaggtggggggggacgcgccgccgacgaggaggcggcgacggcgcggcggtggcgtgggggatttgggggggaggagtttggtgtcgggccggaggaggaaagggaggggaagggagccctagagagagtagagagagagaggaggagcacggtggcacgaatctcaaagtcgctggttcggttcggttcggttcggtgcgcgctgtgctgttggatgccggacgaagccaggtcggcaaggaggagtggtggcctacaactgaatcaggaaagagagaagaaacctcaacccactaccaaagaggtaaaattagatttacgaccctggctgcgcccactatcaatcttcatggaacatgaa

SEQ ID NO: 90054 - DNA, 1282 bp, Oryza sativa
tgatgattctttgaaagataagacagactttcctacttcaacaagtaagaccgaagtgaacaatatatctgaaaatggttcgaccaaccagagcactatgctatcagatgaatcgagaacaaaagaagacaagatgaatcatcacgagaacattgctgccaccacaaacaaaaaggcagaaacagatgcgagacctgaaagtccatacagaggtctcattgacactgctgcgccatttgagtcagttagagaggctgtcaccaagttcggaggaattgttgattggaaagcatacagatctcagacactagaggtaatactgatttgtttaaaactgcaaatggatcagatcatggttaaagatgcaactttgttgtgtttcatattaatttccttgccattacagaaatacactttgtttttatgagaaacaatagagcacatattatacttctgctcactgctgttcaatcaataacacggtcaaaaattttcatcatatagactgctgttgttaaggaatttgctttttatgcagaggcgcagggtcatgcagcttgaacttgaaaaggctcaacaagagattccacaattcaaacaagattcagaagcttgtgagatggccaagttacaagtggttgaggagctagggagaactaggagacttgtagaggagctgaaacacaaactggagagagcagagattgatgtggaccaggcaaagcaggattcgaacttgcgcagctgcgggcacaagaaatggagcaggggattgacgatgaagctagcgtaatagcccaaacacaattggcagttgctaaagagagacatcagaaggctgttgatgaactgaagttggtcaaggaggagatgagatcaacacacgaaaagcataccgttttagctagcgaaagggacatagcagccaaaagagccgagcaagctatttctgctgcaaaggagactgagaagagagttgaggaactcactttagaacttatcgcaatcaaagagtctctcgagtcagcccatgccgcgcatcatgaagcagaagaacacaagctcggggcggctttggcaaaagagcaggattgcctggcttgggagaaggaactgcagcaagcacaggaggagttgcagcaactcaacatgcaacttgtatcaaaaactgatgcaaagtccaaaattgatgaaaatacgcacatgctacaaatcctcagtaaggagctggctgcctatacagaaaacaaaatgagtgaagaagctggagtgatcgaggagg

SEQ ID NO: 90055 - DNA, 659 bp, Oryza sativa
atatttgtgtcctcacaagcaatggaaatagtaatacatatgattaatcttaatttctttggcgaggtaaagctttgcttaatagtaacttggccaaacaccttcaattgatctgccatatgtgcacaagtttcgagtaacaggaccaatacgccaagacaagaagctgaccggttagctgacatgatgtggaaataacagatgttcatgattcttctgttccatcaattaagggttgggtagttaccagtttgaacttttgtagtacttcaaacatccaaggacattctgcaagtcacaggttaaccaacagatataccatactgcccaagtcatacagcatttcatgggaaatggcagaatgcaataatcaaatcctactaagcaacaataatgtactcagaacattatattatttcccctcgaattacatatgtaaagtgttcctaaataacaataatttactcagaacattagatagatccatcaggcaaagactgtacaaacggaacactatcaggtcataaattagctgcagactatctatttcctaattaactgtagacagctccgtgatcgccccttgtctgatgcattgtttcagtgcatgaagtcgtcgattcttgttagtaaatcattgtcgagtgttgatgccgctt

SEQ ID NO: 90056 - DNA, 704 bp, Oryza sativa
tgctatgcttgctcaaaggtttgatttcatttgatacatgaagcgcatatttcttagacatatcacttttacttgccattatgcctacctatgagttttacttccgatagtgaaaaggtttcctcttccccttacttgaaatagttacgcacttacacttgcccaaaaaataacttatatagtcaagttcatcagtcttccccaaatttgactatagatttgtcctaattttttgcctcttaagattttccaacgaatgtatatgaatataatttcatgaaatgttgactaaactcttataacttgttcacagattaaaaataaattatccgacaggaaatatgttcaaactgcatgattgtgctgtctgccaattggtgatgaaacctggtgagggcatctctgttcatggtagcattccgaggaattcaagggttgatccttggggtggcccttttctatgttcatcctgccaattgaaaaaggaggctatggaagggaagcaacatttgacaagtatgaatgccttcatctaaagattttttttctctttgcattaggacaataattgttgaatgcttttttatttttaatttccagattctcaaccgacagtccaacctgttctcaagtagccttcaacggtgttcgatacttcagtgaatacatgctaatatcactaagaccctaacaggggtgcagga

SEQ ID NO: 90057 - DNA, 711 bp, Oryza sativa
tgttgttacataatctgatgtattcaagaatcttaacagttccctgtcagagtttgctgttttgggctttgaattgggctattccatggagaatccaaactcactggttttatgggaagcccagtttggtgatttttccaatggagctcaagtgatatttgatcagtttctgagtagtggagaggcaaaatggctccgccagaccggtcttgtcgtttgccttcctcacggatatgatggtcaggggcctgaacattccagtgcaaggttggagcgtttccttcaggtaccatttttctgtttctgactgcagaaatgtcgtcactagtatcttgtgttagtattagttgcattatcttatcatctgttgacataaaaggaacacaacataacagcactgcttttcacagtgttgctttctcataaactgtgttggcattgccatagttctacagttcatatattttgtataatatatgctgatgccatgtggtgatacaaagttgcggacttttaacacttcactgaaattcagcattttttttgtttttgtttgtttattagttttccttttgtcataacttgatgactgcgcatagaaatattccgcactgtgactaaccatattatattgtactaactctacttttgacttggaaactgcaccacatcatccatttgtacatcatttattctgcagggctgcaggaa

SEQ ID NO: 90058 - DNA, 950 bp, Oryza sativa
aaatgatcttttgggatgttctggagtatagatggcagaccatattggtaatgaagcacattgctggcatcatgcatcatagtgtacttgagcatctccgcgaagatctccgcatcgatttttgtcagtgatattgtttctgacaacttaattagtgtgagacaccaaccatgttgcctagaatgcttgccaaattgaattgttcagcactcggtagtatatgctacatacttttacgtatggctctttaggggcattcagtacctctgtttggaactttgttcaatcactgcaacagaaactgcagttacttacatatcatttatgcaattttcattcagatgtttacttcaggaaaagtggtctggaacgctcagctagaattacaaaagatttggagtggtttggagggcaaggaattgcagtaccagagccaagtactgctggatcaacatatgcaacttatctgactgaacttgctgagagcaatgccccagccttcctttcccactattacaatatttattttgcacatacaactggaggggtggctataggtaacaaggtaatgctattcccatattggatttaagtccccattaagttgtgtaatgaactgttgatatatatactcatgtttcatacctaacctgattaaatatccattatatgtctattaaactataaacaaaatataaaccagcagatttaaatgaaatactgagttcaacgctactttcttatcagatgagatgatacattgtgatttcattgtttcatgtctcaacatgtttctcattaaatggattggcagcacggagctttttgtatggagttgacaaaagagtgtaaagctgaatatctagactgatacatttctattctgggtatcagatattcatatataaagttcctctgttagctggtgatacagggctatttaaacattt

SEQ ID NO: 90059 - DNA, 1794 bp, Oryza sativa
ttcctgcagccctcctagattcgttttttagggacggaggtagtaagtcagttagctcagagcgggtacaatagcagactataagccagctataaacacatttcgagaagataaaataggagagagaagagcagcgggctacagattcgtagccagctgcagtataggctccaagatacatgtatgtatgataggtgggatcaactataaattgtgtagtatatatttataggtaactattgtatgaatcggctattaaattgactataaatgatttggagccggtagttggctataatattaaacttgctctcacaccttatggtgctagctgaagaccccaggttcgagcaatctataggtagatttttgcaacaatttcatcaaatcagagacaaactcacacgtttcaaggccactacttcaaatttaaacagacaagccattcgtttcaataattctctatggccccagcccccaggcctctgctgccattgccattgctattgggagcagagccaatcccacatggcggggaccaatcatcaagcgagagaccatctcatctcctctcttgtgtgggagcctcctgcgacaaatgctcagctgcagctctggagaaacaagctgaatcggcagcaagaaacaattactgctagcattttggattttggcagatacacagataacattagatggatatacctggctcactcactcgtgacttgagttccaacaaccacaacacgggtatatatcaataccattcacccccgtgatgatgatgtattgatatatgcgtcgtacatttaaacgcatatacacacagtacttgtacatcaatttccagtccagcagaaactccaccaggggttggtacaggcaaaagcaaaatattgattgcaaggataatgtaagatggtagtagtagtagtagctaggattggtacaagcaaagcgaattcattgcaaggataaatggataatgtggtgaggtacaagaggagacgaagctttggcaggcatggggggatcctggctggctagcatggtgttctgctgctaagtgaattgtgtcaggctggcatcattgcgattgaacgcgtgagatcctgatcgacagcagcaagcatcttcaactttgcacagttcgaagttgctgaaagcaagagctcactccaacgagcagctccaccatgcaagccagaaaagaggctattgttgtggcctggtgttttcaatctccaggatagtgctcgctgatcagcttcagtctcacaccagaagatccttctgtaccagacttcaacatagttaagacgtgtagtcttcgacaaaaatgactgcactaagcctcaagtttaatatatctctagctttcctgtcttcaggaatagattataggttgatttgatcagttgctcatctatgaggaactataagatgattaagcgaacaatccgccccaaatgctggaaacattttgcagcttctttcaagcacaagttcctgtccttccgagaccaatgctggacagcatgacagatagactaatcaggttacataagcatataacttctgtggcaaattccagtttcgagcttacaagaaaataaaagaaagtgatcttgaggcggttaccttgctaagttcgttaagcttctccctggtatcttttagcaaaagttctacatcagaatcccatttgtaaaactctagctcccttccttccaaaattttcttggatatctgttacgtttcaaactaatacttcttcagagagcaattaaataa

SEQ ID NO: 90060 - DNA, 644 bp, Oryza sativa
cagcccgtaaaatttaggccccaacttaccacggccggtgaccccgagcgaagcaatcgggcgatggagcaaacgaagccacaaccagtcgcccacactgaattccaatgcccgatgcttgccatcatacgccgacttgtgtgtctgctgcgcttgctccaggcgatcacgaatctcacgcaaaaattcatctcgatcttgcatcgcctgttggactgccagcagacgagtggatcccggttcataggcgcgcagcgtaggcggctcacggccataaaccacacggaacggcgacgtgcgaagagatgactggtaggacgtgttgtagcagtactctgcccatggaagccaccgtagccagtgccgcggccgatcgccggtaagacaacggagatacatcgcaatgatcttgttcgtcacctcggactgaccgtcagactgaggatgaaatgccgacgacaagttcagtcgtactccggccaatctgaacaactcccgccagaaagtgctggtgaagaccggatctcgatcactgacaatagaagctggaacaccatgcagacgaacaatttccgagaagaaggccgctgccaccgaggttgccgtgtagggatgagccattggtataaagtgggcaaacttgg

SEQ ID NO: 90061 - DNA, 1625 bp, Oryza sativa
gctgtgtcttgggtgtacagttgtacacctctgatcagagtaaaactattcgaatagccgtgcccgcgattatgggcggtcaaccagattcaccgtgattagtctcaccctagtttagtctaatgaaattggatagtataggtggagggttgggcctgttgcaacgtgggatagcgttggacagcggatgatcaatattaattaattattgcaactgtttaattctttcaacttctgtttataaatgctcgctttatgcaaatgaaccactctagctctcctttgataattccctgcatcatacccctattccggtatgacttgctgagtacagtgggtagtactatgtcttgctctatttttccccaaccccagagtgcgagtatgtgtccgatggcgggttctccgaggagtagacttcgtccgtgccgtcgagggtgcctgtggagtggtgttcccgctgcagttcaagtccaggcttagccccagttatcttttgtttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacagtcgtcggatagggagcatgacaacaatgaatcctgacagaggcggatctagaaaattggtccgttggtgtcacaacgtgtctatcggtgtcatagtatgctaattatgcttagagcataatgttatagtatatgaataagctgttttgttataggttttgtcgaaagtcgtcggtgtcggctgacaccgacgattatactgtagatccgcccctgaaccctgagcatgggagcagcagtgggatctacctagggttttggaattttatttgtgctttttgctgattaatttctttcctaaagcatacggcataattctcgcgtgaaaatccctttttgtgcacggttgtgctgttcatctgcgaaagtttctatttttattgacatctaggggtaatcggttgctttctccgtttgcaaaaatacattttagtcgctttgaaaaatcgactctgtgctagtgtgaccaccttgactaacctgaacctcttaattacttataaaactgtagtgatttgtaagcaattccgtttgaacaaatcatcgtactattttaaacaggtatgtcacacgcatagggatgaaaacggtcgaaaaaatcttatactattttttatttccaacaccggaacaaatcttatgatcggtgcaaaccggaaaaaaaacgttagaaatttccgaactgttttcacccctaagcacgcataccacgcgcggttccatgtccccacgtgttgacggcgaaccggcatttccacgtagtcactgcaggcgggacccctctttacgaattacgatcaatgatctgtgcacaggaagcccaacaacctcccggatcacgatctctcactgacaatggggtccaggatgaagtgtgacccacatatactagtacacatggccacgtcagctccattcccgtcgcgtcactgcctctcgcgactgcatttaaattcaccaaaccagtgatgag

SEQ ID NO: 90062 - DNA, 1387 bp, Oryza sativa
ctcgccatggtccgcgtcgaggacctgccggtgaaggtgatggtgctgaacaaccagcacctgggcatggtggtgcagtgggaggacaggttctacgacgccaacagggcgcacacctacctcggcaacccggcggcgaacggcggcggcgaggtgtacccggacttcgtgacgatcgccggaggcttcggcatcccggcggcccgcgtgacgaggaagggcgaggtccgcgccgccgtcgaggagatgatggcggcgccggggccgtacctgctggacgtcgtcgtgcctcaccaggagcacgtgctgccgatgatccccagcaatggcgctttcaaggacattatcgtcgacggtgatggccggagttcgtattagttctgaacttcaatatatgggactatccgtacatttatcgtctaaaaatgtgttatctataaatatagtaccatagtaatgtaattacattgtaactatatataattgttctataactttcgttagttttgaaccactccttttctcaatggactaagcagtgttgtgctgattgtggcatccaagaggcaaagctcaaataaattcatgtggtgtatgatgttgccgtcggaatgttctctgctctcgttgctaaaaacttagagtaaacatttgaaatcttttcatatatctactagtaatgttcccgtgctaacgctacggtctcacttgaatggcttgctaccaaaaccagaaattgataagcagtaatataggtgatatagcaggaaaagataccatgtcaaaatgcatataaatattattacaaatttggtcattgacataatactacatttcatcagagttactggtgaaaaataatgtctcgcggttataaagacaaggcaacaaagataataaatggatgaattcgtatcattgaaaataaacccttgttttgccgcccaagtcgttgaagatggtaattgatggctttgttgcattatttaacctccctttctatgatcaagtcttaagcaatcatcataaatatggaaggcacgtggattaaaatctgggtaaacaatttgaaaggattaaaaaaatgaaatggcgattaagacttgagtcctagtaaaaagcaaccaagagattcgtctgctggacattctgtagaatatatctttcaacattaagctggcacctataaaaatgacaataccaaaaaatgtagtagcagaccacttagtttgtttcatgtagaagtagtgatgtcattagactagatataagacacctaatatatatacctgtattaaaaagtgaactccaaatcaattgtcttgtgtttgtgagctgaatcaagaagctcatggaatagcaataagtggaatagtcacacgggggg

SEQ ID NO: 90063 - DNA, 569 bp, Oryza sativa
ccccgatgtcgacgtgcacgatcttggccctgctcgcgaacgcctcgactttgccggtgacgcggtcgtcgaagcgcacgccgagcgcgaggaggaggtcggcgttgtcgacggcgtagttggcgtacacagtgccatgcatcccgagcatccgcagcgagagcgggtcgtcgctggggaagttcccgatgcccatgagggtggtcgtcaccgggatgcccgtcagctccacgaagcgccgcagctcgtagcccgacgcggagcacccgccgccgacgtagaggacgggcctctcggcgtcgccgacgaggcggatgacttcgtcgagcaggttggcggccggcggcttcggcagccgggagatgtaccccgggaggcgcatcggcgcgtcccaggatggcacggccatctgctgctggatgtccttggggatgtcgacgagcaccgggccggggcgacccgtggacgcgaggaagaaggcctcgttgatgacacgggggatgtcgtcgacgtcgaggactaggtagttgtgcttggtgatggagcgggtgaactcgacgatgggcgtc

SEQ ID NO: 90064 - DNA, 4574 bp, Oryza sativa
ctgatttatgccttgcatgctttccaggactagcattccatccactggatgggattttgcaagccataccgcatgtgtttgcgctctaccttatcccaacacacttcaggacacacattgctctcttgttcatagaggccgtgtggacaactaacatccatgactgcattcacggcaaggtttggccggtcatgggtgctggctatcacaccattcaccatacaacataccgtcacaactatggccactacaccgtgtggatggactggatgttcggcacccttcgagagccagaagatatcttgaagaaggattaggatcgaattgttaagcacggcgcgacgttcgcctctcgtctttgtagcagtcggaagaagggggttctatgtatttatcctgctcgatgctatctgttatctttcatgtaccaatgtgctgtttcagtatgctaggtgaacataaaagtgaactttagtgagttcatcatccctggaatgcaatggaatcgagagatatatcctgggtaggttccaggtgtttgtaccattcctgaatttctctgtacttctttgtgtcaaagaacatgatgaacagttgtggccagcttttgtacagcaataactgttttattgtaactgctgccatccttttgtatcatgaatttttctccgtttgttagtctggtagtaaaatttcttgaaagcttatattgggctttagcctttagagagttagagatgaatttttgtgatgggtttaaattagggcccaatacgaactggccctgaaattgaagccttgaggcccaaacagtctgctggattgccggcctgtttaaggcagggaaagaactcaagcagtgcagtgcaaaatgaaaaaaggagccagaaaatcatctcccagtcaaaaattcaccttctcatgactcatgaactgtgaaatttccgatcgaaacgtgtgaaactttctccaatttagaactccaaaccattaatcctaggtaaccttgttcagctgttcaaaacaaacagcagccatataatcacgtcgagtcgcactgctcgtgtaagtcgcgttatattacgggagggaaatttgggcaaagatattgctgtctcgattgatgtctatcactcacaatctttctctgtcgtactagcacgacggtggagtgacatgctttttcccagttgctgctgcttggtcggtccagtaacgtgcacaccaaaacctcgttaattaggttgttacacccgacagtcaaaattaaatacaggttaatgagtcatcaggtcatgcagtatgtttggtaaaagtctagctttcctgtaattgcacgctcgaaagtggcatgccatgattcaagtgaattcgtcttttttgttaattcagtactactcccaggaatataattgctgccgaatccgttgaatcaggaaatgctaaatatgattaaattgttgtagattactagatttgagaggagtttgtatgttgcatctgaatgcaagataattaccggtggacaaacttcatataggtctaggtcggtctcgtgcaagtgacaaaatcaacgcgttttgtagcgtgtcatgcatatatgataggattaggatgggtctgcttgctcgtcctgacgaaagaaatgaaagagatacatatccaatggctactggctagtattatctctttttcaaaatgcatgacgatactattcatttttcacgcaacgtttgattattatcttttcaaaaatttagttaaagatataaaaatataagttaagattatattttatttgataataaaacaaggcacaacaaaataaataatattgatatattttttaataagacgaatggttaaatgttatagaacaacgttataaatttaaaaatggagggagtatatattttcagtctaagagttaacctcttttgtttcctctgcttgtacccaaaaggaagtttggcatgaactggtgatcattggttgctaaagaagctgtagctttgttccaagctattagtatacaaaagtagcgtccttttctcctcctgttttgttggttaccaccaacagtatattccatgcacctttgttcatgctaacccctcgatcgatccgacgtggttgatttggtaggtctcataaaagaattaacgctagcttttgatttgtctacatgtatgtgtcgctgttaatctcagtattagcaagatcaatggcaagtctacacgcggagatggagcgaatgacaccgacgtcggcgaagaattaacgctgcatgccttgatttcttcgcctgcgtgtgacagggacatgaacacgatgtgcatatccttttctgaacttttacgctgagaaatactgtagtaaacaagacctgattcgatcggagatatttaaccatttgtcacatttaaatgtggcaattaacattttatcaatagaaccacatatcatagatatatgtggatccacatgtcattgtgatagaggtgataaatagttatttgctaaatttaaaagtgacagatagttaaaagcccgatcggatcgatcgatggaaacgacctactgcatcgtcgccgtgagctttttgctgcgacatgtttggggaaaaacttgtcccatcgatcaacacaagacgacgcgtttgtggtttggttttttgtatggttcggtggaatctcgtaacacggattgttccggtaatattccactgctaattacagtacagccgaatacacgcttttgagtgtttctgaaaggccaccgtgatgctaacagaacattatcttcagtgtttgcctattttctttagataatgaaataaatttcggcttttcttgtaacggagctataatcacttattacacaattcgtccgagagcatatataatctagtaactcacgatgtaaagactaatactcccttcttccctaaatgtttgacgccgttgacttttttaaacatgtttgaccgttcgttttattcaaaaacttttgtgaatattattcaaaaacttagagtagtagtatatttaacaatgaattaaatgataaaaaagaattaataattgcttaaattttttgaataagacgaacggtcaaatatatttaaaaaagtcaacagtgtcaaatatttagggacggagggagtactttatcatttaatgagactagcatttattcggtgtttgcttatggatcggcgataattttgttaagtttgcacactatcgcactatgatttggttcgatcttcttttaccgccgctatttttaggcttgttgggagtgtagtggagctccgccaccacttttcctctttagaggtgtagcgttttttaagtaatagtttctttaccttagcagtcttttttttctccttttttttctcctaggcaattatgttttcttctaatatattgacgtgtagttttatttacgtgtgcacaaaagaaatgagaatgttctacatgcatcaggccgactttagttccaaactttttctttaaacttccaacttttccatcacatcgaaacttttctacacacaaacttccaacttttccatcacatcgtttcaattttagtgtgaactaaacacatcctcaatcatttactgtcttcaagtaggcatagtaataagcctccaatggtccaatattccaagctagctaggcacatcggccgtatcgcggtcggagaatttgcgagccagcgaagagaactttttcttcgtgcgatgcgatgaactgctgctgcgtcgtacgttccgggccggacaagtacgcctcaagcggatgaccaaactggttaattagtctttggactctagatccgtccgctcaatttcatttcgccgtacaagtcaccgcaccttccatgtgcaaagtttgatttgaattacgaaaagtcgggagaaaacagaccgtggtacgttgaatgccgaatgaaaaaaaaaacctatactttaatggttgatatgatatgaagtttttcttgatctgtttgacaatcaagaagcatgcctattttcaccgttgaaagaaaaaataattccttttacctttgcgtaaggtgaggctttagtcatctggactttgtttgttcggtctgtgtggaggccaggtttttaattattttttaaaaaaaatactcccttcattaataaaaataactcctttgtggaagctcattgaaactatatcaagacaaacatttctaaatgctactttactcacattaaccatccatcatttttcttatctcatcttaccttccactctaaccctctctaaatgaggtgcatgatagtcttctagtttgatctttatttttgcagaaacccatgaaagtgcttatatttttaacgaaggggagtaggaaggaagtctacctgttgcatatgtggacaccttgtttaccgtttcatgaaatttcattacctttaaatatgtaaattttatttataaagggtgatattttataatttttatttatttgattctctttctttgcttggccctactcccttcgtcccaaaaagactcaattcctgggtt

SEQ ID NO: 90065 - DNA, 835 bp, Oryza sativa
cgagtagattcgatgcttccgaagtatttgacaagctgagaatcgctccggacacctatttcaagaatattaaagaagccggaagcatgggagcaggtttagcgctagcaatgaccaaatccctgtacccgaagatcgatattgatgccattgatggttttacggatgggacaagcgaagaggctgcccttgatcttatcaacgacactcaaaaagcagccgacaagattgcaggtgatgtcgtagatcggtttcaggataccgaccttcggccgactggtaacaataactctgatgatgagaagactgatactgattaaatgtaaatgtattggatgacgaatgatggaggcacaatttgtataataccggtgtatttatgctgtgcttggtgtttcttgcttagctgttgatttcttaaaagcctttatcaagctttgttgagcctaaaacccgcaaaagctattaaaaactttcagtcctcgtaaactaagtagaaaaatcaagcaaggcaatgatagaccaagtaagcaaattgaattgataaaaatcacactccattattattatagtagcccccgactgacaacctcaagaaaaaaaaggcttgatgttgacagtcaagatagggaaatacatagagaaacttaagcgtagaaacgacgaagatgttcgatattccaagaattgtcaacaagtgtaccatcttcacgcttgagtcggtaggaacctggccgggtgacttcagagattataaatgacccttcccatagaggagataactgtgccgatctcgtgtagtttggattttgtcacgtcctgataaattcatccc

SEQ ID NO: 90066 - DNA, 691 bp, Oryza sativa
gctaaacgggttgtcacaatcacagcagataaagctcgagatttcttcatcaacattgtgcataggtttggagtgcctaatcggattatcaccgataatggcacacaattcactcgcggagtttttaacgacttttgcgaagacttcggaattaaaatttgctatgcctcagtagcgcacccgatgagcaacggacaggtcgaacgagccaacggcatgatacttcaagggataaaagcgcgagtttttgaccggctaaaaccctatgctggaaaatgggtggaacagctgccatcagtactttggtctttgcgtactacacctagtcgggccacaggccagtcaccttttttccttgtctacggggcagaagcaatattgcctagtgaagttgaattcgaatctttgcgctttcacaattttcgcgaagaacgctacgaagaggaccgagtgaatgatctgcaccgattggaagaaatccgcgaagcagctttaattcagtcggcccgatatttacaagggttgcgacgctatcataatcgcaacgttcgatcacgagcttttctagtcggcgacctggttttgaggaaaatctgtcacgaccgggaaaattgccttttcccgaacgctagtgtattaatccccgtcccaggaaaagccggggtacaccacacaaacatgatataaagga

SEQ ID NO: 90067 - DNA, 1382 bp, Oryza sativa
tataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgcaactataaaatatgtgtaagcgctagcctggaaaagacaggaaggctgcgccgttgacatgcagaccccacatgtcaacctaaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccgggaatgacgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgaggatgaacgggcggccgaagggacgtcggcgacgatgaggatggagaggccagcacgggcgacggtgttccggcgaaacagaggagcagctggaggagaggacaacgcggcgacgtcgataggcgtaccggcgacgtacaggagccggccggaggcggggaggtactggacgccgacgtggaggccactccggcgagcttcaggcgaggaggaggtgatgccggggatgagggcggcgtcgcggagccgagggaggtggtggcgacgtcggccggcg

SEQ ID NO: 90068 - DNA, 704 bp, Oryza sativa
ggcgacgatgcctggatggaatctgttgtcgaccagggtagtggtaatcatcagctccgtggcacatctcggcctcgtcttgtgtgccgaagtccgccgaaatagtgcgacaggctttcggattgtcatcctgtgggtggcgaaccagatgtcacgttgggccccgaccaccgcgctggccatgctggccgccggacgcacgccgcaggaggagcagctggtgacgctctgggtggcgttcatgctgctacacgctggtatgccggacaacatcaccgcctacgccttggaagacggcgttctctcgtttcgccagagtgtaaacgtgtttcttcagcttgttggacctgtgtcacctgcctatatcctgcaccagaatatgttcgccatgcctggcgactccatgctgtgggtctcctcgatcatctgctgtatggccatctgcaaatatttggagggggcgtttttcgcgctgcagcgtggcaacctggaaaacatgcgaagcgaaagcaagaaggaggttccaagtcgaagagtaacaagcctccaaagtctaaggcgtggcggcaaaccagataatgaccaaatcatgctggttgctcatggcaatctccatatcaccaagggtgccttcatcgataatttgcaatacgagcatgatgcccagcaaccaagaaatactcccgaaaacattggatgaaaac

SEQ ID NO: 90069 - DNA, 1797 bp, Oryza sativa
gccatccttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaggccagcggcaagcggcggtcagaccgacagcatacaggcgggcagaccggcggcggcgacaggcgcagcaggcgatctcggcggtcagaccggtggcatccactcagtcagaccggcagatcaatctcggtcagaccgactttcttcgatttcgagggtaacttttatttccactaaaagttttcagtttttgggtataccaatcattcaccccccctctggttggcttagttcttgtgattcgatcctacaagtggtatcagagccttgttttcttctttggatttttaccgatctagagtttttgccatggctactcccgctaggttttcaactaagcctcatgttttcgatggaacggatttttctcattgatgtagtaggatgcaatcttatattatggctgaagattatgatatttggagaaaagtttctcatgcttatgtgattcctgaagctattaatactgctgctgaaaaaactgcttttgaacaaaattgcaaagctcgcaacattcttttgagtggtatttcttgttcggattatgatcgtgttgttcatcttcaaactgctcatgagatttggattgctttgagtaattttcatcaaggaacaaataacattaaagagcttcgtcgagatctttttaaaaaggagtacattaaatttgatatgaaacctggaaaagctttggatgactatctttctaggtttaataaaattttgagtgatcttagatctgttgattcttcttatgatgctaattatccacaatctgagatttctcatcactttttgaatggtctcgacatgtctatttgggagatgaaagttgcatctattcaggagtctgttaacatgtatactttgactttggattcactttatactaaattgaaaacacatgagatgaatgttctttctcgaaaagttgattctaaatcgagtgctttggtttcttcttcttcttctttggatattgatgcctcttcatctaagtcgtcttttcttgctgttattaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagtttgagagaggcaaaaaagaagacaaagatggtgagaagaccaacaacaacaagtccaacaacaacaagtcgaagggttcttaccaagggaggaagatggagaatcttagaaaggcttttcaacaagtttggtatgggtattctattaatcctattaagccctagcccaggatgtcaaattggggttattaaatgatttcaaatggaaaagtcaccaaaaccaaagttgtagaactcatcga

SEQ ID NO: 90070 - DNA, 605 bp, Oryza sativa
agctccttgcggtggtcttagaaacctgccggggggtcgccatcgtccttcttcttcgacgtgctttgtttttcgtcggagttcttccgtgtagtcttggtgtattgttccgcgaactgcttgtagacgaaacaatctttggccgcgtggttggacttaggatgatgcgggcattgggagttcatgatcttgtcgaacgtgttgacgcgcgaacgctttgatgatcttccaccccctcccgtagccggtgtatccttttttggcttccaactggagcccgactgctttgatgcgatgacggcgtcttcagccttggcgtactcgttggctttttcaaacataagtttgactgttttgggaggcttacgcccgaacttgccgaccaattcttcgtggcgaattcctttggtgaatgcggcgatgataacatcgtcggtgatgtcagagatcttgttgcattgttcagaaaatcgccggatgtaatctcgaagagattctccggacttctgaataacattgtaaagatcgaattgtgtgccggggcgctcgaaagtgccttggaagttggcgatgaagtggtcgcgtaattcggcccaagatccgat

SEQ ID NO: 90071 - DNA, 623 bp, Oryza sativa
gtctttggttaccacctggaaatactgggttgttaaccatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatattgagccaaacgatagaactcgtgcaggtactctgtgacggtcaaatctccttgcttcaggtagcggaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggccccgttttgagaaattctgataacttgcactgttgctggactgtaggtacttgaacgttggttgcccctgct

SEQ ID NO: 90072 - DNA, 802 bp, Oryza sativa
taccgccatagtacctcctaggcatcttgccaaacactcgggaagtatttcttcaagtatttcccgttgattgcccgctgaaaacgctccccttgaagtgtctccaaaaagtatgcgttccctcgaacaatgccgcacactcgataaggaccttcccaactaggagaccgcttaccgaactccttggatcgagtacccaaaggcaaaattgtcttccaaaccaagtctccaacttgaaacaattttgctttcaccctcttcttgtacgccttggccaccctcttcttctctttttctatctcttccaatgccttcaagcgcttgtcgatgacttcatcaaggttgtctcccatcaacatcttgtaatattcacttgacaaatcatcttgcttgatataatgaagagaaccaagatttacctccactggtaaaacggcttctcgaccataaaccaactcaaaaggagtgactttagtggcaccatgtttagatattctatgcgcccacaatgcttcagaaagcacgtcatgccacctcttcgggtgttcctcaatcttcttttttactagctttaacaatgttttattagtcgactcggcttgtccattagcctgagcgtagtaaggagaagaactcaacaatttaatgccataagatttggtaaaactcttcacttccttagacataaaagaagcaccttggtccgtagttaatgtttgcggaatactgaacctatgaataatatgctttaaaataaaatcaattacctccgtatgagtcatattcttcaaaggcacggctt

SEQ ID NO: 90073 - DNA, 3572 bp, Oryza sativa
ctaatgctgatgataccaccaacaaccatggttcttgccccattcatgaccacttagatcaagcgtgcaatgtcaacatcattcaccaagatatcgacgatagtatcaatgaaggcacccagaatgacaaccctagcaattttgactctgggaaggactccaatggtgatagcaataatggtaccactgatgccaatgttagcaaggattcccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaattctaacccatagtagatacaatgtaccgatgttaagcaccgtccctttttgtttaaggcagtgccccgtattcatgtaatgagggagaaatgtgtaatacagacaagttccatgaggattcgtttgaaagatgcggatatgtgatcatgtgtataattggttactgacaaaggagacctagggtctcgtgtcagaggaactatattctaacctcgagttaatagccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgagccacatcaaggtttcactgaaaggcagcaagccaaaggacctcatcatccccagaagcgtccgcaatccacattcaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctatgaaggcaaggagtgaaatcttcaactcggtatcagatgctacacgaagtgaaaagtgcaagcaccggttaccaggtaatgccaagtcttgggagatgatccaatgggaaagaacacatcaaggttaaaagtgtaaaggaatacgttgaatgctaactgaggacaacctgaagataataatgggaagtaaactgaatgtaaagaaagtgaatccgagctgcttgttcgtgagagccattcccagttatagaaccagtgatatgttcgaagatagtctatagaggtcagattaaaatcacctctcacaacgaagcctcagatttgacagggtaatgattagacaataacaaatccagcagtaaagccatttgggaagacgtcaaagtataacaagtaggataagttggctctcttgggaagcataattcaaaggtaaagttatcgacccttgcatcaaatagcagaagtagctatcacccggagaccaggaaagctaatatgagacagttgatggcgagttagaagcaaatgacaagcatggtatcctagtaatgacaagcaggttacgacgcatgacatgaagttgataacttgtccgaggttgactccgaagatatgaatcatgagaagttctggaacggaagcatcactgaactaccgcaacttagtctgagtcagccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtacaagaaaaattcgaatgtggcccggagaatttttgttaaattctccttggtctaaaaggagccctcaaattttacttgaattttcagagcaccggaaataattattaagcaacaaaaacaattattagagtttattaaaaagaaaaacctaaaaataaatcctcttcctcctttgggccaagcccagcccaaagtctccctctcctccctctctttctctccctctccttctctccctcctcctcttgggcctcatcccctcctggcccagctccctcccttcccctcggcacagctccctcctccctctctctccgggctgcctctcccccccctcccctcccggcctgcccggcccaggccgcctccccctcctcttctcctgggccggccgcccggcccaacccgagcggcgccctcccgcccgtgccgcgcacgtgcgcgcgcgtgcgcgccgttgccgcgcgctgaccgcgcgcccgaccgcgtggggcccacgcgccaggcgcgtcgtcttcctcccgcccggcttctctctctcccgtgcgaaccctagctcgctccctcctccaaatccgcttgattcaattggccaattccaaaattaattggggggttttaatccccattgaatcctcttcaattgcccccaaattcccccttgattcgtgccttcaatccccgggaacggacgcgccaagtccggccgctttccatggccgtcggccgttattcccgtcgccgttccgccctctcccgagcccggctcccgcccccaccctataaaatgggatcccctcactccgttctatcgttttaaccccatcccgagcctccccgtggtccctagccctctccccgccgccctcctcctctctctcccacgccgccggccgcctccagccgcctgtgccgcctcgaccgtgcgccggccggtcgcgccgtcgcctcctccagcgtcgccgccacctcctccaccccggcctgccctccgtttcgcgcggtgaccgccggaggcgcgttcccgccgtcgcccttctctttcctccgcgccggccgcctccagccgcctctccctcctcgccggagcgccgtccggccgcgccgtcttctccctcggcctcgcagccacctcctctccctcggtcagccctccgtttcgcggggaaagcaccggagacgcgtcctcgccggcaaaacagtggcgttgtcgccact

SEQ ID NO: 90074 - DNA, 1432 bp, Oryza sativa
ttcaactgagagggaccttgagccaaaagtatttttctatgcccttcaagacctcaaacaaaggatggcatgccaactggttttatgtccaaaatcccgagcccgctcttcccgagtactcctgtcttcccctagtataccaagataattggaactcactgcccatgggagatgaagctgcccaagccttagaactgatggagcgcatgctgaagctcaaggagcaaggcttgcagggagagcaaatcactcggcatttcattaagtgccgattagctccaatcaaagagagatcccgcacagctttcgagtttgatggtaaacatgatccaaaccgtgaagacccagattctctggacttaagatcatgaaggagaggatgtacaagatattctcaaacgccatcgttgtcagttatttgcatctgctgccagtcgtgccatataatgcattcaacccatctccgctggtatgtatcagaactcttcaaaccgcgaccaaaacataattttgtcttcttgttgaattaacagaccgtggaggcatttcattcaggaatttgctttgatgaagtctgaccccccaattgctcaacgccgatctcctcgtcatcagaccgttcaggggagtggaggaccaaaaatcaggtcagactcccaatccaaaactcccaatccgactgggcaatcagattctcgcaagagaaaacttgtgctaagcgacgacgaaggcgacgacaataataaatttggggataagggatcacccaaaaaactaccaaagcacactgctccgaagaagaaaaagttcagaaaatcctccaggtataaaccattcggtaccatctcacttcgacatgcttctctcatgaagataatattgaaaactggaagaaaacttgcaggaaaccgtctgacatagatccatccgggaaggactctgatccagctaacacagagacaggttcatccaaagaagctgggccgacttctgaggaccacccgactggcgttcagacttcaactgattatgtcaacccaagcgaccagcccccgactggaaaccagttggcagaagcggaaactgcaacaagccaagagcccccgactggcaatcaatcggaagtaggtccagatcaagaaattcctgaagttgaagttcaggctacaacttcccaaggactggacgctggtaacgacccaacgcctgggtccccagataaagggcaaggatcgcctcacgctcaaccggaaattgcttcaggtaacccatcttctcaagtaatgccaatctgaataactccgacttgcttgtctaatgtttgggaatacatcaggaccactaggcggtgacggagaagaaatccctcgcataaaggcaactactgattctcgtccccccatcttaatcaaatggtgggacgacaacttgc

SEQ ID NO: 90075 - DNA, 2697 bp, Oryza sativa
ccgtggaccgctcctttcgcttcccccttccctcctctctctcgggcgccgctccgtcgcgccggaggtcgccgccggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcgcccggtccaccgtggaccgagaggctgacgcgtgggccccactcccgtggacccggtccgcgcgccctctctcccggctgacgcaatagatgagtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgatttaaattattgcattatcgctttatttaaattcccgcgttatcactgttttatttagccatgcctatttacgtttgttatgaccatattattattgttattgttattattattaccttgttcaccctagattaaacaaaacctcaactagtggacactctactgcatggcagccagctagttgtaattttagagtagatgcttcgcaatttaattaggtaacattaggtggtttttcaactatagactttgggaaatattcatatcacctggacactttggaactgttggattattgtggaattggattcacaccgccccctctattcaaaatccccaaaagaggttttaggctgggctcggggtgcatggttttgatagtagcacctcggccatataaggaccggtcttcgggcctctgttgcaaagcactaccatacttccacatgtctagtgggtaaggcttagtttgttgctcagtctagtcataaacaaaagtgcacggattggagatggatgaagtcgggggtcgatggacattctccagggtaaatgaaggctacacgagctgcggcccggtagtcgagatgtcatagcacagagttggtgccctgctgctaggggctcagtcctgcctgcctatcccggaggttccggccgtaggtgggattgggtcggtactcttgtctatggctaggatgggttggaaactatgtcacgtctttcgtctgtataccgtggtggtatgtggcacgtggttgcacgtgagaaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgggtttacaaaatagctttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccactgtttcccgtttgtctttgtgtgtgctgggccttcgctgcccatgtaataagttaactatttacgcttccgcttgttaaactctgaattgtatcaactgttggtgtaccttgcctcctgggacaaggattaatgcacgcacgtcaggaacgcccgttgggttatttccggtcgtgacaaatacccagcaagtccaaggaaactacgaatttctgaaaccgtcttgggttgcttccaacttaatactgactccacattgcttggatctactgccactcctccagacgagatgacatgaccaagaaacttcacttcggacaaccaaaattcacatttactgaacttggcataaagctgatgctcacgtagtttctctaaagctagacgaagatgctcttcatgttcttctttcgtcttggagtaaatgagaatgtcatcgataaacaccacgacaaacttatccagatattccataaacaccttgttcatcagattcatgaaaaaggctggggcattagtgagtccaaacgacataacggtacattcgaacaaaccataccgagttgtgaaggcggtctttggtatatcttcctcacggattcgaagttgatgatatccagaacggagatctatcttggaaaaaactgtagcaccttccaattgatcaaacaggtcatcaattctaggtaaagggtattattcttgata

SEQ ID NO: 90076 - DNA, 3262 bp, Oryza sativa
tgtcatttcgacaacagctggcgccgaccgtggggacctccgagcgaaaccaccgagagcgaatgccaccgaagagagtcgtgaaggagaaggttgccaggcggaaggaaagcgacgccggaccggacatggccgccgaggaaggagcagagccttcggcacccgtggccgaagatggaggaggacaagcgccatcacaaccgccttcggcccctgcaaccactgtgcaagtgccgaacgcggccgacgtggcgaaggcggctgcggtggcaagggcactccagaccagggcggagatcctttcgacaagccaaccggtggtgccccaagccgctccatcgctggcggcagcggccccaactgcgctcgccgttgtgcaggcccaagtcagccctgaccctgaagcacaagccgaagccgacatggaagccatgcgacagaacatgacacggctccaagacatgcttcgccgaatgcaagaacaacaagaagcatacgaggcggcaaagcggaccaaggccacgtcggctccaatccttcagtattcggcaggttatgtcccacttcaagtccatctgcaagtgacgacccagccctttccgccacaagccgcacaggcgccggtgtacttcaccgggcagcaatcggccgcagctgtgcgtccggcccctcacgtgcaactgcaagctcaaccagtcactgcccaagtacaccatcaaccacctggccaagcgccacaaacagtggcggaaggggcttcggctctgcaggcgcaactccaagctttccttcagcaactctaccaacctcactgcatttcaagtacaaccccatcggcccacccggaggggaatacaagtcaaggtgcgcctaattggttgccaccgattcagccaggcctgggagtttcgccgtggaatcaaggaccgcagttcgacttcgtcaatgctactcaggtgccaaccgttcggcagcaagctccaactccaggcttcggaacaaaccaagcaccaatcaaagctgccatgatgtggtcgcagccaatttttgacccatctatggtggctcagcaagtacctccagttggaaccgggcagtcgaatgccacggcccaacctcacgcacaagctgcgattttgcctttcaccacaccgtacccgcagcaaggtgcggcaaacagggcgggaggagaaaaggggctaccgctgagtgggggaatcaagactcgtccaatcccaccacagttcaagttcccacccgtcccgcgctattcaggcgaaactgacccgaaggagttcctctccatctacgagtcagcgatcgaagtggctcatggtgacgaaaataccaaggcaaaggtaatacatctcgctctagacggcatcgcccgttcttggtatttcaatttactagccaatagcatttactcatgggagcaattgcgcgatgtttttgtccttaactttcgaggcacctatgaggagccgaagacgcagcaacacctactcggcattcgccaaaggccgggggagtcgataagggagtacatgcgtcgcttctcgcaagcccggtgccatgttcaagacataaccgaggcgtcggttataaacgccacttcggccggtctgctcgagggcgaactcacaagaaaaatcgccaacaaggagccacagacgctcgagcacctacttcgtatcattgacgggttcgcaaggggcgaggaggattccaagcgacgacaagctatacaagctgagtacgataaagcctccatcgtcgctgctcaagctcaagtacaagttcaagttgccgaaccacctcccctctctgttcgccagtctcagccggcgatccaaggacagtcgccaaggcaaggccaggcccccataacttggagaaagttcagaacagaccgtgcaggcaaagctgtgatggcggtcgaagaagtgcaagccctccgcaaggagttcgacgcccagcaagcgagcaaccatcagcagccagcccgcaagaaggtccgaaaagacctctactgtgcctttcacggacgctcttcgcacaccacggagcaatgccgaaacattaggcaacgtggcaacgcgcaagacccaaggccgcagcagggaacaactgtcgaagcaccccgagaagcagttcaggagcaaacacccccagccgaacaacgccaagatgtacagcgaagggcaatccaagtgattacaaggctgacccgccaagccagttgtccaaacggcagaagaagatgcagatccgtatggtccacagcatcacttcggcgggtgaaggggcgccgcagtatctgaaccagctaatttcttttgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccacaatggggttgcctacccaatcccttaccccagcaccaacatcgctccacggtttcggcggcgaagcagttcaagttctcggccaagcacttttgctgatagcctttggctcgggggagaacagacgcgaagagcaaatactatttgacgtcgtcgacatcccgtataactacaacgccatcttcggccgtgcaaccctgaacaagttcgaagccatttgccaccacaattatctcaagctcaagatgcccggcccgacatgggtgatagtagtcaaggggcttcaaccttcggccgcttcaaaaggcgatctagccataatcaacagagcagtgtacagtgttgagaccgaaccacatgaacggccgaagcacatgccaaagcccacccgtcacggcaagataacaaaaatgcaaattgatgatgccgaccccataaagctcgtatcactagggggcgacatgggcgaagaagaagttgagagtatcctagaggtgctcaaaaagaacatcgatatcttcgcctggagccctaacgaggtggggggtgtcccgacggatctcatcatgcatcacctagcagtcaagccggacattaagccaagaaaacaaaagttgcgcaagatgtctgccgatcgccaagaagcggcgaaagccgaaatacaaaaattgctcagggcgggggttatccaagagattgaccatccggagtggttggcaaatccagtgctggtgcggaagtcaaacggcaaatggcgtatgtgtgtcgatttcacagac

SEQ ID NO: 90077 - DNA, 905 bp, Oryza sativa
cggccgcccctcggtttccgccgtcgaccaccggagcgccgccgtcgctgctaacccgagccgccgcgccgcctttgctcgtcgccggccgccgtcgtgcatcctttgactacgtggtgagtaccaacgggttcgtctcgttgccctctacgcgtaggtggtctccgtttccgccgccgaagtccctagcgccggcgagatcgcggtcccgagccggccgtcgtgctgacgtcatgccgacgtcaaccctagggctgacgtcatcagggccagggctgacgtcatctctctctctttttcctttttctcgattttctaatagattaaaactttgaaaaatcataactaaataaccgtagatccgttttaggtggttcaagtttctaaattcttctaaaatcaagatctacatgataaaaatatccacatgtactgtttatgcttgtttttgtactgttttgttgattttgtttatttgctttagtttccgacgttccggaggagagcgtttccgttgaggaaggttccgaagcgtttgtggaggctcaaggcaagtcacacagatcccaaacaaccctttgagcatgttgatcccgtttaaagctattgttttatttcaactatgcattgttttcgaatgtcatcgggtggtgagccgttccctattatttaatggccgaagatgactttattttcctatgggttataatttgattagcatgaaccttatatattggattggttcagctaaatgctatatataggtttgcttagtcatgcttagaaacattagctaattaaaaggggttaaatataaattatattacataattattactgttaataatggttttatataatggtagctcacgatggtcaatcgtgtgatgttaattgattgataa

SEQ ID NO: 90078 - DNA, 534 bp, Oryza sativa
tctaaagacgagactcaacgtcttctgtttgtgttagaaaagcatcgcgctgttcttggctattcccttcaagatctcagagggattaatcccgcgctttgtattcatcgtatccctattgatcctgagagtactccctctagggaacctcaacgacggctcaataatgcgatgcgaaaagttgtaaagaaagatgtcctaaaactcctgcatgccgagattatttatcccgtaccatatagtgtgtgggttagcccggtccaggttgtgccaaagaagggaggaatgacggtcgttgcaaatgctcgaaatgaacttatcccgcaacgaactgtaactggatggaggatgtgtagactacagaaaacttaataaggctaaaaaaaggatcattttccgctacccttgattgatgaaatgttggaacagctagcaaatcattcctttttctgtttccttgatgggtattccgggtatcaccatgtcgttagctctccggaccttccaattatatttgagggatgaagtgaataa

SEQ ID NO: 90079 - DNA, 1452 bp, Oryza sativa
aatgtcgaggacaactgtatttattcaaagtttaagaatgggagatttattttcctaactctgtatgtggatgacattctactggctagtagtgatgtcagtctactgcagaaacaaagaatttaaattcttgtcctcaaactttgacatgaaagacctcggtgaggcttcatatgttttgggcatagaaattcaccgagatagaacaaagtatgcattgggactttctcaaaagacatatatagaaaaggtgttgaagaaattcaacatgtacagatgcagtgctacacctgctcctatagtgaaaggcgaaaagtatggggcatcgcaatgtcctagaaatcagtatgagctcaatgaaatgaaaacaaagccatatgcgtcagctgtaggaagcctacagtacgcgcaagtgtgcacatgacctaacttggcatttgttaccaggttacttggcagatttcaaagtaatccaggcccagagcactgaaaattggtaaagaaagtcttgtgtgcctcatgctgtcttacagaagatcagaatcgctccagatagtggggtattcagattctgattttgcaaaagataatacaaagtcaacatcgtgatatatgttcaccctggcaggaggagctatttcatggaaaagctcaaaacagactatcattgcagggtctactatgtatgccgagtttatagcatgctatgaggcaacggggcaggtgaactggctaaagaagttcatacctggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaataatcagtctcgagcacattagaatagaaaggatgctcgcggatccgctcacgaaaggcctaccacccaacatgttcaaggaacatgtagccggcataggtttaagggaagccttatgaatcctggactatagggcccaaaagtaaagtatctgtttctgaatagagatgtgtatagtggctgtcgaatccatcggtgattgaccgtgacgatgaaacatgctctatttacaaatctgtgatggaatagaaaaagctaaaagaaatagtgagatcaaggaggggaatgttaaattgatctctcacccgtcggacccaacggcacaatggaccttgaccgcgccctgatcaggggcgcccagcccaatggctggtgagcccccgtcacactgcgccatataaaagaggggtggaggccggcacggcacaaggtacgaggttcgctgccgccgccaactccaccccacaaaccctaatccgatcgagagggggcgcagccagtgacgagaaacgccaccggcgcgccacgcctcatcatcgggacatcta

SEQ ID NO: 90080 - DNA, 5903 bp, Oryza sativa
  unsure (1)..(5903): unsure at all n locations
gggatcctaaacctcgacaagttctcgagggctctaagactccgttagagtggaaattgccagaaaaagcgttggcagggatggagatgccgtgtgaccaaaacgacaaactcctcttcacggctgtttcgaaaattatgatcggtaatgggggcacaataagattctgggacaatgtatggcttgatggtcgttggctgaaggacgtggcaccactcgtgtactcgatatccaggcggaagaattgcacatcggaccgactagtaacccgaggctggcagaacaacagcgtttgcccgctatgttggcacactgacgagaccgctatatacctgttggtggaatgcagatacactaagaaaatctgggatgccattgccagctggatagcctatgcacccatggcgccgacagattggacacaagcaaccacggttcatgaatggtgggaatatcttgccgcatgccacggcgtaccaaaacttgggactatatccctaatcctcataatgtcctgggaaatctggaacgagcaaaaccgacgaatcttccgaaacaaggagctaagcacggcagccctcatcacgaagataaaggaagagtcaaaaactggggctacggcgggagccaaatacctagcggagatgttgccttagtgcctggtcgccttttgtaaatattaccttttcatcttgtaaatattgctcccttctttattcaatgaaatggcaagctctgccgtagttcaaaaaaaaaaatctggtttgcagcatgtgcatactcactttggaagataagaaacgtcaggattttcgacaggcaacaagccagactatcggatacaatccagcaaattatcgactgtcttgaactttgaaaacaccgggccaacgcagccattaaagagaaactttcactctggtgtaactcaatcacacagagttaatgtaaatacaaactagaatgttttttgtttttaggtttcttgtatattctactttcaactcctacttctcctgtatccccactctgtatctctattcctctccattttgttaatgaaatggctataaggtagagccggctctaccttcttatgtcaaaaaaaaaaaactatgaaatatcaatgtcgcaatagttattctgccattctgctgtcttggtgtgctgtttagctgtttcttctgcaatgtagtattgtattgtttcttcttttcgtcaatgatgtgaaggttatgttttatacttggaatactctttcattatctttcataataaataaataaatgtatgattgggactctaccaataataattataacagttgggctaactaggttgtttcctttgccgagtacaccagtacaggtgcagattattcttggctatatgaatgttgtgtgctcactgatcaaagttccatttcacagctggtttcttcgcagaatccccaaatcaactcccatcaatcgggctctttgcctcttggaggtgcagtgcaagtgcgtgatggatccaacacccatcgtgatcagtctgttagattgatctccaacctgtcgggcccaacggcacaacggaccttgaccgcgccctgatcgggggcacccagcccaatggctggtgggccctcgtcacactgcgccatataaaagaggggtggaggccggcacggcacaaggtacgaggttcgctgccgccgccaactctaccccacaaaccctaatctgatcgagagggggcgcagccagtgacgggaaacgccaccgccgcgccacgcctcatcgtcgggacatctacgaccgtcactgccgcagccgtcatcgccgtcgaccttaccggcgccgcatccacgacaaccgagcgccaacgacgacgatggccggcacttcttcatcctccaacacctcaaccggtcggtatctaaacccctctccctttcatctattgttcaaacatcaacccaaatagaatcacccgacctagacctaacctaggtgatcctagtgcaaagtctaacacagtctactgaccacgatcatccctaagctgtacacgctcatcagtgggcagtacaatctggaggagaccatccggcaagacatccgatccatcaagaacgagctggacatgatgttgagcgccatccaagattacagcagcttgctgatgacaacgcgaagcggagatggccgtcatcatcatcagctgggagcaggagctgtgcaggcgacatggatcgagaaagtgcgcaccctggctcatcagatggaggactgcatcgacagctacatctacgatcagatggctcctcatggctcccggaggcaaggccctgctcggtttgcatccgaggtcagggagctcaggagcagatcagctgaactatcccagctgaaccagcagtacggagcagctgttctcagccgggagtaaatcatcatcggtgacggtggtggtggtagtactctatcctctgccgcaccgttgtcgacttctccagatgagctcgttggcatggaggctcgccggggggagctcctggagctggtaaacggcgaggggcagccggagcagcagcgcaaggtgatctccatcgtcagcttcggtgggctagggaagactgtccttgccaatcaagtgtattgcgacactgacgagctgaatttcagtcctcgggcatgggttagcgcggcagagaagacagctggggaggttctcatggagatattgcagagatttgaggtgcgagtaagggacatgccttatttcgaccaactcagcaagcgtctcagggaacaccttcgcaacaaaaggtaaggctaattaatcggttttgcatttttttttcgttggtcgtttcgtcattcacctaaaacttgcatagagtgtagactaaacctttttataaggtgtatgatatataaaaactgcaattttttatacataacaactgcaacttcttgtttgctttattttttttatttttctagattaatctagaatagttttatgcttatatagtgaggataaacaacaaagtgtattctctttacagtttagtttagaacattttttttcacaatagcgacaaaaaaaatatgcatgagttattggatattgatttggtgttaaagaaaaaaagagctatcggtagacaaggaaaaaataaatcagtcacttcacaaataaacagtcccaattactatacactgcttctagaacaaatagtgctcgggcactttatttacattaggcatatgctctgtatgaatgtgcacacaattttttttttctaggagtgaagtttagcctgttaatctatagactagttcaaataagtttggattgaacttgaaactatcgatgtctttcatttgccttttttagtgcatcatattgtgagatgttcagtgcaagagtcaacaggtgggtttagggatggggttagctcagtttgtcagaatcttgttctaaaattcccaagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattctcgcaggtatctcatcgtaattgatgatataagggtagaacagtggtgtaatatggagcctgctttccctgccgatcatggtatcagcagcagaatagtggtgaccacgagtattcaatcaattgccaatgcatgcagcatcccaaaaggctacatctacaaaatggaaaaactagatgctgaatgctccaaaaacctgttcttcagaagcgcctctatcgaggaatgctcacctgacatagagagaggttcagaatcactttcggaaagaaaatgttgaattggggccncctttccccccaacccttgggggccttcctttgggaattcccttggggcctaggccagttcttgcgcacagaaggagctctaacagggcatgcaattacatctgcagcaaactactccttcgtccaaaagaaaaaaaaaaaacaaaccctgggttttcatgtccaactttgactatccgttttatatgaaatttttttataattcgtattttcattgttgttagatgataaaatatgattaatattttatgcgtgacttgtctttttattttttttcataattttttcaaataagacggacggtcaaacgtttggcacggaaaccagggtttgtctttttttgggacggagggagtaggttactatctggagaacgacaacaatgcattagcaagaatgcaagggttgcttgccaggagctatgcctgcctgccatgccatgatgccaaggcctgcttgttgtacctaggcatgtttcccagcaactacccgattcggaggagaagattgttgatgcgatggctggctgaagggcttgtcagaaaacggcctcaccctcggcttggcgacgcggcggtcaacaacttcaggacgttcatggaccggaacatcgttcatcctgtcggtgtgagcaccaacgacgaggtgaagacatgccagctgcccgggatgatgctcgagttcatcttgcacaggtccatatcggagggtttcatcacactggtttctgatgagaatgtgatgcccaggtatgcccctcgtcgtctcgctgtccaacttagcactgctgctgtgaaggacaggctaggaccaagaagtgatctctcttttgtccggtctctcatggtctccggcatagcatcccaatgtgttctggatttcagcaggtacaaactgctcaaagtcttggatctggaacaatgtgacggattgacggatcaacatctcgaaggcgtatccaatttgttgttgctcaagtatcttagcctcgggggagaagttaccatgctccccaagaagattggaacactaagtttcttggagacacttgatgttaggagagccaaggttgatgtgatggtgttcccggtcgaagcaatagtgcttcccaaattaattcacctctttgggaagtttaaacttttcggtaaggtatcggataaaatacttaagtttttcgatgcgggaaaaagtaaactacaaactttagccggatttgtcacagacagtaaccaaggttttctgcaactaattggtcatatgaagaacctgaaaaaaattaagatatggtgccggtctataccagatggaaacaactttcatttgatttcaaatgccattcaaaactagattgaagacggcgatgacttgaacgatgcccgttctctgtctgtccatttcaacgaatgctctgaagacatcatgaatttttccctgcaaggagcctgcaatctttccacgctgaagctccaaggtgacctgcaccaaatacctccatttgttccctcattggtagctctcacagagctatctctgacatcgactactcttcggcaggaactcttaactagcttgactgaattgagatgtctagtttatctcaaacttgtcgcgcaaaatctcgagggttttgtcataaaagttggggcattccaaagccttcaacgactatgcatggtggttcagaatccatcattccttgaaatccaggatggagctctgccacagcttgtgtctctccagctgatgtatgaaaatttggcaaaccttcctttaatcaacattgggggcatcaagcgtcttagggaagtggtgcttgattctgcggtaaatggaagatcacggaaaaactgggcgaagaagcacgcaaatagacccagaattttgttcatcgaaaggacgagaagggccagatcagaacattctgttgcacaggcagaaaaaccttctacacttcatcgg

SEQ ID NO: 90081 - DNA, 2048 bp, Oryza sativa
aagcaaggaaactgctatacaaggagttccctgaacactaccgttggataaccggacagaatgtgtgacagaaaaggaaaacggagagacgccaagttggacggattgtgtacactcaccctgcagaggaggagagatactacttgagagtgcttctcaaccacatgcgaggtgcaacctgaagatttgaggacagtgtcaggtacaacgtactttacctttagagaggcatgcgagaagagagggcttgtggagacggataagtcacatgacgattgtttgaatgaggcatccactttccaaatgccatctgctctgcatcgattatttgcaaccatattggtattttgcgaagtcactgatatccgtgcactatgggacaatcacaaggctgcaatgtctgaagattacagccgagggaacactaaccctgcagcagtagagcagatggtgctacgagacatacgtgatttgctttattccatggggaaggatatcacggagtatggtcttcccgaggtcattgatataggtttttttatactatcacatctttttcttattggtttacatttgcaccacccaccaatagtttcatgatgcatatatttgttttcactaatctcaggtgaacgttgcaatgacgtaatgacagagattatagaggaacttaacgtgctagtggaccaagaccatttagacatatacacaacccttaatgatgagcagcgtgcaggatttgatgagatcattgatcatgtaactaataagaagagccaggtattttttatcgacggcccaggtggcactggcaaaatatttatgtaaaaggcacttcttgctagagtgcggtctgagggattaatagccattgcaactgcgacgtcaggtatagcagcgtcgattttgcccggaggacgtaccgcacactcgagattcaaaatccctattaatattgctcacaacagtatgtgcaacttcacgaagcaaagtggcaccatggaattgcttcgcatggcatccttaattatttgggatgaagctgcaatgatgaagcgtcaagccgtagagacacttgataggtatcttcaagatattatgggttgttcattgccatttggaggaaaggttattgtttttggcggtgatttcagacaggtacttcccatggttacacgtgggacaagggcccagataactgatgcaacattgcagaggtcgtatttatgggaaaaatattaggaagatcagattgtcgcgtaacatgagggctcaatctgatccatggttttcggaatatctccttagaattggaaatggcactgaaaatactattagagatgattacgttcgcttgcctgatgaaattgtgattgcttatggggatagcgaggattcagtacacaaattgattaatcatgtgtttccctcgcttgatgatgaaaagaatgcaagctctgcatcttatatgagcacacgtgccattctatccactaaaaatgattatgtggacaagctgaatgcaaatatgattgatagatttccagggcaggccaaggtttatcacagttttgactctgttgatgatgaccctcacaacagttatcctctagactacctgaactctatcactccaaatggtctcccaccacacgagctaatagtaaaaatcaattgtcccgtgattcttcttcgcaaccttgacccaaataatggattgtgcaatgggactagactaatggttagagcttttcaagataatgcaattgatgctaagattgttggtagacaacatgccagcaaaagggtgttcatcccatggatccctttgtctccctccgatgatatatctctacctttcaaattcaagaggaagcaatttccaatacgtctcagtttcgcaatgactattaacaaatcacaaggacaaaccatcccaaatgttgggatctatcttccatagcccgtgttttcacatggtcagctatatgtcgcattgtcaaggggtgtgtcaagtctaacaacaaggattttggcaaagccaaaga

SEQ ID NO: 90082 - DNA, 2295 bp, Oryza sativa
  unsure (1)..(2295): unsure at all n locations
gggcagcgcgaagggccgggcggctggcggccttgctgcggtgcgccggcgggcggagggccgggtggcctcacagcggcgcggagggacgggcgacctcgcagcggcggtcggcgctccggcgggtggagggccgggcggcctcgcagcgggtggcgcagcagcagcagcaggcgtttctttgtttttttttgagaattcgtgattcggatctgagatgtatttgatttgtgtgtgatgtgaatatgtgatgtatttgtgatgaattttgtagaagttgtgatgtaattttttttaagattttgtgatgtattttatatgatcgatttgaggatttgaggatttggggatgattgatttaggattttgggatagggatggagtgaaatcaatatattaaaaacaacgaagaaaagaatagaataatggagcaaccggatctagctagcctagctctattgttagtactaaaaatgttctatctttagttccggttggtaaccccaaccgggattaaaaatggatttttacccccggttatttcacccgggactaaagataacgatctttagtcccggattcgtagtcccggttggaaaaccgggactataaagggttatgaaccggtagtaaaaagcacttctccaccagtgttactctcttagattggaaattatgcatgagaatcttctactgtatagattgaggggcgagatggggagggaggcaaaagaggtaaatggaggttttcacagaaaacaaaggtttttttttatgatctaggttcatgatgttcttggtgcctattgatttaattaggtaatgtttaaaagtttgtgctctcaggacatatcttagatgggagcagtggataaagaagttgcagttcattaccattggttcaaggtaacaacactagtttttttttcctatggaacgtattctaaacaaacattaatcctttctctcatttcagacanannaatnctcttnaagnnnaaattcccacttcagtatttttgtgcaatgcggttttcattgggaccaccggaaatcacttaattatgtaggaaagagatgtggaaatcctatgatatatgcaactganaatagtaatgcttccgtacctcctaaagtgaatgtgatgcaacatagatttttcgaatatttatcaatatggccctttgttctacataattagagtaggttgtatatttaacagttattattcatcgtttagacaataattgtttggtcgactattatgtagtaaagaattcacagctctacctctttgccaactactatatttggtcgaccatagatatcaacctggcacttcacttgattaaccactaagggagcctcccatgtgatgtttcataaagaggttgaattgttacccatttgcaaacaaatacgtatagattgagataattttcatgcatttttttttacttttgttctcctactgattttcctattataatattacacggtttcttttagatgaccacatttgctggaggtgtatcatccatgcaggcgcatggaccaactgaccaccatatacatcctcctttcaaggatggatttggtccctctatgaaccaaacaagttttttttgttcgagaacaactttctcaactatatgcccttataacttctctcatggttagtatcatgcttcggttcttgcatgcgccatatttcatggattggaagtagaaattgtgcttagatagggttattgatgcttaatttttaccttggcgtgcttaggccgatttaagtcctattgtatccttatatgtatcaccgtatcaatgaaagatgacaggcggagagctcctgcaggcaataaatttcctatggtaggatgagcctatcaagttctaacgggatgaaatacaccgagtttctggtaagataattggtttgccagtcatgatggatctgcaagcaatattactgcagtccttcttggctgaaaataaaaatgttgaattgctgcttcatgctttttcaggagtaaagccagagaggctggtacagggtctatctcctagatattgtgcattatctctggttgtggaaccaaatatgtatccagagataaatgttctgattgttgatctacaccgtaggcacatatctacatttcttgtcagtaatgcacagtttcctgataagattaagacattgaaaccaatcaatcatgtcatattcgaattaagatatgttttggcatttaagtgctcaaagcaacaagctttaaagatatctgtttatat

SEQ ID NO: 90083 - DNA, 1217 bp, Oryza sativa
  unsure (1)..(1217): unsure at all n locations
gcaagatgaactgcgatctagtgatgataatttgctaagagaaaaaaggctgatggaagagcttcagtctaccctcgcaagtctgacgtcacaacttggtcacaaggatcaggccctgctttcctttgatgagcacaaaacggagttaaatcgtctgagggaccaagttttggacatggaaagggcaaacagtttgatgcaagatgctctttcacaaagtgaacaaatccagatggatctcaattgtaaaaatatctcactccagtcccagctttccaatgttgaagaccggttagcaacagttatgaaggatacagtcgccactgaaactgaagctagttatatgagaaatctggttgaggagcttactgggcaacttgattccttgagaaatgaccatgaaaaactccagcttaagaacaaagatgctgatgatttactaagggtacacatgtcaactgaagcagaattagctgatagagttgctgcactcgaagcagctatccattctttagaaattgaccttgctagggtcaatgaagagaaggaagaaactgagngagctataaaaagtaacgaagaacaatttgttcaagttggtcccgacaagtctcgatatatagtagaatcaattgatagcagtgagagagttttgaagtatcaagatgacattttgcagcttaaagtcttactgacaaatcttgaagagcaagttgatgatctgaggttcacaaaagatgaggttgaaattctaaacatggttctagaatcaaaattggaggcacaacgtactgaaatattgtcattgctccagaactctggacacgaaagagtgtcatttgggccccaaacttttttaaaagacactagaaccaaggatcttactcaaaaacttgctgaacaaactctgaaggcagaagagttcaagaatttgtctatccatttgagagagctaaaagagaaggctgaagctggaaggaaggagaaagagggatcattgtttgccatgcaagaatccctcagaattgcattcattaaagagcagtacgaaacaaaggttcaagaactgaaaggtcaggtgtttgtttccaaaaagtatgctgaagagatgttactgaagctacaaagtgctttggatgaggttgaaactgggcggaaaaatgagattgctcttgctaaaagaattgaagagctatcaatgagaatttctgaaatgg

SEQ ID NO: 90084 - DNA, 2440 bp, Oryza sativa
tttcacatgcatgaatcttttgaacacctagagagaatggacatatcaatttcttcgcttgatatgtgttcctcggcagcaggtgatgcggacatcactacctcggatacacacaacaatcctccaacggtcattcaaggaccaataacaagagctcgtgcacgacaattgaatttagaggtgagctcgatcctatgttcttctttgtatgaattcgagaatagattgctacctaatgattatattgtgattaggaacaatgaagggggcaaggagacacttggagaaggacttagagccatggaggatcatcgaggatgtccaagtcaaggtggaggcccaaaccaagtcgaccttcgggtgcaattcggagtccaggaccagtctgcactaaaacgggcgcccaggtcgcatacgtgctaggattggggcgttctttatatggatggaaacctaagaagataacttttccaatggttttggtcccacgtccaaattctttccgagtcaatgggaatcgaccaaacaagttgacattcagaatctgtcccgttgttgcgtcaccgtatttgggcctttgggccgtgtatcgtgtggaacccattagggttgcgtcgagagggggttgcacgaccctaaactctatatattagtaccgccgccatctttaggtttttgggttttgcttagattattccgtcgagaatagtttcgccgctagatcgatttgtaagaccccaactcgtgagcttaatcattcatctgcaattttggttattttctatctcgttcttgtttgtgttcttcgattggcaaatagggattagccttctcggcgaggtcatccgcgtttctacacgggtgataaccagaggagacatggtgctgcgattgcggggctcaagagcgtgcgtgttcaagaagccggatcgatttgtgtcgtgactccgcccaaatcattgtttatcagaacctttcagaagatcgggaaccctagtgcacatcagcaggttcggtttaggaagcataactctcagaagatccatcaaatcattgaagctagtgtccgaccatccatgtctggccttcaatttgagaagttcaagcacaaagcacaacaccgtataatccttgtcacatcctttcgattcgtcgtaaagaagttccttcgctgctttttccaactcttcccaattgttgaaccctcgtcttgtactagttagaacctctggttcaacgtgctgcaacatatcctctagatcaaaatcaatacctgcatcatctataccaaagccaccacattccgggatcgttccctgtgacatgtcttcgattataaaattttctgccgcatcaaagcaaaaatcatcagcctcttcgttacgatcggtgacttctccatgcaaagtccatatcttgtaatcatccataaacccacgctctacaatgtgccccaaaatatcattcgggttttgcatcatctttttcgttcttgcaatcaaagaatggacaaaaaatgtcccttctattctccctcaaagcatgtgcctttgcctgatcaacaaatttatttggatgcttccttcaagaacgccggatgagttcttttttgtcgtacatctatgcccgatccatctaccaaaaaacatctttcatgagtcgaattatactatatttaacatatgaaaaaaggatacaacttaaacagacattatattaatattcatggtctagtggttccaataacattaaattaataaattaaaaattacttagaattactagatttgcaaacctaatatatttttcgaagtccactgaaaaaatttgaaataaatggagggaactaaacaaaaattaaatttaagttctacggaaaatttaaacatgcatacgatatttttaatcattaataaaaagaatgtccatttccagaaatgaaaattttcttagcttttatccgatgacaaattaaactaatggagacaaacctaaaaaagaatcggactactaaatactttaaaaatcatgtgatacaaacaatatatatatttacctattataaaagtttaagatgtttttgctggtaaatttcgtatgtcaccttgtccgactgcgtcccgtacgatttttttttgtccatggtcacgttgtccgtttcgctgccctccgcatccgattgcaattcccgcattccacgctgcgcaccgcgtccgggccatgcgctagccttgacgcatgcacgtgcgcacaaccctgacgcatgcacgtatgccctccagttcccgtgaaagcaagactgtttctgagttttatgttcacacacaactttaatttttatagcacctacctaagattcttctgttcctatataatttcaatttttaagacatgtaccctaaagttattctcttatgtttgtgcatgatttttagagaac

SEQ ID NO: 90085 - DNA, 1276 bp, Oryza sativa
  unsure (1)..(1276): unsure at all n locations
gggagataactggaagaaaaggagcattttttttgagttaccatattttaaaactctattgctacgtcataatcttgatgtgatgcatatagaaaaaaatatatgtgatagcattattggaacactaatgaatgttccaaagggaagaccaaggacaatattaatacccgtagtgacttaaaactcatgaacctgaggccagacttgcatccagtagatgatggaggaaaggtggttttgccacctgcgccttacacgttatctccagatcaaaaaaaagcactgcttagtttttttaaagaattgaaagttcctgatggattttcttcaaatataagtcgttgcgttaatatgaaagagcggaaaatgtcaggattgaagagccacgactgtcatgttattttaaatcatatactccctcttgctctgcgtggactgctccctgaaaatatttatgaaccacttgtggagctatcccagttctttaagaaattaaattcgaaggcattgtcagttgaacagcttgaagaaatggatgctcaaataccagtaattctttgtaagcttgaaaaggaatttccaccatccttctttgatgtcatgatgcatttgcctgttcatttggctagagaagctctaattggtggaccaaccatgtatcgatggatgtatttatttgagagacaaattcactacctaaaatcactagttcggaatatggctcgcccagagggttcaattgctgagggatacattgcagatgagtttatgacattaagctctaggtacttggatgatgtcgagacaaaacacaatcgtccaggaagaatacatgacacatctattggtaacaaatttaatttatcaatcttctcctgtgctggaaggccgaattttttggggggtttcttcggtaaaacnntcgcagatccttgatatgcttgaatcagaacaagctcatatttatattctgcggaattgcgatgaagtccaagcatatatcaggtatcccttgataaaaatggcatttatttatgtcatgtttcttacgattcatttcacaagcttatgtaatttctaatttaaaatgttgcagtgagtactgcaacagtacagagggttcttcaatggtacaatttacctcaacatggaacaaaaaattcatcaactggtttaaagagaaggtaatatttatataattacatatatggaataaactgtttcaaatatgtatatttgttgatgttattttttttaatctttttgccctgtagat

SEQ ID NO: 90086 - DNA, 730 bp, Oryza sativa
atgttacatcctcacccccttaatagagattgacgcccccgtcgatcaaccccaggccaggaatgtcccctcttggccacgtccgtgtgtccagtgccagcacatgtagtcggctctgataccattttgtaacgtcctgcccgcctctgataccactttgtaacgtcctgcccgcctctcccaggccgggcccgcttacatctgatagctttcatagatcatagactaccctcacagaccaatacacgtcttttctgcacactttgtcctcactcgtgcgcacccgggaagtatttcctgatcggtcacccatcccgaaattgctccaggccaagcacgcttaacctcagagttctttcgagttggtttccagaaaagaagttgcaacttgttgatatgagtattctattaatcctattaagccgtgggccgggatgttatagaacccatgtgacctcaagctctacaggtcctaccgttgatggacatcatcggccctcttgtcgatcaccaggcttccgcctcccttaaggagaaagtcacggaagaggttgttgtcgcttccactgcccctatcgtcgcagggggcagtggaaccaagaggaaaatttgggccaagacaagtggcgatgccggatctcggcagaagtccagcagctctgaggtaagacttggcgttcccctttgtccggtttttccccctttcatgaggtgaacgaaatgaagacac

SEQ ID NO: 90087 - DNA, 5052 bp, Oryza sativa
  unsure (1)..(5052): unsure at all n locations
ctctaatccaccaccgagccgccctccccactacaaccagagccaccgtcgccatttccgcctccggccgcgccgcaccgcctcttcagtccgccccgtgttgtgccgtcgccctctgcggtaccgcagccatcattcgtggctcagcaatccctccgtgttcgccggtcgtcgccggactcatctccccgtgcctcccggtgagctccgtcgtcatttcggtcggcgtttcccgccacactgcaactccctaccctctcctaacctcttcatttccttccctaggtccctccaaccatcggccgccggttcctgctcacggaacgccgccgaaccgccgtcgccgttgcctccccgaggagcgccgccgcctcttcccgccgccggcgacctcccgctctgcctcgttggcccgcatgctcagtgagcccctcctcccgctccccttccctttcgcgtgcatcgccactgcccgtgagcgccgccgtcttccggctgctcgccgccgttcggcgccgccggctgctgcctccagaggccgcnnntgcccagcaccatggctcggccgtgtccatgccccagccgtgccgcctcgtggccgtccgatcggctttgggccgatccgggccgtcggttcccgtggaccggcggtggaccgcctcggtggtccctgtccacggtggaccggcgctcttatgccgctgaccggtgggccccgcatgtcggcgccggccgcccctttgctgacgtcagcgaggaccatttcctttgtaaaaataaataataattgcgcaataaatcgagtttaattctagaaattcatttaaacggctcaaaacttctaaaattcatatctaattcattcgaactccgaattgagccattcaacttgaaaaattcatctaaaattgagctctacatgtttgtttagtttttatgtactgtttccttggtttttattagagtttttcctcgttttgcgtgccagcgtgtagaatccgtcgtttcggaagtccgcggttgcgaggaaaagagttcggaagatcaaagtgaagaagcaaggcaagtcacacattccccttgagcatgttgatcccaatttataaatattttaccgtttacaaataaatatgcatgttttgctaattacattggatccgggtattacctatctgctcgcttgtgccatgtttacttgatatctgttccttgtcaaccttgggtaatgaatcgactagctcatgttacttatgtgacctagctagaactgtatgcttagccatgcttaatcaccactagctcagttgatggggtaattacagtattagacctttttagtatcagagtgagctgcgtgctcgagacatctggccatgcttcatggtcgtaattatccaactaaaatatgactgaatggtgggctgtgggtgcatgattttgctagtcgcacccatggcaattaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttacctgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcaacccaatgcactgtagtccaggtgggttggttgggcctgttcaacgtggtgtagcgttgatcagtggagatttaatgttactttaattactcacagttttactgttttgctcaatgaaatgttttacaactgcctttatgcaaatagccacaaacccctccttgtatccccttgcacgtctgcatcgttggtgtggcttgctgagtacggtggttgtactcagtcttgctattatttcccccttttcagaagtgtagtgcttctgagctgaagatggaattagaggaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtttattacttgtcgttttgtgtaccctggctggtcctggacagggatttaatgcacaaaatagtctggaaatttaggctaaatttctgggcgtgacagtcggtcgactagattttacaatagtcccagttgtattaaaaaccaggactaaaaatatctttagtcccggtttaaagatctatttgtagtcccggttgataaaacaaccaggaaaaaagatcgccatacgctttactcccggttggtgttaccaaccgggactaaagatctatttatagtcccggttggtaaaaccaaccgggaanaaagatcgacgcggagatcggagaggtgtgcgcgatcagatcgaggtatctcctcgtctcctcaaccttatctcctcctctcatttttaactcctctgctcaaccttatctattcttcttcttatctctattcctctccttctcctctctactgccaggccggcgcgaaggcggtggggtgtggagggccggccggcgcgggggcggcgcggagtgcggtgaggcggcggggtgcggagggctggccagccggccggcgcggcggcggcgcgcggcaaggcagcggctttctcttttttttttgagaatctgagattgttgtgtaatgtatttgattggatgtgagattgttgtgtgatgtatttgatttgtgtgtgatgtgaatatgtgatgaattttgtagaagttgcgatgtaatttttttaaagattttgtgatgtatttgagtatttgagatgatcgatttgtggatttggaggcaatttgaggatgattgatttgggattttggggacgggatggggtgaaatcaatatatttaaaaataataaagaaaagaaaaaaataaagaggaaccggtaagagcaaccggattagcctctttagtcccggttggtaacacaccaaccgggactaaagatgctttatctttagtcctaaaaatggatttttactcccagtttttcccggattcgtagtcccggttggaaaaccaggactacagggggttacgaaccgggagtaataaccctttctccaccagtgtttctatacacgtatgaatagaaacaatccaaaatataatactaatactcaccactttcaatcaatcgatttctgcaccttctcctagtaacatgaagaactcacatgactgctaataattgtcataggtagtggaccgagaggataggtcataaggatagggatagagatagagttggttggataagattagactgagtcctcccctctgtttatataaggacatattgtatcattattctaattagtcactgaatcagaattagtctttcccaacctaagttcccctctcatccctagcagccgtcgccgcccggctatcctcccggcggtgtttaccccctatgaacactaacccataacaacttggtatcagagccatggctagtgaagacatgatcgaagatcctgagacacctgcatccgggtcctcaaaaggatgcaggctgatctagtgatactagtagcctcaagaaaggcagagaaagcgccaaacgggaaggaagagagccacaccgagcaaaaggtggtcatgggctccctacccgtgacaccctcatctcttccctcgctgctggagatcgtctacttgaggaaggagacggcagtggcgcatctagcacaactgtcaccattggaggccatcacgcaacaccgtcgaccaccatccttgtgacgacctcggcgtgtcttcaaaaggcatagtggcggacccagaaaaattacactgggtgtgcccattctaacgatcacttcactatatatatattttttcaaaagaaaacacctatttctgatggaagaattttggcaaattttggtcggatttttcaatataatattcaaatgtggtccataattcatgaaaaatctataaaattcataacaatcaattccataacctaatctatttagctgttcttctttcccccccccccaccttttctcttcatctagtcctttcctcttcctcttatttgatttcttgacgattacaagattaagacaaatcgtgctcattgttatattctattttttgagaggatttcatttttatatccttttgattgcatactacatcctagtgtttttcttaaaaaaaaaaaaggtatgccggtgccaaccagcacacaccctaggtccacccctgaaaaggcacattaggagcaagtcgggacggagggtgagctcccagctacagccgaaggagaaggaagcagtacgttccccctgcgacgtcatcctccagtgcacgacggtgggatattccgctgcggacaaggccgctcctaggagacccacaacatcgctgctcgccctggcaacggcggcgtcgtcgccgtcctcagcggaagtgacaacctcgactgtcccagcgacttccggaggaagcggcgtggtacgcaaaagagacagcacggtgggaacgacgcaaggcggggaggcagcacgattttcgggagaagcagtttttcgctctctgacggcgacacaatttcagaaggcggagcattgcgcggaggcgtgggggcggcacggcagttgcgcgggccacgtccactcgcggcaaaagcgtggctccaactcctggcaacgtcgtgtgcagtggataaggatccacgtccctggttggatgag

SEQ ID NO: 90088 - DNA, 697 bp, Oryza sativa
aaaaattgaaataacaaaaataataagtatagagaaaacaaaataggatgctcaaacagtaacattcacaaaacccacagaccacatttcatgttatacattcactagattcctaaagtatgttcatttgtcatcatgagatgcataaataatgtaacccctgcgacaagtgaaactaagctatttctcgaataggatatactgccaactctaaaagataattccttacttagcattaatacctaaaagcttctgtcaaaatttggatgatatcattaggtattacataaacttaaccaaatgaaggaaaacgtgcagaactgagcagaagctattgaaaaaaaaaaagacatgggtaggttacacggtcagaaggcataccatcagctcctttgttctagggtgcttcttagttgtgaaaagaacacctaaacaacaaagttattactcagtgtatgagaaaaacttcaaaccacagcaacagtcatttaactaaactatggtaccatgattttttttaacaacaaaatcaatttcaagcaaatagcaaaacataccattgtgattagacacagtgattgatggtctaatccaataagggcatctatgaaagccaaatcccctgagcatgcacctgcaaaataaaatcgcatattaataagatatacatgtagcgcatatcctcatactgaaacca

SEQ ID NO: 90089 - DNA, 1132 bp, Oryza sativa
ttgatgatgatgagaacagattacaaagagagtagtcgaaacagatggtgccgacgagatcatagtcgagggattcgacgagatctcccggcgagttgactccacgtactctggcttcgtaaattttggtgggtgtgttggcgattgaattggatgtctcgaacccctcccaaggggtccgttttataccgtggatcatcttgatccccaagaaaggtttgaggatatcggatctggtacggtataatagaaaccctatctcttccgagtaggactttggaaatcactttgactcgaagagatactttccacaacccgagtcggtttcctcgtgacattcataggaacaatccgtatacgtgaaggtatacctcatcaatatattccataagtcacaggataggaggtataccttatctataaccctgacagtagcccccgacttcaactcaaatgaattcatgttgtcgttcatgacttctctcatcagcgacttgtcgtactcactagatcgttctcggtatggaccgagaagacaaggagttattgaaaacactaacggaagtccgtctggctaatcatgaatttgaattgaagtctgaacaaccgcccttaatgggcctcaggattttcggcggcaatctctctccttcctcgaaattcgaaccattaggtagtgcgcttatataaagggattttgggatccatttcaggtccgtttgccaaaaaattctccaaccttccaacaatcttggacctttcgtctcccccagttccttaggttttttccgtcttgctctggcgatcttcctccgatggcggacctcggcatttccacctccgatctggcaacgctagcgaagctctccatcgagggggcccttcctccagagcaagacatggctagagaagaaggaggtactgccccctcccctgccctaggtcatatggtagtagtagaagatttcgttcgtagtgtctttctaccgctgccatcagaattccttttgttggtattgaacttctacggcctttctctcttgcacctcaaccccaactccatcgctttcttgagcatttttacccatttgtgcgaggcctacatcggggtagtgcccttcttgatcttttt

SEQ ID NO: 90090 - DNA, 1434 bp, Oryza sativa
aaaagactattgatttcaggtcactatgctgctccttaccatcatttttgctgtcgtccatagtggtatggcaagcttacgtgaaactggtgagaaaataataggggagagagcttaccgtgtaatgtttgctggaatctcactgcctttagcagttagtactgttgtaagtgcttggcatacctttttttggacagttggcatctcaatggctaagttcttctgtatcttagaacgttgtcctttcttgtaggtctactttataaatcatcggtatgatggcattcagctatggcaagttcagggtatttcaggcatccatgagcttgtttggctctcatctttcatctcattcttctttttgtatccatctactttcaatcttttagaagtggcagctgttgacaagccaaaattccacatgtgggaaactggaataatgcgcatcactagacatccacaggtaattccaggaggccattttaaagatacttgtcatggaattctttagtgatattagatataaacctatgttttttatctgttatctttccttgcatatgttttgactcataacatataatatggtttgctttatggtattctatagatggttggacaggtaatttggtgcttagcccacacgttatggattggcaattcagttgctgttgcggcatccgttggattaattggtcaccatctgtttggtgtttggaatggtgataggaggctggcatcacgctatggtgaagcctttgaagttctgaaaaagagaacaagtgttattccttttgctgcagttatcgatggaagacagaaactacccaaagattattacagggagttcatccggttaccatatctcgcaatcactgcattaactttgggagcatactttgttcatcccttaatgcaggcgtccagctaccaactcccttggtgattggtgtacataacaatgtccacaaagagaacacgatacagaaatagtgactttgtactttgatagacctgatagcctggccttgcattcgttattttaatactggcctgctcacacttgttgtaaaagaagactaacgaaagagtaccaggttgatgtagatgggagtattcaagacaaatggattgcacgttgccatgcttcctgaggacatctctatactcattagttgtgcatctataccaactagtgagcgtgcacatgcaaggcacgtcacggatagacatatataaccatataggcagagtaaaagtttttgttacgtagatcgtgcacaaaagtcatgttaagcattaggagtgccaattggtgtagcaaatccctttttatttgcctaatattttgtgtgttcatttgcctcttcaatggcatttttaatgtcatggacactcctatggaagaatcattattatccgtcgctattttaa

SEQ ID NO: 90091 - DNA, 2233 bp, Oryza sativa
aatttcctccaaaatccacatgcaatgtgccattccataggaatttcataggatttgaaaaacttcaatcctttgaatcaaagggccaaatagaaaaatttcctatagaatttgaatcctatgaaatttctacataaattctttgattcaaagaggccctcaatgccttaaccccgtgctattcctagcattgggtccttcgaacaaaactgtgggctgttttgctcctgctgcctcgattcaaaatcatgtagacaaaatgcagagtattaattacaaaatgatatcagcagcagttactcagtttagcataggatctaataaaataaaatgtttgacactttggataagcaaaagaaatcatgatatgtcttcctaggtagtgataaacagcaaagccaacatactcatttaactatttcctgagaaacaacaaaattggcaagttctaaaagacaagagaaaaaaaaatccaaaaatgactaccaaaatataccagtggagacgtacttaaattgtttatctggaaggtttaggggacataatggccatgaccggggtgtgggccgaacgcgatcacgatgcggaagggatctcaatatagataactatgctcacctgaacaatgcatgttcaggacatcatatcaagcagaagagagtcaactgaggcatgctacttctcataatttcatagcttccctgtaaagaaacaaacagaacaattaaattttacatgaaccaataaaaggtcaactgtattgtgtagaagaaattcttctaagtttaatatatacataacaccgaaggaatcaacacatgcatgggcccctttaaatcacaggattgagaaaacagaggaatagaaaaaacgtaggaattgaatgccacacttactgaattcctatgggattttgaaacacaggaaagtcttcgaactgtcgtttgattagcacacatgaaaaacgcaggaaccttagacacatgaagaggaaaacatgaggtgagacctcatgcttattttccttcaaaattgctctagtaaggttcattccataggaatttcaaaggaattgataggaaacaatcctttgtttcaaaggactctataggattatttcccataggataaaatcctctagaattcctatggtttttcctttgattcaaagggggcctaaaagtgcttgtatttatctattaaaaatgcttgtgaatcaggggagttcaggggaaatttagtgcactccgcacacatgtaagaattgtacatcagtatagaaacttgcagctaacaacgaattcatatggaacggcaaaaactcaaattattttgaggtgtacatcgaatgcagagctttctttcggccaattactttcttcttatttcactattctctcagaccatttgtggcaactttcgagcagattttgttcagaatcatcaaatattcgagaagaaattcaactttgcaagcaattaacttctgatgataaattgaagagaaaggggagatgatttaaaggattcactcagattggccatagaaattatgtagaaacctgtagtgagtaatagattggatttaaatatatctttgtgaggtatttaacttctaatgatgaattgaagagaatggcggtgatttaaagatttcactcggtgaaggttggtcttgcaaaattatgagataggcctgcaataagcaagagaacatttatttgggaagaaattcaactttgtaagtatttaacttctaatgacgaattgaagagaaaatggtggtgtgcttcactgagacgggccataaaaaaattactcctattcagagactgacggagcgtggggctcctcaccgggagaccgcgcaggcccccctttgccggttcggccgggggcgctaagcgagtttcttcgtcctcgatctgtggaatgttcgcgagagagcaaatgcacgagacacgggcgatgtagacaggttcgggccactgagaagcgtaataccctactcctgtgttctggtggatctgtgtgtgaaggagttacagagagccggagagcaagagagttcaggctctagaacccctcttcctctttctctcctctacgagctcaggtattctccgagttgtcttcttttttctttttctgctttggtgggcaaggtcctccttctatatctcaaggggataccacatgcaccacttctacctactcttcttttgggtggaga

SEQ ID NO: 90092 - DNA, 2537 bp, Oryza sativa
gagctcgaggcgcgggcgaaggagctagacgcaagagcgcatagcggcggggcggccgcgggcgacggcgacctagccgcccgcctcgcagccgccgaacacaccatcgccgagctgcagggcgcgctggactcgtccgccggggagagtcgaggccctccgcttggcgggcgaggtagggcccggcatgcttcgggacgccgtctcccgtctagaccgcgccgggcggcaggcgggcctctggggcgggcggtgcgcgaagtacgccgccaaccaggggggcctcgcccagctcctctcagagatggccgggaccctccagcgactccccgaggagctcgaggagacgatcaagtcatcctcgagagaactcgcccggggggcggtggagctcgtactggcaagttaccaggccagggaccctgacttctccccgtgggcagcgctggacgagttccctcccggaaccgaggacggcgcgcgcgcgcaggtccgggacgccgccgaccacatcgtccacagcttcgagggtacggcccctcggctcgcgttcgccctcgactccgacaaggagggcggtgacggtggtgcggacgacagcgacgacgaggctggcgacccgggcgcgtcgaagtgagcccccaggcccccgccaatcttaaatagctttttctttcttcttccgaggccttcgggcccccttcttgtatagactaatttaatctgcaatcaaataaagaggaaatttctgtgtcaattctatttgtcgtgtgtatgagacgaggatggtctgtgccgcggtccttctgtgtcttggcttgaacaagggctcgtgcccaggtcccagcctcaaatggcgcgggtcggggctagtgcctggggagatccacatgtcgagactggcaggccgggagcgcggtgaccgagggttatgggtgacccgattgtgggcctttgccgattcccccccggagttcaccatgccccggggcgcggctcgattctgggccccgtttggcgatttccgccggcccgggccaccgagggcagggtcgagcacgagcgtgctaattcaagccaagattcttcaaaaggaaacaatggcacagacacagtccttaggaaatcgaaaaagcttttattgaaatacggaagagaaaaaagataagtatatacatgtggtagcccccggccaaccctgcatgcccgggggggtgcggggttggcccgagcccgagacctgacacccgacccccactaggggtagaagcgacgaaggtgttcgatgttccacgggttaggcagctctgtgctgtcgcccgtggccagccgaacggagcccggccgggggacgccgatcactcgatacggaccctcccacattggtgagagcttgctcagtccagctcgcgtttggacgcggcgtaggacgaggttgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggaccttagggtgagctcagatgggaggaccgcctccgcgccgtagatgaggaagaaagtcgtttccccggttgctcggcttggcgtggttcggttcgcccagagcaccgctggcagctccttgatccacgagtcgccgtgcttcttgaggatgttgaaggtcttggttttgaggcccttgaggatttccgcgttggcgcgctcgacttggccattgcttctggggtgggtgggggaggcgaagcagagcttgatgcccatgtcttcgcagtagtcaccgaagagcttactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacaacaaacggccacgaaagaggtatggtctgcagggcctgggccggctgatggggttgcctggcgtggaactggcacgccctgcaccgccggaccaggtcgaccgcatcgttgagagctgtcggccaatagaaaccctggcgaaaggccttgccaaccaaggtgcgtgaggcggagtgggctccacactcgccttcatggatatcggcaagaagctcgacgccttgttcccgaggaatgcacttcaggaggactccgttagccgcgcgccgatagagggtcccttccaccagcacgtagcgcttggagatgcgctggacgcgttcactcccttcgcggtcctcgggtagagtcttatctgcgaggtacacctggatctcagcgatccaagcaatcaatctaagggagctgggagcgctcccctcgggtcccg

SEQ ID NO: 90093 - DNA, 1331 bp, Oryza sativa
agctcatggaggaggtgtactgtacgatgagaaaaccgagacctatttctggtatggggagaataaggatggcaaaacatacaaagctcacagcaagggagctgatcgggtaggttgaaaattttcttatgctttccatattttgacatcatttatgtgtgcaagagcttttgacatgagttagataggagtagtcacttgggtagcacttctcacagaacctaaatctaatacatgtagtatgcatgtttctttggagtagtgtgtgctaatggatggaccaagttttcctgcccttttacattctgttggtgacaccccattgatagtggacatgttacaattatgttatgttggggaggtacggaaaagcctggcttgtgtcaaggcaggccactaggaatttagtctaatatacatagattgcagagatgaaaagaatagataaagagcttcaaagtgacttcaatagtgccatggcatctgatattgttaactaaccagcatgattggaaattatgtctctgggttttagaaatgagcaaaagggctggttctgaaaaatgggtttttatctgttcagtaaggattccctatgtagtgctttacttggttgtcctgatatgcggagcactgtctctagatagatagggaacaatcatcattttctgtctcagggtgtgtttagttcacgccaaaattggaagtttggttgaaattggaacgatgtgacggaaaagttggaagtttgtgtgtgtagaaaagttttgatgtgatggaaaagttcgaagtttgaagaaaaaatttggaactaaactcggcctcaagagcaaaatgcaccatcctgcagagacacgtagtatttcagagtcaaagtgacatctgtagcgtgtcagagctagtggtgtcagagttagtgactgtcattgtaattaattgtgatattctgttatactgttctgtatagatttctgtgcgtccctatgtcattcctaaccatgataacctttttcaggttgacattgtgggagtaagttgctattcatcaaaggacctgtggacgtggagaaatgaagtagttgttctacgaggtgagaaaaagaatgtgacacatgatctccataaatccagatgtactggagagacccaaagttatatataatgatcggtgtggcaaatatgttatgtggatgcacatagacgatacaaattactccaaagcatcagttggtgtggccatcagtgactctcccacaggcccattcagttacctgtacagcaagcagccacatgactgtgaaagtagagacatgaccatcttcaaggatgac

SEQ ID NO: 90094 - DNA, 778 bp, Oryza sativa
cgtatggcagcttaaatgcatcaaattagatatttagaagctacctaaatgagtgtacaaagtacaaacaactctccaccaggaatttgatatagttaaatgagtgactaaagaatccaaattctttgtatgtttgcccaatttagttttggggccacttcaaatttcacaatctttccaagcaacattatcttgcaattttcagattaacatcattatgaacaatgatgcaatcaatgaccataaacattgagtggtctctttacaatttctgtaacatatggagtggttgattcttaacccaaaaaattcagcagctgagaatttagaaagaaagataaaaaggaaaagacaaattaggtctattcaagatatatacacattacaaatatcagccaaatttccgggacctaatatggccggttttcgaagctaggggtgaaaaaaaaccggtattgtatttcaggggtgaaaaaaaaaactttgagcaaagttcaaggatcaaaaagactttacccaaacaaataatacatgatgcacaagtaacattaccagttttctatttggggggtgattgaatttgcaggtcatcccaaacctacatagtccagtcctcatataataactgcagtctggctctcctatccgctcagggtatggagtggactccatagactctcctcctcctaaagtcatttgccacattgcttctgcaatatcattgagaaacattgttaacaatcacttggcatgactggtatactagagacaaagagca

SEQ ID NO: 90095 - DNA, 2117 bp, Oryza sativa
agtgtgtcatgcttctaagagtaaaacaaaattgaaaaggatgaatttacagtgagatatggtcattattcattgtatacaattaaaagtatacccttgcacaatagaatatctcctagacgatagatatctttagctatgtgttgttgatataccatccatgagtattctctattgaaaaaaaggctgtctaagacggtttatccaataaaactttcttcacaaaacataagcctaatgtaccattgatacactgcccaacagaatctgattctccttattggcagcttcatcagtattcttccaatcatttagtttttgtagggaccttttagcatcataaacaccataaactttataataccacaccatccttgatacatcatcctgcggtgaatttatctccttccttttgattgtcttatgaagttcacagaagaattttggatcttgcagtttaatatactcacgcaatacaagctcgtggtgaggcacccagtttctagggaaaggtgtgtagtcacacgatggaattgatgacatgcgtgcaaattgtacaccctcaataatatcaactagtcccattctcaagagatcagagtattctggtgcatcattccttgtgctctctctcaatgggcggctaaggtcacgtgaggcaatctttgtaaactttagctcgagacttgagtctataccttgccgcataaagctttgccaaggaactcctaatgacatatgcacagaaccctacaatcttcttccggttgtctgcatatctgtaccaatcagccatggtctcaagaaatttgttcatctgagagttagtgtgcgcctgcccagagtacagcattggtgaacatggcaatggctcaggatccgatccccctttacaagttcaagcttcctgaaatgccttatgcacctctgaaggcttgctgttactgataataatgtcccaatacctttctcactcacaatgttccctccactagcggtatatcttaaggttgggtagatgacccggcgggtgatcacatgatccaagaactcaatccctcttgtgatgtgctcaatctctaccatcgaattctcaggcctcaaaccaaacgtgctctcgcagaactccatcagttgtctccttatctcaactgcgtcctcccttggtcccctgatcccaataagaacatgggagccaaatctaaggtaatccatcttccttgtcttctccttcccacttgatgggacaaactcaggccaggcaggattatggcatccttcatcacccgcctccttccaaatcgaatcatggcttgacgggcggaagtactcatgaattctctcctcgagccaccaatccagttcgttaaggcacacattggcaagcaaagggctaatatcccacaatgcccataattcggtgcatggcacgcctgttctggggcaaacccgaagaataacctcaaccaatacggatcaggcttgggctcgttctcattgagcaccttcttcttcctgcttttcctgagaaccttcctcttcagcctcttcttagctaggccatcaagctccttctcccgtggtggcacagacccaggccggacaggggcattgagcgccgacttcagcaaagataagaccttgcggtcagagacggccttctggacgcaggagagtatggtataaggcgagagtgcgtcgaccaccccggtgaggtccgcggagatgaaccagaggtaggcggcgaagtgggagcggacggagcggatggcggtgtggggcccgcggccggggcggaaggcgtgggacttcggagagaaacggggctcgaagacgggctcgaggagcaggaggaggagctcctggacgacgcggtcctggaacgggggcggcgcgttggcgaggcgggcttcgagcttgcggcgggagatggtgacggtggaaggggggtcggccggggagcggatgaggaggtgcgtggaggcgccccaggggaaggcggggtggcggcggagggcggcggcgcggaggcggaggagggagtggagggtggggagctggacggcgtggcgtggcgggaaggagcccgtggcgtgggcgcaggctcgctggtaaga

SEQ ID NO: 90096 - DNA, 1422 bp, Oryza sativa
acatgggcagagctacattagattaggcgggtgctcaggaacctggtcaagcaattgttttagctataatctgtctattttcaccatatgtgcaccccctcggttcaaattcaggcacccgcatcagcctaaactcggtccaaagtagagcaaaacaagcgagtggcatccctgccatttagttctagctccgcccagtaggtgggacaaaaacctaggcagaagtatcttgcatagtaagcaagcccccccataagcctttctttagtactagtatgtattcaatttctctgtaatattcaggatcaaaccagttatttctctaacttcaatttagtggagtttaactactacagctttttgttgattgattgagagctggagttatttgagttgaaaattggatatctataccgagtaacttcattgtgtaaggtatttggtgcatatttcccttcctagtgtggtagtacagattatgaaaagtttcttttagtactaggttgacaagctcacttgcaaattccattactttctgctttatcaagttttggtacgaggaactggatttctgattattgttttttgtggttcatgcctgttagtagttccaataaattataatacttgagtaatctgtaatttggtactttttgcctatcgggggatgctaccctaacatctatctctttcctgctaacagggagaacctgtctgcacattctattctcgttacgggatctgcaagtttggtcctaattgcaaatttgaccatcctatgggaacccttatgtatggaagtgcaacatcaccaagaggtgatgtgtcatctatgcattatcagttgtcaccctcaccagggcatccaggaatattgcttgatggaggctctggaaggtctcaccgggttcctcagtctgattcccagcaaataccctctggcgatgggaatgccgagagagaggcatcataagccctcctcggcctttcctcatgctacctcccattcttgactcttcagtaattatctccaacaaattcaaagagctgaagctgtacaggtccttgtccatcctttttctgcttctctgaatcaccacacaccggtgcttcatcatgtatcacattcaggcaggaaaatgttcttgcttgcccctccccgccccaattcctgcatgccccgtgaaaataaatggggcaaccattcttatttatccctaccatatatacacacacaagatacactcacctcctgacactcggttcggcgaatgatgtgccttgatccctctgttgtagttatacaggtggcctgcagtggacaaagcttaccaaactgactgtattggggattctgtttcgttttgctcttcttcctttctaggcattggggagtaagcgcaagacttgctgcttgtgcaa

SEQ ID NO: 90097 - DNA, 999 bp, Oryza sativa
acaccaccctccaaatccccacgccgaccgcatcctcctcccgaagatgccgctccaccactctgacgtctataacccccctcccaccaccaccaccaccaccaccaccaccacgcacctctcccctccccgccgccgccgatggcctcccatctcctcctccgccttcccgcccctcccccgcttctcctacacttcccgcagcggcgagtgaccctgccacagagccgggtgtcccccacggcgccgctgctcggggcccgcctcgtcttctccccagcctccgccgtccgtccggcccgggcgagggggtcctcgatcggcggcgcgggggaggacgactcagacggcgaggtggacggggccccgcgcctcgtcggggaggactcggcggcgttccggctgggcgaccagcgggtggcgtcgtgggtctacttcggcgggatactcgccgtggtgctgtgggggctcaacgtgctgtggatcgacccggccaccggggtcgggaccaggttcctcgaggccgtcgccgccgtctccgacaaccacgaggtgcgccggtagatatcgttttcccttccagaaaattgcttttcgcttctcttgtgttaattagtgtactttgagaggagagcctctttactttttttttttggccaaacctaatatttctgcgttttatatactgaattaataattcagtatggactaaatatgcatgcttttagtcaacctgtactgactagtgaaatgacaaaccagtgcagattccattttgatgctctgtggcatgtaggtagttcaacgctttttagtttggactgccaatgaagcaattgaatgtgatattgatttcttgtgtgcttctagtttcggtaattcaaacataaattggaccaaataagacagatcaggcttgatgcttgtgaaactgaacattccctccctatatttacatgaaagctataaactgggtatatggcaaactcctatttatga

SEQ ID NO: 90098 - DNA, 713 bp, Oryza sativa
tgtgaggcttgcgaggttgcttcgattacacacaactgtggcacttagaacctttgacaatggaaaacttaggaattaaatacatgctggaaagccgagacatcaagccaaaattaatatgacataaacgtgagtgccaaacattagcctcatcatccacactaccacaaatatggttcacagacttattgcagaaatcagaaagggaaaaacggaacaggcctctagacacaactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacctagcccattaggacggtggaaccccgtgcgacctgataagaagaaagcaatgagatgtcagcacaaacatgtacattggccccagtatcaacccaccaattagtagactgattaactgaaaaaacagtaggtaaattaccatacccgcttccatctccagtgttgccaatggtcacattagcagacttagaagtctgccctacaggtgccttcatccccttgcgttgtggacacttcctagccagatgaccaggttgcccacacacaaagcaagtcctctcatcctggttaggattgttgttgttctt

SEQ ID NO: 90099 - DNA, 620 bp, Oryza sativa
cggtggacaggttgcacggaagcggcctatggaacgaacggctaagatctaatctaaacaaaacggacggccgagatcgatcggatctaccacgggtctacggctgatgtggagctgatgtcgacgaagacgtcatcaccggcggtggctcgacacctcgtgctcgccggcgaatgacggcgcggcggcgcaaacggaccacacctacgggtagagggcgacacggcgaactcaccgagggctcgaacgacgacagacggcaaccgacggcgacggcagcgaggtcgaagcggcgaagacattcgggtcgacggcgacggcgatgctccggcgatcttcggcggaaacggagaacgggacgaggacagcgacgacttggtgaacacgacagcgaccttcccgagcgacgatgacgaccagagcagcagcagcgcacggctggacttgcggcggcgcacgggctaacgcggctagagctctaccagcggtggagggctaaggcgaaggtggcggcggacgaaggaggtctcgggggtcattttataggggctagggggcagcggctaggcccaagacgttcggcgtcggcgatggaaggtttagggttagaggagagaaat

SEQ ID NO: 90100 - DNA, 2051 bp, Oryza sativa
tgaggagggcatacctcggctcggcgcagaggcggcgtgcaacgccatcggtaactggggaaagccggcgtcgagcatcacgcacgtcgtgttcgccaccaccagcaccggttgcctgcccagcgctgacgtcacgctcatcaagctcctcggcctcccgctgtcgaccaagcgcgtcatgctctaccagtccggctgcttcggcggcaccacggcgctgcgcgtggccaaggacatcgccgagagcaaccgggacgccagggtgctcgtggtgacatccgaggtgatgtcgctgatcatccgtgggccctctgagtcccacgttggcaacctcgttgcccaggcagtgttcggcgacgccgctggcgccgccgtggtgggttgctgccgccacccgtcgtccaccggcgagcgccccgtgttccagctggtccgggcgtcgcaggacgtgatacccggcacggacgacgctgtggtggtgaaggtgcagcaggaaggggtggtgatcaccctgcaccgcgacctgccgctccacgtctccaacgccatcggcggcgtggtcgagagcgcgttccgcggggtaggcacgacggtcaccagctacgacgaggcgttctggttgttgcacgccggcggaagggcggtagtggacggcgtggaggagaggctgggcctcggagaggggaagctggcggtgacgagggaggtgatgaggcagtacggcaacacgcgtagcaccaccatcttcttggcgatggaggagatgcgaaggaggtcggaggagcgagggatggcgacggcgggggaaggccttgagtgggggatgctcatggccttcggccctggactcaccgtggaaaccatgctgctccgcgcgatgccacgcaattaacgtgtgaaatcggccagcacacgaataaattaagcaccaaggtactctacatgttaccagtacagtgctgttacatgttacacgaataaattatttccagttaactgctgcttattactgcacggttaatttagatgttgggttcggaaccagctgaagtattgtgtggacgcctggaacattattgttccatacggaataaagttatgcatgatcaattctaagcttgctcgtctggtcgatcggaaagaacatttctagcacgattattgctttgtatggttagttcgacccttgcaagaaatgtggtgtctgtcagcacctgggaggtataataattttctgaaccttcgtttttgttgtccatatatatagtttccatactccggtcgacgtcacaagaaaaaaagtaactgaaaacgaagtaagattactccctctacttcagtatatcgtgatatccgatgtacaactctgatcactactgtatatattacgtaaccacatgtaccactagctagtcaatggtttggatgttattacagcaaatccttagttaaccaagctccctagctatctcagcgcaccttgtgttgctacagggtaacagtgtcgggctgtgcatgcgccgtccgatgctcccacaccgcttccatccactcgtccacgtatattctctccacaaccatcccgtcgccctaacctccaactcccgatccctgccgccgctcattccagttgaggagagaaatcaagaatcctgcctttccacagcgccttacgacggccgccatctttcttcccatcctcctctcctctcaatctccctcttgttacacatacgtcaccgcctcctgcctttcgagttgctctagcacgacagcgagggggtcgatccagtgaagtgtgcttgatttggtgaaccggccgatggcgaggtggccgatccggtgcgcaactctttgatatagtggcgtgctactagagatcaaagttgagacttaatctggtgccatggagttctatcttcgctgcgaggttctcctggcagcgattggtcgctcctgtctggctattggcggtgagggtgaacgggttaactttgctagggttgtcagcaccaccaccgtgtactgcttcctccatgggctgcaggaat

SEQ ID NO: 90101 - DNA, 703 bp, Oryza sativa
tagaagacttacattcacaatgcgagtagcttctccaagtactttcttcagctggcacacttcctcatcttctttttggcgatttatgacaatgccagaaacttgagagttctcgtcccaccatttgagtaagataggaggacgagagtcatcagctgcctttatgcggagaatttcttcttcgtcgccgcctaatggacctgatgcattcccaagacattagacgaacaagctggagttattcagaacggcatcacttgagaatatgagttacctgaggatgtgcctagttgagcgtgaggtgatctttgctctttatccagagacccaatcaccgagtcattgccagcttttggtccttgggaagttgtcgcttgtgctccagcttcaggaatctcttgatttagacccacatccgactggtttccagtcaggggttcttgggttgttgcagtttcagttgcttccgactggtttccagtcggtggctggtcactcggatcggccttgtcatccgaagcatgggcgccagtcggctggtttttggcagtcggctggttttcggcagtcggctcagtgtctttggataaatttggctctgtcacagccggatcaggatcttttccagttggatcaatgtcggatggtttcctgcaaagtgtcctttcaacattcagcgtaatttctatggggctgcaggaat

SEQ ID NO: 90102 - DNA, 664 bp, Oryza sativa
tacaccgctttcagacaaaaggcaagttggcaccacgcttcgtgggaccgtacaaaattttggaacgaaggggagaagttgcctatcagctagaacttccatccactatgatcggcatccatgacgtgttccatgtgtcccaattaaagaagtgtttaagggtacctgaagaacaggctgattcggaacacattgatatccaagaggacctaacatatgtggagaagccggttcacatacttgacactagcgaaaggagaaccagaaacaaggtcacccggttttgccgagttcagtggagtcatcattcggaagaggaagcgacctgggaaagggaagatgagttgaaagccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatttgacatgtggaatttttcttgagttctacatgtcaaaattcattaacaggatttttagtggaattttcagagctctagaaataatttttaaccaattaaaaatcactaaagtgcaattgttaatt

SEQ ID NO: 90103 - DNA, 664 bp, Oryza sativa
agcaatccaaatcttatgggcagtttgaagatgagaaacacggtcataatccgaacgagaaatcccactcaaaagaatattgcgagctttgtaattttgttcaaattcagtttttaaaggagcagtattaatttgttcaggaatcacataaggatttgacttttctccgaatatcataatcctcagtcataatgtaagattgcatcctactacaccatgagaaaaatcagttccatcgaaaacatgaggcttagttgaaaacctagcagccatggcaaaaactctagaccggttaaaatccaaagaagaaaacaaagctctgataccacttataggatcgaatcacaataactaagccaaccagaggggggtgaatggttggtatacccaaaaaccgaaaacttttagcggaaataaatgttaccctcaaattcgatggattgcggtctgaccgaagtagatgcgctggtctgaccgcctaaatacctccggtctgaccgaggtagtaactcctgtctgaccgcctggatcagctcccgtcgcctgctgccaccgccggtctgaccgttgcttgccgccgatctgaccgccagtgtgatgccggttagaccgccgaaacccgatgaaacacaaatcgaagaactcttaaaatagatgacgactt

SEQ ID NO: 90104 - DNA, 658 bp, Oryza sativa
ctgaggcttcgacttctgctggtgtgtatcctttggtggcaaggaaggagaacgtgtggatcgtgaattctggttgttcgcggcacatgattggtgataaaaattggttctcctccgtcaaaaaggcatccaagactgaatcgattatctttggtgatgcttctactagtgccgttctcgctacaggtttggtaaaggtaaatgagaaatttgaattgaagaacgtagctttagttgaggacttaaagtataatttactttcagtttcataaattgttgatgaagattttgaggttcactttaggaaaactggaagcaaagtttttgattcttgtggtgattctgtgttgaatatttctcgctatggaagagtgtttaaagctgattttgataatcctatttcacctgtgataacatgtttggttgctaagtttgataaagatgtgatgttttggcattgtagacttggacatgttggttttgatcatctcactaggttaagtggtttggatcttgttcgtggtttgcctaaacttaagaaagatcttgatttggtttgtacactgtgtcgtcatgctaagatggttgcttcttcacatgctcctgttgttttttgtgatgacggatgcacagggacagctattacatatggacactg

SEQ ID NO: 90105 - DNA, 5389 bp, Oryza sativa
aaactataagatgcgatttagcaaaattagtttggcctagaaaaaataggtaaagtgtggcttacagaaatcctaagctgaaactgaaattgaatggcctagcaatgaggcctgcatgtcacatgctcgctggagcagaaatggatgtggccgggcctatggccagatcaggcccataagccaggatgccccatttaattgcctgttgggtgacaattatggaataagttcatccgaggtcccttaactttacaccgaatccgattcgtccttatacctcaaagccagatacaatacgtccctaaactgtcaaaaccagtacaaattaggtccctcggcggtttggaaggcggttttgactgatgtggcgcttacgtggctggtttgactagatcttcgtctcacgtggcattgacgtggcgcttacgtgtcaattctactccggaaaaataataaaaaccgtgggcccacctgtcagttacacaaaaaaataatgtaaaaggtggagcccacgtgggccccatatgtcagcctcactcctcccttttctcttcttcctcatcctcactcctctcttcttccatctcctctctctctctctccttgctagggagcagacgggcaggtggggggcggagcgcacgggcggctccttcgatggccgctgtgtcacgggcgactgcgccagcgcgctgtcctgctccgcctccggcgagctgcccaccacgctgcccgagtacacggctacacgctcggctcccgacccggcaccggcgacgacttcctcgacctgtcgctcatcgacgggttcaacgtgccggtgagcttcgagacgaccaacggcggcggcgccgggtgcagcaaagggcgcgggccgagctgcgccgtggacatcacggcgaggtacgtgcccacccgagctctgtgtcccaggcggctgcgccagtgcgtgcgacaagttcggcggcgacacctactgctgccggggccagttcaaggtctgccctgttggcgttggcagacacggtagctagctggatgaacaaaagaagacttgctacatgcacaaagctaactaaccgatatacttgctccactagcatgcaggacatgcaagtacttgctcatgcaggacttgctacatgcccgccgacaagctactccatgttcttcaaggggctatgcgcctcgacgcctacagctacgccaaggacgaccagaccagcaccttcacctgccccgccggcaccaactaccgcgtcgacttctgcccgccgacgagtggcgtgacggccggcgacgacgatggtgtgcgtggccacggcctcccgcggctgacctgccggatttgtgcaaccgcggcggtggtcctcgtcccgccgcaggccacggcctcccgcggctgagctgccggatttgtgcatccgcggcgatggtcatggtcctcctcctgccgccggccacggcctcccacggtggagaccgccgtgagctgccgaattttcgtggcttcggggtcggtcttcctttcctcccaccgccggccacggtgaagaccgctattgagctgtcggattgtgcagccgcggtgactgtcctcctcccgccgctgttcacggcctcaagaggagcatcctggtggaggcgtacgccgcggcgcacgctgagcagccgccgacagcccgcctcgctcgcctgctccggcgcccacctgcccgtccgctcccgggaagaagagagagaggagagggaaacaaagaggagtgaggatgaggaagaagagcgaagggagagggtaggaagtgaggctgacatgtggggcccacgtgggccctattatttttaaattattttttatgtacctgacatgtgggtctacggtttttattattttttcgaggtagaattgccatgtaagcgccacgtcaatgccacgtggaacgaagacctagtcaagccagccacgtaagcgccacgtcagccaaaaccactttccaaaccgccgagggacctcatttgtaccggttttgatagtttagggaccagttatatctggttttggggtttaagaacgaaaatcggattcggtgtaaagttaaggatcctcagatgaacttattctgacaattattgcaaaatgctacaattgtcacaatgatgaaacaaaagcctactccctatgtgccaaaaaaaattcaaatcctatgaaaccaaacactctccatcgaatttgttcttcttaaaatatagtgctgaaaatctttacccttttcctgttctgaaataaacttatgtggataaacttggaaggtagcccgcgcattcgcgcggaaatgtatcttaggctacgctgacaaatttttaatagtagaatatcaaccgtatggcgccttccacgcattaaaaataatatttcttaacaattttttttcatcgatattgcttagataaattttccatgctatttgttagctttatacaatataatctttaattcatccatatgtgcaattatttgtttcgaaaacatttataacaaattatgtgtaaattgtgattttcctttttttagttgaatgtttagggtctcttttttaacaaaacctaaaaggatattattgccaatgcatatgtttatatgttttatttgtaccaacaagctaattggttcacattgactcattttgttacctgcaatcacgctagagggatgcatgacatagatccaacaacaaaatataactaagcgtagatgatgcatatagtatgtcgctagattgttcaattgtggcaaaaaataattagcaaagtaaaaggaaaaagtataaattacccctggaactatcgcggtcgaccgaattattcctctgaacttgaaatacagatatcgctcaccctgaattttcaataccagacgaattacccccctcaacccattccagagcggttttgtcctatgtagcgtacgcgtggcagctccaataagtattttcttttttaaatggtggggcccacctgtcatcctcatctttctcctcttcccctcttcacctcttcccctctttctctctcactctctctcaggcatgggcacagatcgcgcagcggcaagcgttcggcgcgcacgacgacgggcggtcagcgcaggcgcagtacgaggaggtaggagccctctttttcctcttcccctcttcccccccctctctctctctctcgatcgagtgtcgtcgggtgcgggcacaggttgagcagcgcgagtggtctacgcgcacggcggtgagcaggggcgggcggtggatgacggcacggtacgtggagacgggagcggagaactccgggagggagccggagtggtgggcccctgcctccatcaactcccatcctcctcctccttcatggcgctcgctgtcgtggcgctggcggccaccccggtggtcaccgtcctgaagggcacccccggctgggtgtcctatgtcggggacgggtagcttcaccagtgcgccaagtgggatgctgagggccggcggctgcttgtgtcaaatttcttcgatgtcggcgtgtccaagctctacgccgccgggacagcggggaaggagaaggaggaggagcgggttgtgtctggcatgtatgagctccaacgccaccgggagggtcgcgctggggttcaccatcgacacactgaaggggcgctgctcattgtctatgctgaccggatgccgcggttcgggtactccgcccacaactccggctccctcccggagttcgccgctcccgcctccgtttcctgcgccggcaccgagcgcacgcgccgaacgcttgccgccgcgtgacctgtgcccacgcctgtgagagagggagagagaatgagggggagaggggaagaggagaaagaggaggatgataggtgggccccaccatttaaaaaagaaaatgttgattggacctgccacgtgtacgccatgtaggacaaaactgctctggatcaggctatgtgggggtaattcgtccaatattgaaagttcagggtgaatgatatttggttttatggttcatagggtaattcagtctaccacgacagttcggggagggagggtaatacgtactttttcccaaagtaaaatggccaaaagtcttgctaatgattaatgggtgtttttaaccagcaaagtaaaagcctaaatgctgtcagatgagattttgatacatttttttatatggaatgaaatgatttagacgcacacattaagagaacaaggtcaattaagcgcttattatctgaagtaaaatgggagaatacggttggcacatatatcaataattatttttaggtgtgtatattctgagagctttctttaagtgcggtcagcataaagttgcataaaggtaggcgcgaccaataagggagtgccacctgtcagctgagtaaataatggggttaatttgttcgagggatatgacggtcatttggacactagcgtaaactctatttgttagtttactctagtcgtgattccacaccggaggaacgtacgcagtgttagaatttgccggagaggacaaaggaatccccgaaaagctaagaggcgagtggaaagtttaattacgtgctagtttttatggtttacgcactatatcggccactattgtagatcgcgtttagagaaagaaatagtggtacaaatgatctgatgtagaagatcctagctaaaaccaagcgattatggttacatccgttttacgttggtcttcaaatagaaaatacaaagtacatagccacataagattgatagcactcctctgtatacgctgtgaaaacgaaaaaaaatttatggtgggcccggcccacctaaatttatttagcagttaatcctctcaaccgtgtactgaataacgataggagtaaatcccaatgtcagtccattatgaagcccattttagctgtaactgttttatatagtagtcctttatatttccactattatgagccaaacacagcatcgatatccaaaatagagataaaattgctctcgatgtgctaaaaaatatgtcgaatgttttcttattgctgcaacatttgtcttttggactgtctgatttggctccaagatttttataaagagagggcttatctttgatgatccttctatttgaatttctctctccccttcaataccacgtttttttcacatgcacgagagagaaagggatgccgttctgcttcatagtgtcttcaaagtcagtcactatggcatcctcatctccctcttcctctaattcttcatcctaattgtcgaaacatgaattcggcaataataaaggggtagcgcacgagacctaaaagtggatggatgcggagacaaaggatttagacaggttcaggccctctcga

SEQ ID NO: 90106 - DNA, 988 bp, Oryza sativa
atcagcttacatcatttgaatccgaactccatagtccatattgcaaatttcgtccatgtctgcgaagcttttttgggcattagacctcattttgctctgttccgccgaatatttttccttaagcctcaaccgaacaaaaacaaaccatgcgtagttggaggggctggatttcaactgagaggcactctgagccaaaagtatttctccatgcctttcaagacttcaaacaaaggatggcacgccaactggttttatattcaaaatcccgagcccgctcttcctgagtactcctgtcttcccccagtataccaagatacatggaactctcttcccatgggagatgaagctgcccaagccttagaactgatggaacgcatgctgaaactcaaagagcaaggcttacagggagagcaaatcactcggcatttcattaagtgccgattagctccaatcaaagaaagatcccgcacagcatttgaatttgacggcaagcacgatccaaaccgtgaagacccagattctctggattttaagatcatgaaggagaggatgtacaagatattctcgaacgctattgtcgtcagctactcacatcaactgccagttgtaccatacaacgcattcaatccgcctccgcaggtatgtatctgaaaatcttcaacccaaggtcaaaacataatttcatcttcatgttgagttagctaactgtggaagcatctcattcaggaatactattgatgaaatctgatcccccaattgctcagcgccgatctcctcgccagcacaccattcagggaagtggagggccgacaatcaggtcagacccacaacctcaaacctccaaaccggctgggcagacaggtcctcgcaagagaaagctggtgcttaatgacgacgagggcgatgacagcaacaaatctggggacaagggaacgcccaacaaactcccaaagcataccatgcccaggaaaaaactggctggccgtca

SEQ ID NO: 90107 - DNA, 669 bp, Oryza sativa
atcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccactatgatgacaaagttgcatcgccgtgatgaagtgaacatgagtc

SEQ ID NO: 90108 - DNA, 1155 bp, Oryza sativa
ggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttctggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaaaatatatgtatggcaaataatgttgaagattgcaagataattaatatagtctatatagaggtagtatctcttaagaagccactattactggaagtccctgagaaatgattttattcctcagtcccatatctgccttgtttctctccactaaccaattagaacaacaaaaatggcctactcctgacgtagtggcataccgtatagttagatgcctgttgcgcgtatactctagcctttcatactagtatacttgtgtctagtgacaagctagtgtggcacacctctctttcatgcttttgctttgcaaggcagggctcatttatgagtgaaaagagtgaggcgacgtcatttctcctactatttactggaacttccgccctactgatttgttttccttgggcatgacagtgcaccagagaagattttgtggaaagagttaaaactcaacaaggtgaaggttgtaatgtacatggctttttagatgtcagcaaagttgcagggaacttacactttgctccaggcaaaggattttatgagtcaaatataaatgtgcctgagctgtcggcacttgagcatggtttcaacgtaagtaggtccaataaatgttccttttccttaaaagtgtttttattcagtggttctgatatg

SEQ ID NO: 90109 - DNA, 632 bp, Oryza sativa
caccttttgagaatccactctttttgacaggtatgtctctaatcataagtcttcaccacaaaagctttagctctactgtcttctgaagtataaagattccatgggcaaccttcttcacaatgagctcttatcctcctcctatcatatctaggcatcttgatctcaaccctattccttacactgtactcagtaattgcttgtctcaacttcttaacagatgggaaaacaagaccaaccttgaaattaggattgttcaagtcctcttctgcaaatgacttgaacttgagcctgacaccctcatcatcagaatctgctgcattaagctcttcctcatcagtatcttcactttcatctcctctaggcacaattgcaagatttcccttcaacctgcttcctctggctttctttcccttcaatattttctttcctttggccaccccctcatctatcacattttcatcaacataatcaacaaacaagtcatcatcaccatcatctaattcatagtcactatcatagaattcctcatcactgtcatcactctttgtcccactgtcttcttcatcacaatcatctcctgttgctccctgacgttatgctcttttagattgctctgttgctgcctgcttcct

SEQ ID NO: 90110 - DNA, 703 bp, Oryza sativa
ctttaaattaaataactttaccaatggatgaactacaaatattaatatccccgtacctcccctccatgtaaaggtcaccaaacatacttgtgatgcaaaaactattaaagaacaacacttttataaatggtttcaagagatatatattttgagagcaaaagaaaaaaaaatgaactacaaggtaaacttacatcagcagccatccgagaccacttattccccattttgcgatgaagattaataattttattctcttcttccttgctgaaagcccccttctttaggttaggcctcagatggttcatccaccgaagacggcaactcttgccacacctcaagaggccagtgttcttctgcacaagcttccagttcctttcaccatgcttcttgatgtacttctctaagatggagtcctcccaagatgtccatggacctttcttcaacagcagggctacggtgctccttctgcaatctttatctttatcaacaaatgactcgtcatcgctattgctcatataccagtgtgtcctgtcagaatcaggatcgctgtcgctctcgtgcatcctgtcacaaacacgagttgaactatcaaaaataaaacagaaatatgtgtacatgaaaatgttaggtcagtggccacggctagcagagattaacaaatttatacccatataaaacttttacaaaaatgggctgcaggaat

SEQ ID NO: 90111 - DNA, 2155 bp, Oryza sativa
cttaaatcttgagggacgtctcccctggctgccaatgctgaagctttcatgccttgtgaagaacatgtcctggtggggtattgcgacatgttcatgtagatcactttcatctgattgctcaaaaggatgatcaaacggattcctccatgtatgcagaacggatggagctgagccaggaaattctgtctcatcagaacaagaaagaatatcagatgggtttctcttgcaaaccttatcattatcgatgtctaagttactgtcaggatcaaatactatgttcttccttgatcttctcttaaccatcaagatctctaacctacgatgcctttccacctcagagtacccaagatccatgacattcttatcatcatctacggttccaagaaatgcaggatcagtgctgacattcttgtcatcgtttttgttggccttgctcttgtcagattcataattattatctctcacagttctagaatcctgaagggacatgtggttgtccgagtcatcattttggatgggatcaggatggggggaatcagcactggaaagagggtcaatctcgtccaggacagaagcaatgcgtgttctaggagtaccaggagtggtaccctctgtctgatcatgatcaaaacctggtgaaccatcatggcagccaactctaccaaatggtgaatccaaagatgagtctaatggactgtccacagcagcattgataggctctaccttaatatcagaaagcttcttcctgcgacgaacagaaaaggcacggccccatttacaggtaccagccggtttatcttctgaatctactttcatctcatcactctgtgaatctgttgatcctctatcatgacttatcttgcccaccatctcaacaacttcgatagcatgttctctggaagaattcaagccatctttgatttcaccgtcatttaagctcgccgtgttctcttttgccgaaaatcccttgtttgcttccaaatggatattcctggacaaatctgcatacttgggatccgaaacctcggcgacagatttccgttcttccttgatctcagcaacgtttgtgctgccatggcttatcagcacaccaaggataagagcggcacatatgattacaggagagtgggacagaaggaaagcgaagaaacccggcgaagatctgaatagcaggtagagcagcaggaccgggaagaggagaacccagttttcagaagcatatctgtagctcatcctgattgaacacctcaagatcgtccttatacatggcgtaccatgatctgcctcgacacccatggccttgtcctctatcaacttgacagcacaaatctagcaaagaaacaaacgaaaaaggcaatagttcagccaaaataaggatctactagcaatgaatgaagcaaagagagaaaatgttccgtccataattctgaaactctcatgctaaataattccatgctatatatactacagaattacaagagatcaattcaggtagtgcagtagtggtaagcaatagctgaaatcgaaaacttgaagaacaaagatgcaatccgtataatcttaaatctcctagaaccaaaaagcgagttcagcagcagcatcctgatcatcaccatctctgctacgacattacaactgcgactgatcgatggcgcacgaaagaaagattgtttaccttcaggcggcagccggcgatccgacggcgagatcttggtccctgaggcttctttccttcagcgcgccgggaagcaatcggcaatggcggccgtcgtcgtcgtcggatcgaaggcaaaggtcgcagcaaggagagagagagagcacgaggagacgagctcaagaaagcgagacaagaaagaggcaggcaagcagcacggtggtgggggcaggtggtgggtgggcccggctggtcagcgtcggctggcactgtaccaacaccgtgacgtcgtcgtcgccctcgtcgtcgtcggtccggctggacgccggtggcggtggcacgtgtgcgcacgccggcggtgggcccgccgccggttcacgcgaggccaggtttggcgcggcgcgggagcgttttcccgcgtgttttggtctctcgtcgtgtgggtggggtggggtgggtgagatctggattccgtttgcttttttctgaattctgatctct

SEQ ID NO: 90112 - DNA, 1487 bp, Oryza sativa
agtcaaaagtcagttctgtcatgggaggaatgtgcttcagtgcaaagaacatgatatgtgggtggctgtcatctccatggtcatgctgaactggctgccagaaaacattcggggaacaactatggttcatgaaacgtgagacatttcccatcttttttgcactaatcttgatgggcagtggctcaaattcatcagctgatacatatgtactctcctcaccaatcaattcaggaccaaagttgaattttaatgtcttctcaccaggacatacagtctgaaaaatgtaatcatcttcactgtcatccagattaactttgagctcatcaatgacctcaccagtatactcacagataaatgcaccagcacgaatgggatcccagcagcgaagaccccagcctcgatttgcagtccggaagacctcaaagtgaaatctgacccctttttgggtcactctgttccggcaattcgtagtacaatggcaagcatcaccgcattcataaattattggcttgcggcacgccaaaagtcctgatgagctgtaaggtaagtcacctccgttatgttgtccacaagcacagttgggatcaccaggcaggcaaacactctggcatccgcaaccctgtaagggtttcatagaactgaggggcctcaagtatttgacttgactggcataggtgaaatgcccaggtcctttctcatggtctacctcattgacaaggcaaactgggagagcttcagccgcagatgatagatcaggtaatataaccctgcctctgcttgctggattgtctatccatccttgagtcatcttccacaatgcagctccatcaggctgtccaggctcacgcagcagtttgtacttgaagcaattgataccagactttgttctctccttccaggactcctgaatcttatagaggccatcatatatgtagatttttccagtcaggcaaaatggatccctgaagccccgcacaaccctgatctcgttcttcctatgcaggctcctctccagagcaaggttacctctctcaagcttttgatcatgcctctcctcactgttcctactattgccacctgaaccactgtacaccagtgtatctgtgtcatcatccacattctcatagccacctgctgcaacaatacatattgccacagaatcctcatcgcttccaaatttagcactcatataatcaatgccacccatactaggagcatgcaacccgatgatacatagctccatccggaaatagaaaatatcccctatttcaactccaggaacaagtcctaccctttttcccacattagccctgatattgcttgccatcatgatggcgccagccttcaggtcagcccgtttgctagtctcttgtatttcatccagttgcagatgtctacgcctaagtgcttcaaaggtcatgtggactgcttccacaacctccctgggatcactggatgaaggtggtctaaagggggctgcaggaatt

SEQ ID NO: 90113 - DNA, 3559 bp, Oryza sativa
aattcctgcagccctttttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatcccattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatccagcaagttttacatcaaaaggaattttatagttacttaatacgtctttaaataaaaaggaatttgattatgatcagcaaggaccatacaaacaaacagccacatcacccccagaaaatgatagctagttgagcggatcaatcaaacgattctaaacatcccggcgacgacgacggcggcggcggcaatggcgacgccgacggcgacgaggtggtcgccggagcggccggcggcggcggcgttggtggacggcgtcgccgtcgacggcggcgaggc

SEQ ID NO: 90114 - DNA, 3325 bp, Oryza sativa
cagtttttatagtactacctccatcccatattacttgtcggtttgagttgttgtttgtactccctccgtttcaaaatataagcatttttagctatgaatctagacaactgtgtatccagattcatagctaaaagtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaactatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagc

SEQ ID NO: 90115 - DNA, 1448 bp, Oryza sativa
atatgtgcaaatatactcctgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaagaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggccaactgctattgatttgacatctcagggcaactttttctactagaactggacaaaatataggacaatgcaggtataaactgaagtgctaacaactaccaaaagacgacatttcagcaatgattggcaggcagatctccaaactatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaatagg

SEQ ID NO: 90116 - DNA, 1171 bp, Oryza sativa
tctttgtaccctcatgtcaaaacagatttcatgaacgtcagtgctcagtggacacaaccagcatcagatgggacataccaatacttcataaaagtgagctcttgttatccatgtttacgtgcttacatttgtatcagttgtttctgctacaaaccatcatttgaaaagaaacttactgggttttgcttaaccaggttgttcctacaatttacactgatctaagagggcgcaagattcattccaaccaagttagtgaagtttattgaatcatgtttatactttatattttttttccaagcctagtgatcttattgttacttgcattcacagttctcagtaacagagcattttagagatgggaatattcgccccaaaccccagcctggagtatttttcttctatgatttctcacccataaaggtagtaacaatggagagaaattcgtatgtagtcatgttcatttttctctttttatgattctatcttagcttgctctactcatcttctcaacctgtggatatgtgttgccaagctcatctgttgaatggctggctgtgttggtgtgaccattcttgctgcacatgcagaatgctccaaattcaccatctgttattattcagtactatttaattactttggacacaagagaagtctacaatacctttgtttcacctttatctattctgacactgcaggaccaaactggaatttgtaggctttaggtcatggagagtttctaaagttagttattatactagtcagtagctaaaagaatcagttcattgatgagatatatctgttaggagtatcctagcataaaatttggtattatccttttattatttttattatttgctgaatggctccaaaaatgtctgcatatgcatcgtaacactttgaatacaaaattgacagtgcatgtctatactcattcaaaagcctctagtggtggtggcagggaatttgccaccccactattgctttttgcagtttttacaaattgtcccctgatatttttctaatattgtggaatagttcaatatttggttcaaacaagtgaatagcagataatgaaataaacaaacaattgatactaagatatttgataaaatatatatttttcttacatattatgatattgtttttcttctgcccatagcaaagcttgggc

SEQ ID NO: 90117 - DNA, 680 bp, Oryza sativa
gcggcattaggcaatggcgatggcgatggcggcgaggatgatgacgatttgttccaagtgaagccgaagggtggagatggtggtaacaaggaggatgatgacgaggagaagaaggagactgagcagatactgattgatattttcggcaaagacgaggagctggacgagaacagcaagttcctgaagaaattcttcctcgagaggccgtatctcgagacgggcagcgagaagaaatactctccggatgatatccaggaggtatcggacgaagaggagcatctcatagagcaggaggattatgagaccaggtataacttccggcatgaggaagcagccgcgactggtgcggatgtaatggacagggtgatggggcattcgcggtttgtcgaggggtctgtgaggaagaaggagagcagcaggaagcagcagcgcaagaacaaggaggagcggatagcacgggccaagcaggagcaggcagaggagttgaagcatttgaagaacttgaagaagaaagagatcgccgagaagcttgagaggatccggatgattgccggaattgatagcgatgcagcttgcaagctcggagccgatgacttggaggaggattttgatcctgaggagtatgacaggaaaatgaaggagacattcaatgacaattactatgaagcagatgatgttga

SEQ ID NO: 90118 - DNA, 4141 bp, Oryza sativa
gaatttcagattcgctgcaagaacagctgagaaaaatgcaattacaatgctggattcttgtccatctgacagcagcttgagcatctcgaacgcgaggccggacgatttcttcagctccctgagcgtcctgagcacgtccttgatgtacgtcgtgatctcgtgcatcccctctgaaatttcacaatgttaggataaaaatgttcagagattctttctttctgaaccaaaaaataacaaaaaattcagagttctctctctctctctctctctctctcttctgaaattcttgtggcaagattggtaatggacggtgtgaccaaccgcgatcgttcatgaagctcctgagggccaccatggcgagggccctgtcgctgccgtgcttgcctgaccggaggacgagcacgagctgccggagcaggcacaccctggcggcgccgagcacgccggtgtcggggaggagggggagcatgcggaccagccatgccgccgacacgaggctcgccgtgaacagctcgccgttcttggccgccgcgaggcaccccgacagcgcctcgaacaccagcccgaactcatggctgaccagcgcgtacgccgccttcctctcccactccgccgccgccttctcttcctcctacaaaaaaaaaaaaaaacatcgcaagtgaactcgatgtatgaaatccagcaggtttttttatagagaaaacttctgaaaattggcaatgtaaagtacggtgatatctatcagttcaccaaaaattaagttcaaattcgacctgctcatcgtgaaaaaaaagagacaaattcacatgtaaacaatatactattattcacactgaatttgtatttttttttatatctcgacgtgtgagttgagtttggacctaaaattttatagacatgttgcatgagtgttttcaaattttttaaagaatttttcataaccataagatggtttttaagcgaactgaggagacattcccctttagtgaccaaaatagtttcccaatactaccatttcgtcctcgccggcgccgcgagaaatgctgagatcgtgcgacggccggtgcctctctttcaccctggcaagcttaagcagcgatgagcgtgagagtggccggcccgacgaggagaacttgccggagagattcatgatagtctcggcggcgagcagctggcttctcgggtaatccgagttcttgaggcactggatgaggctgtccactgcttcctccctgtacatgctgatcttcctcggctccacctgacaaaccatttgcgcattgatctcgccatcaaacatgagattttttttgacaaatctgaagaaatgttgcgagaaaaagttgtttttactaggagatctagctgaagaagtagccctgcaacgacagggctctgctccggtgtcgtggattgcaggtacacgagaagcgtgtgcatcatgctgaaggagctcgcctccttgatcgtccgaagaagacgatcagcagctgatcgcctgaaaaataagttgagattttgttttagatgtggataattttgtcattcttaagaggatatctgaagataccatatatttttgaatgtaaagtttactacctctaggtggtgttcatcaaaccgttttgaatgtggttaccaccactccacagaaaaggcggttatcgaggtaactgtacggttaccgcgaggtttaccgtgatttaaaaactgagaatgttatcacacatgataattgtgtgatgatcgtacggttttgtaaaccctgcctctaagtagtagggtactcgagattttttttttaaggaccgtaaaatggaggagctttggggttaccgtttgagcttgagcagttcggagaggagccgcacgatgtcgaacttgtcggcgtcgccgacgacgtggaacgcgtcgaggacggcggcgagggccgagttctcgacgatgctgctccggcaatggccgtcctcggcgacgcaccgcagtaggatcctcacggcggcgaccctctcctccacctgctcggcttccaagctcgccgccacgctcctgatgaacctctcggagaccagggcggacttggccaccgccggcgacgagctgtcccggccgccttcgacgaggatctgactcaggaggatcaccgacgcggccttcggcttgacgcacatcttgaccaccgcgccgccgtcgtgtcgccgccgcctcgccggatggtggcgaccagcgcgtcggccatgtccatctcgacaagctgctccggcgagggggagaggaggtggatgagcgagacggcctcgacgaggcccttcttgaagagcgcgacgaggcagtccacgtcggagtccaccctcgtcagcgtctgcacgacggcgtcgtcgcgggaggcgagctcggcgaggaggaagacggccacctggagcacctgcgcgctcacggagttgaagaggatctccacgaagccgttgacgacggcgggcttggcgagcgcggcgaggacgacgtgctcggcaccggcggcctcgcgccatagccgctcgatccggagcaccgacctctccgagtcggcgagctcctccgacgtgcagaggcaggacaccgcggcgcggagctcgccgactgcgctgtcgagggacgcctgcgcgatgacgctggtcggcgacggcgcgctggcctggctcacggtggcgtccggcgacggcgagctgatcttgaacggggccgcggcggcggggctatccatcgtcgtcgtcgccggcggcggcggcgtgggcgcggaggaggaggcggcggggttctggtcgcgccaggcggcgatgaggcgcttgaggacgtagttggtgctggggaggtgggcgccgtggaggcggtggcgcgtgatggggcaggtggcgttgccgcggtcgagccactcctggatggcgcggcgctcgtacgtctgcccggtctcgagcgtgacggggtcgtcgaacacctggctcgtgatcgggcacacgaagtccttgggcgtcgccaccaccggccgccgcgccacgtcgccgccgccgtcgccgcccatcacagaactgcattaagaataatccgccgccgccgcggcgtcgccatcatcacatcgggaacggtgttgctttggaggcgagcgcgaggacgccagctagcttacctcgcgtgctccggagagagcatggcggcgacgtcgtcgtcgtcgtcttcctcgccgcgtggacgcgctctgcctgcaagccgtgacagctgcgaggccgtgtgcttttcctaagagacgagacagcaacattgaaacctcatctatgatctgttcaactctgtattttaaaacaacgctatttgtttatgaaaacatcgcctggatcttctctaattaacaaatggagtgagatatgatgctaatcttagctttcttagcgtcctagattacatattaaacgagttgcaccaagactaattcagagcactgacctctctgccggcgaggagctcggaggaggagggggagtcctccatgctgacgtcggaagaaggcgtcgccggcgagtgcccggcgcgcagcctcgccaccgggcttcctctgccggtcggcgacggcgacgactgctgctgctgcactatgaggtgcggcggcacgcgctgcgggtacaggctcggcggccgcatcagctccctccaccccttgccgctgccctgccgcgggtacaggtcggccgcctcgtcggcgtccgcccagatcggctgcaaaagatcaccggaacatgacgtcaccatggtgtcgacaccgtcgagccgagcacgctgatgggataggtttgtgttcgtagcattacgttgtaccgtacgtcgttctgcgagctgacggtctcgtcggtctccgccgtggtctcgtcgtcgacgtcgccgtcctggtcgtcgtctccgacgccgaatacaagctctggaggcggtggcggcggggagtacgtctccttcgccgcgtcgccggtttcaaggatcttctttaggtagagcgcgtacgctatgcagttcgcgtcgagcaccttctcgtactcgcgctccaggtccctcatctcctgcgcgtgggggcctctcatcaaggagagaaccctcatcgccgacatcgcggcggtct

SEQ ID NO: 90119 - DNA, 957 bp, Oryza sativa
tacccggctgataatctcaacctccgcctgaaattcacgctctccctgcccactcccatctctcaattgcttcacagcaacctctgtcccattcggcagaactcctttgtgaacatacccaaaaccgccctgtccgagcagattagcatcggagaatccatcggtcgccgctgacaagtcctcataagtgaaagtacaccttgaaaaacccaatgcagcaccaggtgacactagaggttggctgttgtcgccaccggagtaatttgagccagaaccaccactgtgtacatttagtggagcaggaggtggtggaggggaaggatgcgaaggcaccttcttcagcacatgatcaggtggaggtggaggaccattttgctgccaattttggtacaccccaccatagtgatcccctgcagctcagcaagaattgtactgaaaagaccgccgatcatagttaatattccaaatagattttctcaatgcagaatgatatgagaaggatatgattgattgcacatttgtttttgtttctttttagatgattgctcacagattaaatatatgtaaagaaacatattcaactctgtgatggttaactcaaagaatgaaaaagtaagaaaatgacatgctttttgtttgccaaatgatttggcttaaaagtaaggtaacctcaggactacatgaccatgtcaggtcttgtcactttctttccagaattaaccttttgtgttatctcaacacaagtgatgaactgataatccacaacaccactactccatccatggtaaacttagcacaatccacaccaaaacctacatcctgtgtttttttgcctaacgatatgttcttccatcccataacaaacaagaataagtccttcaaaatttttcaataaatccaaaaaaaacatttaccatgacagcaatttagcaaaattttcagttgatagcaacgtct

SEQ ID NO: 90120 - DNA, 964 bp, Oryza sativa
gcctgtatagatggccatgtgggccgcccggcacggcacggcccaggcccggccgtgcctgggccgaggcttgtcgggccggcacggcccgaccaacgcaccgggccgtccgtgccagcccacgtgccgcactcacagcccaggcacggcccaacacgcctcgggccgtgccgggccgacccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggttcctattctttagacattgacatttatatgtctatttttagtccctatactttgtgtaccgggcctggcctgccagcccatcgtgccgggccggcccgaccgtgccgggccagcccagcgtgctggtggggaggcccaggcacggcccgacagtcgggccgggccggcacgggcccgacccaagtcgggccgtgccgtgcttgggccgggccaaaaaggcgtgccgtgggccgggccttcgggcctcgggccttatggccaactatagcggccggcgcggcggcggcggctgcggtgggcggccgctcggcggtgaccggcgcggcggtggccggccggcgcggaggggaggaggggaggcggcagtggccgccggccagatttttttttctttttttcttttgagatgtgaatctgtgatgtatttttatgtgagatgtgaatctgtgatgaattttttagaaccctgtgatgtgatttttttaagagtttgtgtgtatttggagatgatttgtttgaggatttggagatgttctgtaatatgtgatgatttggatatgggaggggatggtgtgaaattaatattcaatattaaaagcagaaaaaaaaagaaagggctgcaggaat

SEQ ID NO: 90121 - DNA, 2944 bp, Oryza sativa
tgtaattacactacgattatactgtaattacatctgtcaaatttttggggaaaaatttatcaacaaatatatagcaaaatcgtaattatatttgtaaaagaatgaaaaaaatgtttttatttgaggccgtagttgagataacctattattgtgagtcctcggctactgcctttgcattttcggagttcggacttcagagccgatggtaattgggctcagtatgttgggtcttcagttcttcacgcggactcttctgggccatttttgcaaattaaaacaaagattataagtctagtattagacgaatgattttactgttcttaataagtataccatgattctattgaaaatgtagtatctctcaatatttcagactagaaagataccaaattcacataatttttttatacttcgcaaacggtaaaatttcttataacagagactgcatcaatttcctacaaaagacagacataggtatgtatgcatatactacttatcttaaatccattattaattgattattctatagacggcaatttaactgcacaaaatactatacacacacgtaggtatatcttcagcggaacataagaaactcgtttctaggccttgctgcaagggagcggataaagtgggtatgacataatggagactattcttagtatggtgacaattttttttacaattgtgggtggatgcttactattcttactatctcataatataagggattagtatatcgtttttttacaaaattgaaagaagtagcaaaggacagctactcgtgatataaaagatgataatgaggagaataaactagtataaaagctagtacgtgaaaaataaatagtataaaagttaatataggtggaaattaaaatgctgtctttaggatcacaaaatcctgagacgacgaaggaagtaataggctttgtgtttaagtgtttttttccattcaagcttgaattttgtgaaagggtgctactttattaattagcactgttgatcttaattaaactagaactacttcacgcatgtcttgtatatgcagagattggaataaatctattcctttacttataaaacaaaaacattcactgtgcaaactcatatacatacatacatacatacatacataagcagcatcaacgcagtcacacaaatgaaagtttgaaacacatagaaaacataataaatttataatgagatatagtatacagagaaattaattaagatgctccaggagaccacggcttggcaactagattcagatccgccttgagacgcacggacaatccgaacagctcgtccatgtccaatctcgtcgtcgccatgatcccgctggccgccggcggtggcaactcccagtcgaagtggtacagcaggttggcgagcgccagctcgacgctcagcgcggcgaacccggcgccggggcagcctctcctcccggcgccgaacggcacaaacctggagtccttccccagctgctgcgcgtactccacgccgccaccgccgccgccatcgagccaccgctccggcacgaactcctccgcggaatcaccccacgccgccgcgtcgcggccgatggcccacacgttgatgatcacccgcgtgcgcgccgggatgcggtagcccagcagctccgtgtcctccaccgtctcgcgggggaggagaagcggccccggcgcgtgcagccggagcatctccttgatcacggccctgaggaagggcagctcgccgaggtggtcctcggtgacttggccgccgccggtggcggcggcggcggcggatgcactcgatgtgcccacgaccgcgcgaatctcatcctgcagcttgcgcatcacgcgtggatggttgatgagctccgccatgacccattccgtggtggtgaagctggagtctgtgccggcggccatcatgtcctgctcgatgaacctctcattcatgcatgtcacacgtggtactttctctgtttcatatataagtcgttcctcttttttcctaatcaaactttgttgagtttgaccaaattaattaaaaaatatactagtatttttaacataaaataaacatattatcaaactatatttaataaaactaatttcatattttagatattgttaattttttctataaacttaatcaaacttaactaagtgtgacttaaaaaggttcaaaagacttatattatgaaacagagggagtaggcatgtttagctgtgcatgtatatatcatattgcttggaatttttcatgaaaaattaagtgttgtgtagtagtgacagagaaaattgagatggcatatattcagcacagatcactaattttgaaaaaaagcaaatccaatggcatgacttggtgttagatatagctctctatgaataaaaatctagaaaatgaggtgtataaatatctagaaagcgacgtttgcttagagctttgggtggatgagaagaaattaacatgagatttgtgatctcggtcttcttcccggcccagcagtggtgtccttttacacttctccaacaacgacatgatgccgaccaggagttttggggtaagggtgaaaagaggttttcttcacgcttagcagactacaagtatgtgacgatgacactagcctagtggagaaggggtttttctcccagcgtatgggcgaagacacgatggaccggtggtgggcagccgaaaggactatggtgtgcacatatgactcttttgtagtgggtcacatgcatatgcaattatgcatatggacccgctcaatgtaagacctacaaagttagagggcaatattttagaggatctttttttctatgttcacaacaacggttggatcatgaacctatgggcaagagggctaggctggtggacaaagtcaggcgttagcggtgagagcgtgggatctagagtggttgaaaagtagagcggccatggcatctgc

SEQ ID NO: 90122 - DNA, 2274 bp, Oryza sativa
cggtatttgacgcgcatcccccattgatacggatcgattcgggacgaactcggtgggctgcgtttgctggctgctctctagattgccactgccaaatgccatcttcctgaatttcttcaggtcttcattgtaatggcccgtgtcgtactcgttgctgttgtatgatcccaagaatcggctatggccaggacgaacaccttcgttcagatcatccaatgacacatcgccttccaaggcccgaacaacctgttgttcattgcatcaatcaaacggtagttaggacttcagagactagataaaaatgatatgctgccttcctgtaattacacagatgaatcaattttgtcattggaagtgaaactagtgtagctgatagtccactgtaagtaatatattttgcactgaaatttcttgtcttgtatgaatctgtgctgatgaaaactgatgaaagaaaagaacaggaaccttgaagtacaagaaggtacctggctcatccgtgggcgtcggcgtgcagaatggcgtacacaagcagctgcacaagcaatcatcctcgccatctcgttaccattgtactcctgtcctagccgtggatccactaaagcatcataattgccatcatctgatgctcgcatcattaaaggccttgcctgcaggtaggaggaacaaaatcaattgattgtacacaagattttcaaagaacataacacatgttcaggaataggcatgaggaactcgttatctagactgtagaatttcacaggatgatgaacggtacaagaaactaaagtatagaaagatgtacacgaaggccaaaagtaaacataaaggacaaagtacttcactgaatctggatactagattcgcggaaagtaatgtatagaatgtagttacttaaattttcaaatatggacctcaagatatgattgggttgtattcataaaattaattacaacggatcatcatgtaaaatcaacgataagtatatatactgaaagaaattgcataacctctgaaagtattgcttttctttttacgaaacctctgaaagtattgtggacaataaagttaattagtttcgagaaataacttacccaatcaaccaagctgtcatccatctgtgattggttcgatctcacaggacggcggccagttattagctcaagaagcattactccgaaagaaaagacatctgatttctcagttagctggccagaagacgcatactctggtgcaaggtacctaagggcaggaaaagtattacaagggaactgattttgatacggctgatgctgtaatgcactagcttaaaaaatgattctttattatagattttgattaatcctttttttcgaaaatatgaactgatgcttgctacacaagtagatagaacatacccaaatgtgcccattactctggttgaaacatgagtgttattatcagaagtcaattttgcaagtccgaaatctgccacctgtaaaagagttttacatagcaaattacacattaaactatttggtagtatgcgtatcaactctataactgtaattatgattggatatatgccaactactatttctctgaatttacttatcaggtagacagaaaagtttagcctatatcaaaattgtgtacgccttcaggcagattaccagttgaccatagtacatcagaacagtcaaaaccaccttgccaatgaatggaaggcactgtttgctcacaaaatgtgctttaagtctaatcaaaagttcgcaatgtaaatattgatttgtaaaatctttgatgactgtaattaccaatcagtatgcacttctaaaacagaaaggaaacaaaacacaaaatgtatagcgcacctttgcctcaaatctcgcgtcaagaagaatatttgctgactttatgtcacggtgaatgatcttaggatggcctgtaaagtgtgtgagagaaaatcagtatataataggcatgtatacctataagaagtggaaaatggaaccaaaagaaaaacgagtgatatgggtgttcgctcacaatcttcatgaagatatgccaatcccttcgcagcacccaaagcaatgcgtaatcttgtaggccattccatggttggtcggcctctccctgaaagaggtgaaaatagccattaacaaatgctcaagagcagacaaaccaaatgtgtatacaacatggatttcatgacagattgacagctgtttcaaggcaagtttctggattttacataaaagggcatttgaagaacctagagagcattttctctttttt

SEQ ID NO: 90123 - DNA, 655 bp, Oryza sativa
ggacatctaaaccaatgcaaaaaggacagttaaaatctcagaaagtaactgaactgttttcgccatacttcaatgagatcactgaccacttgtaataggaagcttagcaggtgtataatatgttaggccctcatttcggtaaaactctatttggtaatcaattgatgcattgtcatacttgccagcagctttattagcttctgcttcttcaaatacatcaaagcgtttgtagtgccgagagatagcaaaagtagcattcttcctccacaaaaacctaatagccatgatatgacacagtcagactcaacacagtagtcaaatattgcaatattgcgatcttaaaataatgaaaagctggtaagttccaaattctaatgtcagcagaccaacaaggaaatacaaacaaaatactaagaaattgagtgagtagctgttataaataaagtgtcttgtgaaaaagccattgataatctttctagtctaatatcctcaacagacttaaatatgcagtaatccgttgatagaagtaatggcaaatggtggctgttgaaattgttgcaaagatgccaaggtgtagaacagcccaaattttaatttgacaaaactatagcacatgacaggtttctctccttaaagaaatagcatataataaacc

SEQ ID NO: 90124 - DNA, 4811 bp, Oryza sativa
  unsure (1)..(4811): unsure at all n locations
cgcggcgtggaaccatggagatctccttcgacgcgtgggtcggggtgcagcggcacgggcaggacctcgcggaccgcctcgcgcagggcttctcgggcctcctcctccacgcgcacccgccgcagctccactggtccgcccccgcgctgccggccaagctgatacccttcgagatcgacctccccgtcgtccccttcgtcgtcggagggaggcgggccgggggcgggaggggcgccgccgacctccccgccgcggccgtcgcgtcgttcgtcgagatcggcgggcggctcggccaggcggggtccgagctcggggcgtgcgtcgggggcgccgtgcagcagctggcgcggcagatccttgtcccgttcctggcggagagcgcgcggggccggaagtgggaggcgattccgccgcagcctgctgctgcggcggcggcggcggcgacggtgaatgagggggaggtggctctcgcggtggagagagctgaggataaggggctcgcatcggagagggtcggagacagagggcctctcgaggtagctgctgcagcggccgcggcagccactggaagtgccactgcgactagcgttggtggtgcggaaggtggtttggatgaggaagatgatgggttcggatgcgatattgggactattggtaacttcaagaaggctaaggtacacattaccgatttgctgatcaaatgttgcgtcgtaattaccacttacctgttacacaattctgcaactgtaattggaagcaagttcaatcggatactcagaatgtgcttaggagtgacatttgtataggttctaggtttatttggggtgtaaaactgtgtatcttgtctgaatgctgaggtagtgagattttagagggctttggtgcttggaactcattgatttaatatgcttggaatcttcttttgcatgctcatagaaagattctgtccatatgcttctagaatagccatgcatatagttcaaaaattatttttctaatatcagaatttaagtataagcatacaggatcggtactaaatgtaaaggttcaaattttgtagtggctggtgcatacatttggttaaatctaatgatagctggagtgcagtgtgaattccatttgctgaagtacatattattatgctgaacatgatgcagggaaccataaatatctcagcaacatacgagaccaggcaccatgactttgagacttcagttgttgcacgtggggacctttggaggttggagtcgtcgcgtggtggttcaaattctggcgatgaaaatgctccgcttttccttgttcagctgggacctttattatttgttcgtgactctacacttcttttgcctattcatctgtcaaagcagcaccttctttggtatggctatgatcgcaaggtacttttcttcccagctacccaggtcttgatctgaaatcttacatgccataaactttttgcatcatagtgttttagaatctcaatgatataattatggtgcaaataatgcctatcaacgtgcattggcttgtattttgttgcatacccatactaatagtctaaaacttgtgtgtttattttagaacaaaatgcactccttatgtccagctatctggtcaaaacatagaagatggatggtgatgtcaatgatgtgcctcaatcctgtaacctgtgtaagtatgcatgttccttctttgtctttttctttcctcaattccccctgtttcctagttgctatcaggtatcagttatttttatacttcagtatgatggactggttttgcaaatcatcacttttcatgctacgggcatgcaaatccagtaacaatgtttaacatactttactgttacattttgtcacgtgtattcgtgctatcaaatgatacatgtacttatcgtgttctttgtagaaagtttcctatattgatgattactttctgatgcaattggctgtgcagtgacttgatttggactcggatgtagaatcttgtataacaagaatatcaaacctactcataactttttgcaacagtctcatttctaccctcattgttaacttggctatttgtttcagtctttcatggatgtgcagttcccaaatggacagctaacatacgttgctggagaagggataacagcaagtggatttttcccattctttggtggtttgcttcaagctcatggaaaatgtcctggggaaacaagattaagcttctccttcaaggttagtgtctgcataataagccaactgtagctccacttcatccttccaagacctgttcctaattatttcacctgccatgcttatttcctgttgctttgcttttgaagagcaaacaaggcacaaggttcacccctatgtttcaatggcctgacaattctctttcatttggagttgcacaagccttagcgtggaaaagatctggccttatggtgaggcccagcattcaagtcaggtagttagatataaacacttctgcaactcanagccacgttagtcaggcccagcacaaggttactcgactatatttttntgggtcccacatttattttccacttctgatttccttgatggaactacatgcatcagtgtttgccccacatttggaggaagcgatcctgggatacgggcagagtttgtccattcattgaaggaggaactcaatgtaatgtgtggtttctcttgtgccagacatccctcggccttcacagctgtttctgtaagctctcagatcatgttacgcttctgtttataatcaagcacacgctttactttactgctaactgatgtccttgtgtgttgctatgcatccgcagctcgggcgatccaagtggaatggacaagtcggcagttcaggactagtaatcaccttggaaacaccgctggacaacttggctagaccatctttatctgttcaattgaatggaggttttgagttatgacgtctattcctgtaagctgtacatatcgctgtatatattgcacggtgtccatactttcatgtttctggagagagctgccaacctataaattgtattatgtggacgttggttgaatctccttttagtgccccttattataggttttagcccagcaccaaagtcgcaattcaataggtaaggaagtaagtagctggagctgttgcaggtgcgaatatgttgcgtccattttgtcgtcatcgcttgtaagtagaatgtatgtattgctgtagcacaccataatatgggttcctgttgccattgttggtcaatggtctggtcgacattgtagccctcgttgtcacactgttttctgcgagggaaatgattttgtacttttgtcctctggagtttgaactgtacttttgtcaagttacccttatgtaaccaaaatgcccttgacaaatgcttacatagtgtttgtttgactctttagcgcgctgattttacttatatgcaataaactaacaattgcaagtatcacatttttcaaagaaagttatgattcgggaaaaaaaaatgcttgattaatactgttggtctaaaaaataatccaccatatttgtgagttctaaaatcctcttgcaaatttaatactctagttctttctccgtggaacaaggagtttacataggaaattcgtaggattgaaatccgaatttttcatatcaatctcttaggtttggaagattaggctagaaaatcattaaaggaatccttcctttcgttcactttttagaggatttcaatcataaacttattaacctcatagtttcattatctttgagaagtccaatgtaccatctttctttatctctcctctgaacttataaacctcttaagaattttctatggagtatccaaacggcttatttgacaagttcttgtattttccattcctgtaacttgcctattatatggtacacccacatttcaaaaaaaaaaaactgattttgggacagaggatgtatgcaagttgtagatatctaaactactcccttcgttaaaaaaacaaaactagatggaaatacaacagtaccaaatacaacaaatttggacggtcaactgtttatattcgttgtactagattgtgttacatccccacattgggtttttttggacggagcgagaatgttaggccttgtttagttggggaaattttttgggtttggttgtcacatcggatatacagacacacatttaaagtattaaacgtagtctaataacaaaccaaattacagattccgccaaaaaactgcgagacgaatttattaagcctaatccgtcattagcaaatgtttactgtagcacaacattatcaaatcatggcgcaattaggcttaaaagattcatctcgcaatttacacaaactgtttaattggtttttttcttgtacacatttaatactccatacatgtgtccaaacattcgatgtgatgggtgaaaagtttttgttttgggaactaaacaaggccttagggcctgcttagtttgcaaaaaaaaaaaaaaaattggttgtcacatcagatgtttgacaggatgtcagaaggggtttttggacacgaatgaaaaaactaatttcataactcgcctggaaaccgcgagacgaatcttttgagcctaattaatccgtcattagcacatgtggatacccggccgctacacgctacgccggtcccactcacgaccgtactcgcatcggccaccggacgcgccatggacgtgagggtcgcgccgtcctggctaccacccgccggccgttgaggccacaaccgaatgggcgcgccaccgcgcctgcaccaggccgggcgcactcccctgcgtccgcgccatc

SEQ ID NO: 90125 - DNA, 1915 bp, Oryza sativa
agaaaacaggattagcatattatcatcaattgatcagcaacaaatgttatatgccatataacatacagcagctgttcttttagtactaaactgagtattgctaaagaatacccttttacaaagtacttttgtttctatttggcatatgtttattagcattacctttcgtctagtagtgcttgaagccttccaacaaagtaaactcgacttaggctccaatctcctgcaaatagatcaataatccaaaatcatacccaagcttcttatataatgtggatgaatcctatttgatagctctattcatgtggaaaatttctaggataaaataagactttgcagctctaaaaatttttcataaactactgaatatgtgcagtgctgtatcaagtgcttgttttagtgcaatattatttttttttaatttgggtatcatctgttcccctccagagtatctgctgaaaaaagtactcctctagtacaagagagtagcatagaactacttacaaattctcttgctctagcttctctgcaatcgacatagctttttgtctagaccaacctccttgttgtgaacaagtttctgccttgttaatgacatgagcaagagataccttgccccttactatgctgttttgtcggccatgctcattattcacaacttctcgtccttgaagaactatgttttcttttctgacaccggcgctgttatttggttcactatgccagtccacttgagaaggtcctacttctataatttcaccttcagtcaatatatgtggatctgattgcacccatcgtgtctgatttgaattagcaccatggaccacgttgtctttttgaagtctcctaattaagttttcacctctggaagaagcggaactatgtctagtgaaagacctccttaatgccacattggaagtgctatcctcaggatacggtgaaatagctggaacatgacctgcccttgcatcatcctttggttcgtaccggatttcaagtgttatagcagaagcaaggacagactcaaatgcatgtagaacttgttcccttgacctctcagctttggatttattcacacgagagctgaacattagttgcacagttggtgctggaggaaaagaactaagtgttagaagcaagatatattggaaaatggaaacagtgtagctattatttcgccaacacaatattcttaaaacaaaacatattacacgttttcaaggaatctggcatgcttagttttttggggggctatgtgtgtcttaataacatcaacaaagttttaaacttgctctcatcaattctagcatgaaaatttagtcaccatgtggagatgcatattattttatttacatgagatattttatggtccttgggaggtatgcggtattgagaaatgagaggtagatatatcttatagtatagaaaacatgtactattacatggcctaggcaccaagattgacgcatattacttgaacaaagcgatttatggtgtttggagggtactagaggtatcaggcacctttacttcaataaatttcaacggttgagatgtttacaggcacacatagcaagccattctatcttattgcttgattacttatgaaacagcatatttatccatcgcattacttaaaacaataataggtcatccttggatgtattctgcaatgaaatttagacatgatataactagtaatatacagagaatgagcaagaaggaatatcttgcctgtgcctaggctgacagaaatcagtcgtgcttctttagccagcatctttctcactgaatctgatcggatatgctctagtacagcctgccaaatcatctcattgtcactttttctgtatctagataaattcactctagtagcacgcgctaataatacatggttgtctggtgtatgttcacc

SEQ ID NO: 90126 - DNA, 651 bp, Oryza sativa
atttgataatagagtacaaataaatagcaatttaatactcgcaaataagtattattacagaggtagatagttcctctcaaagaataacattctacgcagcggaaatataaaacgataacaaactacggaacagctatggcgactccactccacaggcatcttaaccaagaacaagcctaatcctccagatcatcaccttcactgagatactcctcttctggtgaatgaatattgcaagaatgagcatatgacatactcaacaagtcacacagcaaatatgcaagtgcacgggataacaaaggatggcataatatagctcatttgcagaaacagcatttaataaatatttaagagaatagtaaaaacagttgaataattaatcaatattaaataaacaccatacaacatacccatgttgcataggcccaacctcatttgaacaaccaaccccagttgaacaaattaaacctccaaaccaggaattatccattccaaaccaggagtcaaattaattatcacattattaacattaatgagtagtgtgagactaatcacgaaaaacattgctcaactcacccataatcgcgggtacggctattcgaatagtttaaactctgatcagaggtgtaccactgtacgggctgcaggaat

SEQ ID NO: 90127 - DNA, 799 bp, Oryza sativa
ggcagaacatattgtttatcaggagcaagttgaagcagagcagctgtaagccacgtcatcttatcattagagaccctcaactgtttttcagcttcagagagtgttttcaaggcctggcgtagtttttccatgtcatcttttgatactgtaatccatatattaagatgttagattgtgtggaagaagaatgtttaggtaacatgaatgctactaaaaaaggagagatcagcgatccacgtactactagcccagtcaacaatgtattctttctataaaggaaaggcgtaaataaaatatgtactagtatagccagatctataaaaggataacaatacattggtgagaaaaaaatgctagagcatgacttttacaatacatgactcatggatggatcaacccaactataaatccatctgaagagagtgataaaaagggagtgatattgcttacaggttggacatttgaagaattttcttcgaaccctttcctgcgtgaatgcataggtgccagcaaggatgtcagtaattattgtggcaagctgagacatcagggccaaaggctcaacacctgtttcagtaatatctcttaaagttttcacggtgttcacagtgtcagcagacagtgccaaatcaagcaaatcaaccaatttatcatcagaaaccaagccgacctgtccaaagcaaacaatgtccagttgttattgtcaggtaaatttttaaatgaagtatttttatccaataatataatagcaggttattttattgctactgttagaatttatacaatgtttagtaaacaa

SEQ ID NO: 90128 - DNA, 1905 bp, Oryza sativa
agcaaatctacaggttatgtaacgatgcagccttttatgctcgtactgagctgccatccagcatgccaaatcttgaaaggcttcttatacattctgacactgaggtatacgctcttaataagattttaaaacgaccaactcgtgatgcatacgcttataaccaataattgtcttacagtgaaacctagtagtatttgaatctgcagatggtcaatacacagatgctgcctagcaaattctatcacctcaagtacttaaatattgctcttggtggaggaacctatgattatctctctcaggtttccttctttgatacttctcctttcttggagactttcaacttgaatgtaataaaggtataaagtaaatgtggtggaattgctgctaattaatttgggttttttgttcactgttaggcactctgagtccgagaacgaaaggaatgtgtctcaggctgtgtttagttctatgggtgaaaagttttaacgtgtcacatcggatatacggacacacatttgaagtattaaatgtagcctaattaatccgtcattagcaaatgtttactataacaccatattatcaaatcatagagcaattaggtttaaaagattcgtcttgtaatttacatgtaatctgcgtaattagtttttttatctatatttaatactcaatacatgtgtctaaatatctgacgtgacaggatgaaaagtttttgcgtggcaactaaatggtttttttaggacccttcaggtctgagggtgatgccagagcaccgccgtcatgacaaactcaatttcttttctgcaaagagtttggttgagctaacatgtcacattgttgaatcggcgacatcactcggaaaaaagtgtctttacgctggacacaaccaatttttcctccgcattatctgttatccgttgcctctcactggccggtgggccactagtccaagttgtggctctttggtagtactggtgcaaattgacaaatacaacgcttcctgcgcgggcagagaaacgccgcgcccttcttctcagatgagactcccgagtgctgggcaggctcactgcctatccacggttccacacacaactactactgtagcaattgttacacgtaaaccgcaccaagagagatgcaatgcaaccaaacacagtaatcaatccatagggcagcccaaccattttaggttgcaaacgtatcatcatagctcatcagtagtaatccatatcgccctatgcgtatcattaccagtgctgataaaatgtttcgactctcttataatcacgagtactactgacaaccaccctccttcctcgcgtagttgcgctcctaagcctcgcttttgccggtggttggaatctccacacctgcaagcatgagacacattttatcagcattgctgggcaaactatccacaaaagaacaagaccctcaacagcgcagcgaacctggacgctcagcctgctgctgcaaaaccccgaagactgcggcggtgactcccaacagcaagacactatttttcaagcactccttctgagaattttcgtgaagacccctaaagaattcaatcaatttgtcagagaaaagccttagaatttcaattgcttggaatgcttatagttatgaacaaaggaagtagtacctcattgtggccacgacggtttccatctttgccactttcaagtccagctctgatttcgtaaacttctgcagcgcctcgaattcatgccttatgaaacgctgttcgtccttcagcgcttggagctacaatatgattcgacagaaaatagggtcccaaattagttacatatttaatacactactgaaattgaatacaattctcattacatgaacaactactacaatggtacaactatgttctaaattaactcaatccttaca

SEQ ID NO: 90129 - DNA, 2173 bp, Oryza sativa
atttctttgaaactcatgcaaaaaaaatttgtataggaattagttgaatttctttagagttcattaaaaaaaattgtacattctaataaatcgttccaatttaacataacaatttgagaaaatcgtcaatttactctttgtttccatctatgctattcaaagttcctttgtctgtctaaaattgtaattaaattgtcaactaatgaaaaatagatgttcataattttttaaaaaattaaaagtgttcaagttttttttttcaagaagctacaaaatttcttcctatgtcataacaatttcttttgtacgatgattcattaaatagagtaggaaaaaagtacaaagctaacaccctgcaagacaatagccaggaaagtaaaaaacccaccatcacgcaccgacacagaacccaggagaattgacaacctatgccacattatcaaaatcaatagagttacaaatttattcctatgacataacaaattgcaaatatattgtagaattgatagtatataaacaacatcataccgaccagcatcactattacaaagattggacccatgtaaaaatcgataggaagatctacttctcaatttgtacaaatattaatcagtacaatattacaaggattggtataaggtgatcacccaacatcttgaactctgccaaatgttggatgcattttctgtctgcgcaaaggcctctcgagaccatcatattgcctttggattgataagcactgcacccggcatggctaggacagtaaagaacctacaggttcatggaggttgtcataatggtattaaacttctaggcaagatttacgagaggtgcataattgcaaagctggcaaatgaactatatataactatttctaaaatgaaaacacattcttattgtcgatgtgtcatttgcatttctaaaaaaaatgtcatcgacttattgcacttaaagctcatttttttgcatgatcaagtagtcaagcctcttgaaatcttactaaaccatggtttgcattaatcagtatagagaacttatttctccctcatctaccgcctaccccaaacacacgttcccaccaccgatcattccgtgctgataattccttcagcctcaatagcatggttcacctgagcaactaatagcctgtagagaacagaaggtgcaaaggttttaagtcatacaccatattgctgaaaattgcagctgcactcagtacctagcatctagcgactatctaaatatttgtatagttattgacttattgggcaatatctaccttgaccaatcaactacattatcacagaatggaaactttgagctcagtaaccatgaacaaacaaatatagaggtgatctggacctttaattcgaagatattaataatacatactataggaccagcaagcaaggaagttccagagtccacaatagcagcgcagccttttgcatagaagccagttgagtggccatcaataaggagatcccccgtgtttaactgctagtagccttaacgagaaactgggacataggcgtgatccctcttatagtgctttggatccatgccaccaaaatacaggctcacctcaccaccagaggatgcaccaggtctcggttcagccaaaatgataaaatcacctgttgacatactgcagctgtgagtgcctactgatgcaagaaatttctagccttcacaaatccgtgctaactctgcactttgtttgtttattgctataacatttgattttaactgggcaagtgtaaatcgtctgtactaatggaaaatagcagtagctggtacctaacttcatgtttcagtacaggttacagtaacccaatgcaattcagcttagactagaaaatctgttaccaagcaattaggctcatatcaaagcctttgcaggttagtcaggttatggtgcaacattgcagcctgcgaactactatattttcatttgcaacaaagcaaaccacatttggctcataatcttgtaaataggccatgcaagccattttacccaaatgaatggcaagagcaatgtaagtcttcctcacaactaatgatggccatgcaagtcattttacccaaatgaatgtgccatcttcatccgcatggcaacccatccagtcatgtacatactgatgtagcatacatagtacttcctccgtttcac

SEQ ID NO: 90130 - DNA, 2705 bp, Oryza sativa
ctttaccactgccagttgaatctcctaaaatgttaacaggtaacagaatgtgcccccattatatttttttttttaaaaaaaaacaaatttcattatcatgtcataatgcataatgttgcacactacctccagtcttagatcctcgaaatgcaggtttataaaatggccgaggcctggtttcctgaggtgctttgatctacatgtaataataagagtttgttaggagaacaaaaaatggcatagaaatgtcacttggacaaacttcagagatcaataatattcagtaatttttgcaagctctcaaagactcacacataacactactaccttggtgcacttctcatatacaccattgtggggcatatgccatccaggccaactattaggcaagtgaaaaaaaaaaggtggctttgactctgggtgatgtgttgatgggacagcgattaaagggggccatctctaaggctagagaatgcttaaaacttaaaaggactaaaatttgaattctatgatgctcaaaaactccaattgcatacttccaacaaatttcaatttcagttcaactacattatcaaacatcaagctaatttcaactttgaatgtctgaatttggagttcaaataaatgaaatttagcgtaatatctcaaattattattttgattacacaaaatcagaatttcaacattacgatttcaaaatctggaactcataacagaattctcagacctcagattgccccctttatgtgatgtcccaccaacacagcatctaggggtcaaatcaatttttttcatgtgctaacggttggcttggacacagtcacatgatggcgtatgtgagaagtgtactgatggagtagttgcatatgtctcagtataaaaatgttggcggcgcatgtgcaaagcatgtccaatttaatgacataaaaatttcccttgaagagaacttaactgccatcaaatacacttatacagtatcgcgagaacaaagcatttgatacaaaacgacctagtccctaaaaatggcatacagttgtaaacaaatcatgagaatgagaaataaattcagtactactcatcaggtattgcggcaaacaacaacggtaaattagcatgtagcatagttctaactcgtatgtgatcaatgacactatattcgcattgagatggaaaactcacacaaaataaacagggaggaaaaccaaacagtgaatttccttaagaactggcagcatatagaattcagagttcatatgcttacctcctttttcttgtcacgctttcttctcacttcatgaaaaggatctgaacagacatgaaaataagttagaggaactaccaacatggaattatgtttttgatctatagttccatactatgctgcatttattagaaatagatcagctagatgacatagcacaggtaagcattgtatagagcatgactgcatgagtataggacaaataagacactcaggaataaaaggaaaggacaagttttgattagctccttcagccaacaaaagcgaccaacacctaaggtatcacttttatgcttgcagtctagcactttcttcccaacaaagaaaggaattattctcgttacactagcttctaacagaggtaaacaattgtcttttaatgcactagttccaacagaaaaaaaaatatcccaacacaaatagataaatgccactggatgcaattccagatacaattcaaagttaccagcttcctaaaaagcaatgtacctagaccaagcattaaacagatagaaagtaacactaaataataatgaatgcaaatagatctctacagaaaggtaaataaaatgcatgaagaaagcttccaaaaccaaatcattgtatagcttaagttgaataacatgttgcaattccatccaacacacaatctatacacaccaaccacacaactcaaacatggaaaacaatcagcagatattaatatatagataaaccatcatgttcctgaataagcacacaaaccaagcccatcgtactaagatattaaactgaatctgcttactacatcataggtagccaattccatctcaagccaagaaaaaaaattcttctgcacaggaaaatatataagcttcattgattgtaaaaacaatatgaattactagcttcccacataggcagctccatgtaatcaaactcacagcaagtgaatacagataagtacagcgttaaaaaaagaacaccagattgacaggcagttcaatagcaaaggtccaagtttggagttacaagagcaccgaaacatgacaaaaatactaaaaacaataaaggaacagattagctcaaagcgcaactcctccaggtccgaggcaatcgtcacgcgaaatcaaaccctagtactccaacctctcacaagcacaccgcgccgcaaaacaaaataaacctgtacaattcaaaatcgtccggggggagcctaggcgacgacgggcgccagaaaccgggggctataataccttgcgagatgaggcgctcgacggcgacgtcggggtccatgccgcaatccaggagcgtggcgtagatctcggcctcggagcggtcggtcaggatccccttaagcccctgcaccagcttcctcgacgccggcgggatcgcggccgcatcccccgcccgaggctccgccgccgccgccgcggcgtagaagggcaccctcccaccgccgccc

SEQ ID NO: 90131 - DNA, 2713 bp, Oryza sativa
gccgctccgcccgcctccgcgaggagcgccgcgcccacgccctccagctccacaagctccgcaagaccgccacccgccgctgccgcaactgcaacaacccctaccgcgaccagaaccccggcggcggcaagttcatgtgctcctactgcggccatgtctccaagcgccccgtcctcgacctcggccctgccgggaccctccccaccggctggccctgcacccaggattggccaaatgctgccggtgaccctgcctactggctcgacctccgctgctcctccgataacctgtactcggggttctcgtggcgcttgttctcttccttctgcgtcagcatgaggtggttctggagggaagtgctcagatttggctcctcgggggacggcgatggcttgggccgagatggtaaaagattagcaaaagaaggggagaacggagcaaaggctgaggagagcagagtcgagaaggcgaaaaggaaggcggaggagaagaggttggcgaggctggagaaggaaatgctagaggaggaggaacgcaagcaacgggaggagatggcaaagctcgtggaggagcggaggaggctaagggatgagaaagcagaggctgaagagagatccaaaggcgccacacctgttggggagaaggatcctcggaaggaagtggaacgtagacggcaggagaggaggaggaaggacgagaaggataagggatcaagcaagagcaattcagattgcgaggatatcgagagaagagtaaccagggaaggggagagaaagcgggattctgatagaagaaatgagccagagaagcgggatgcaacaagagttggcgctgagggtcataagccctataattttgatgctaacaaccagggtagtaagacagtacagagcaaggcaaagtactttggccgtatgacaggcggtctattatcttcttcaagaggttttggtggcggctccttttttggtagaagtgctcagacctctgctcctcaagttaacaaggtgactaaaccgcttgttactgtaactgaccagagtaatgtagtcaaaagagatacccaacctcctgcaacagccaaatctgctactgctggaggaacgacaaattcatggactaatgttcatcgacctgtgagtaacaaaggcattattaattgctgcagcagtctatctgttacgattacgacatatgtcattaattgttttcaccctgactatcgtcttacaaataccatttgcatttttgttatgcttttatgcaggttagtccaaatgtgcagtcacagcctactggccttaaaaagtcatggcaccagctgtttagtcgctcagcatctgtgtcaccttgtcctgatgttcctgctgcagcccgtgaaatgaacgggcaaccagaaccatatggagcacaaattagcaatgctcaaatcttcctatcgcagtatccccctctggacagtaaccctagttcaagccgctgtatgcaatttccaggttttccaccagtgaatggagcacctgccaacatgtcactctctcattttccagctggacatgtgccctactattgtgagccagaaccaacagtgtttgaagaaccagaacaatttgaggacccatgctatgatcctgatgcaattgcgttgcttgggccagtttcagagtccctagataactttcctctcgacttggatagcgggttcatctctagtgacatcaccaaggaaacacatacgaagccttcaccaatcgaatctcctctttcaagatcacgtacattcgaggataatcctattaggcactcaactggaaaagggcctaatggttctattttgcctgaggctagcaatgaacaggggggcacatggcaaatgtggggcacgccattagttcaagaaagtttaggtctacgaggtcctcagactgagtggctcctaccaaacgcaaatcaatttaaccatggtgtcagtcatttgaatggtggaacaagaagctcagtgggttctggtttggatgacaatgatttatggctgcagaaagcgcctttccagcaaatgcctcttgatacaaggagtctgttcctttcacatgatgtctcagagaatgctatacacaacaatttggattttggatcaccaaacaaatcagcccgtttgcaccccattgggccacctggtcattcttggtccaagtaagtatgttgtgacattcttgtaccgctttcagtattttctgcagcaatgaagcatttgcttccattatagacaacaattcgataaccttggtttgagctagaaacatggtcataacttacaacagaattaccctaccccacactttgattatgtgagcataattttcatttaggtcataaaaaatcattacgaatgtagcttcgtgtatcaatacacataaggaccaaatgagatcaaattcacagagtattcttacaaggaataatcatatgccataggggactcctaaatttcttttgtcataatgactaggatgggtgctaccactttatctataaaaaatggggcaagagtgataccagttaagagcaaacaatacactctgagtctccaatttagaaggaatcaagggagcaaatacataaatttccataatagcaatttttgcccccaaaagctggggaccatggcccagtttgaccatgccttgcagtggttgcatccttatatggatgg

SEQ ID NO: 90132 - DNA, 894 bp, Oryza sativa
ccggcggcgagcgcggtgacatgcgggcaggtggtgagcatgctggcaccgtgcatcatgtacgcgacggggagggtgtccgcccccaccggcggctgctgcgacggggtcaggaccctcaattctgctgccgccaccaccgccgaccgccagaccacctgcgcctgcctcaagcagcagaccagcgccatgggcggcctgaggcccgacctcgtcgccggcatcccctccaagtgcgacgtcaacatcccctacgccatcagcccttccaccgactgctccaggtaattcatttgccatcaataacggttttgatctgtacgttattagctgcagcttaattaaccattgttaatctgcctatgtatttgtgcgttaattcgcacgcagggtgcactgatgagcggatcaacgtcgacaagtgatgcgacaataataaaggagagatcgatccatcgatctccagctctcatttcgcggttgctatgtgcatgcgccgtcgtcaatgatcgagctagaaatatatatgcatgttgctccttcgttgtgttacttcctgcttacctgctgcggtttgatagttagctagtgtgagagactgtgagggttgattttggggcagacgaatcatgaatctcagaggaccttgtaccactgcacgcttcaatatatatccatcaaatgcagggtcttttaataatgcatcttgtcaattagtatttcagttcattagctggatctgcatataatgctcctccagattctggcatgttttcatttatacctgttgggctggagccccttcggccgcgtgcagcctataaatctgggctggcctggaacgggaatggggctcaagcgcggcccgttatgtgtgtcgtgcgacccatgttg

SEQ ID NO: 90133 - DNA, 2857 bp, Oryza sativa
gccctttgaactggtcaaactctaatactgattgctcagtatatctcggtaatctataatagatgcatgggcacaaaactcggtaagggtgaaaaaggcattatattagttagcactaacctccaggctttccaatattgacaagattaacatagaagcatgaatatggtctggtataacacactttccttaatttgtcatattcctttttcatataaggatttttctatgacttgaggaagtaaataacaatacaattaattcttgaacatgcaaaacagtatgaagcaaaatacaatctacatatggaattttgcacattttatcatgaaaataatttctcactgtagtttatcttatcaaaagaagtaacacagagcatgagagatgcaccgctaattgtgcctcctgcaaggaagaaagttagtagagctaatcgtttgatagtatcttttagagaattttattactatgtatgtaattctatactaagtaattctgcaatatttttcatgcacaaatcctccttatcttcagtctctcatatactcaatcctgaaacaaggagggcaaagatggctacctcctcaatcactctgaaagctttcaaaaatttgatgaagctactctaaaacttcagtctgaagacctgaaacaccaaaaacaattgatagtttgactccgaattgatttgtgaaactattctaaactcaattgcgtaaattactaaattggatcaaatacaggattggttacagggcattgagtaaaactactgaaacatttgcaaactcaaaattgtaatcataaaacctaaacagatgcataaaccattcagtaaagaacgcaaggcaagcttaattaacctttgcccgtgctgtcgcagtaatttgttgcatgcccagtattgatccagtccaaaccatttctccatgtactcatctaggcttgcatgctctgtggcaaccggaattcactaataaactggtaaattgttcctttagagtttagacaatacatcgaaagtgcttgcacattactaatgcacgacattttacatattcaggtgtcatgaataaaaatgtaaaccggaaaaattgtcactgcatgcacaaatcagaactttccgtgtgtgtgcaagcatgccattcattaatatatgcaaagacaaacttaaacgacacaaggtaaactacagtatgaatacaagtggttcaatagagcacaattccagaattgaggtaaattctcattatgtatataaccttcggtacacatcacagaataatgtatacaacggaaagtaaaagaagctctcaatattggcatcatgatttagataattaaattcttctttttaatttggatgtcaatttggatggtgatctctaaagagagcacacaacatgtgtatcaatttaattggtttcctgggctatgttgctgaccaagcaattaatgaagttcaaaagaaattctctgaattttcatatataaacatcccaataatgacttaccttgttgcagtgcgaggccgatgccggggttgagaaatccgaccgcggggacttggaatgtcggactcacacacggccggaggaaggggctggtgccgggatcgaccacgaaaatcgggcggcaacacttaggccagatcggagcaaggagggaggagcgccaaaaatcaaatggaagacatcaaacccaaaaatcggttgtgatctgtcgacgaatctggcttgtcggtccttactgatctgtctcttgatcccaatccccatctctctaattctttttgttcgctctaattctttttgttcgtcctttgagcaatagggatttggtgacggccgcaagagggatgcagtagggggaggaggagcgacggcgacgatgtgaaggcagtacggcgaggaggaggggatggaggcgccggagaggcggtgcgacgattagggtttgggaggcgcgccggttgggcgaaggagggagcgagcgggttttggggagagaacacacacgcgggggaggaggagtgatctagaccgttagatgatcgggagatattctggtccgttggatttgatgaatgagtaatgtaggtataagagtgagttggtgaattatagggtagactattgtccacacttgatgatatgacattgacatatgcatgcaggaaatgcaaacactatatgtaaaccgtaatagcatatacttcctccgtcccctaatataagggattttgatattttacttgtactgtttgaccactcgtcttattcaaaatatttgtgcaaatataaaaacgaaaaattatgtttaaagtactttcgataataaagtaagacacaaataaaataaataataatttaaaaaaaaattgaataagacgaatggtcaaacagtataaataaaatgttaaaattccttatattagcggacatagggagtactaatatataaactctctctggatggctggatgcatgtgccatgaatttatcctaaattagggtactgcaaattaaagttggcaagtagtaaatgaaacaattcaacaaccaccaactcatgatcaaaagtcatatgtacaattaacaaaaagcacacggtgttttaattttagctttccaccgccctgcacatgtaactgcacgtgtaaggtatcaactgatgtgtcggacactcggactcgatcggaagtcctcttttctctaggattgaaacactgcgcttcttcaaaaattaccgggaagcacataaacgatttcactaattactctctaggatgaaaaccaactccaacttaatataggcctatcatcgatatgatctccggctgggctgcaggaat

SEQ ID NO: 90134 - DNA, 1410 bp, Oryza sativa
attcctggttggagtctcccagtggatacagtagctttgttgaacatacctcatgtagccacaaatttcattatttcaaggcacattattatctgcattgcatatataggaccagatggggggacgaaagctgctaccttgatttctttatcacattttaggaagaataacaactcccttttatacaactgcaatccatgttgttcataagcaatgtgacactctagtgctataaaaaccaattattttcttgcttgttacatccactgtttcagaagaattacctcctttcatacctttcagtgtgtacttgagcaaatttgcttctgttggttcgatttttcaaacttcacatatagcttagcttgccacaatatgtgaatgttatttgctttcccaagtattccccgcttttcagatcactcactgctatgtttctttcagttactagaatggaatggtaaagcatactctagtacctataaaatgagcttaagagtttcatttgttacgtttgatctaaataaaattatgtgtttttcaaaaaaattccagacaaatctatatctgtgaaaaaacaaatgttgaaatgtcatagagtattctgacagatgtatataatttcttgccatctattgctcatctattccattttactttagatgctcgatataagaaatatagcatataaaactttctgtcttcatgcaacaacagaatttctccatgtcaagcctggaaaaggtgctgcttttgtaaggacaaaaatgcgtaattatatcactggcaacacagttgacaaaacctttcgagctggaagtacggtaatccaagcagaaactcacctttctaaacctgtagaaattactctctccgtttcaggttataagacgttttgactttggtcaaagttagattgctttaagttttaccaagtttgtagaaaaaagtagtaacattttcaacccaagacaaatttattatgaaaatatattcaattattgatttgatgaaactaatttagtattatcaatattactatatttgtctataaatttagtcaaatttaaagcagtttgattttgaccaaagtcaaaatgtcttataacctagaacggagggagtaccattctgtgactgtatcagatcatgctttagcttatgtaatcagaagcaactgatatgatactcatcaactctccttcaatgtgttctaacaaagaagagcacttattttgtcacttttgttttagatcccagaggcatccatttcaaaggaaactaagcaatttacctacaaggatggagcccagtttgtgttcatggatctggtacatgtttcagtttttcattcaaacatatcatgaaaagagtagtcgctagctgtctgtatgcttcagtaatcagtat

SEQ ID NO: 90135 - DNA, 710 bp, Oryza sativa
aattcctgcagccctaatttgcccttcttaacccttctgtacttaaaatgacttgacaccaacatcaagataaaaatgaagctaccaacattaaaattattggagctacagcccagcaaaactcaagagctagggcttctagaattaagaatgatcattatttcctatagtttcaggcagatgtattgcttacattacgtccatttgactatgtgcagcatgcttcaaagcactgttgcgtctcaccttcattctcagatgctcaacatcatcccatctcttcgcttctgcataaacatttgatattgtgacaagtcctccattatcagttagaatcagctcatgtagttaatgaaaaaacttgtaagcaagatcgatgtgcccatgcactcggcaagctgccaacaacatcttccacagaacagagtttgctgttgaagggttttctttaatcatcagataagcttcttcaattcttccatagcggcaaagcatatcaatcatgcagccataatgcttaacatcaggaacaattctgtagtcctcaatcatgctattaaaatatttcctcccctcattcactaggccaccatggctgcaggcagtcaagacacccaaaaatgtgacaggatttggctcaattttcatcgaatcaaagagctctagagcctcatatgagcagccatgtactgagaaaccaatgatcatcg

SEQ ID NO: 90136 - DNA, 518 bp, Oryza sativa
ctaaaaatcaaagtatttatgtggtttcttcacaaaaaagtaatcttgacgaaagataacctcataaagagaaaatggaggggtaacaagcaatgttgtttttgtaatacacaagagaccatccaacatcttttctttgactgtcatgttgcacgttttgcttggcgatatgtctttttttgccttcaatatccccctccccacaatgcaaaagatatttttttttgtaactggctaaggggagtgcctagacccacagaaaaatgattttatttggagctagtgttctatgttggtcaatttggcgttgttgtaatgatatggtttttaaccataaaaaaatgcttaacatcatgcaggttatcttcatgtgttccaattggcttcactctgtgtatgatgctttcacaggaacaacaggatactatgcgcaatgctgctacacgcttggaattggtagccaaggaacttttactccagtttggatggcgtagtacctacagaattttgtgatagaa

SEQ ID NO: 90137 - DNA, 625 bp, Oryza sativa
gatgatggatcttacaatgtgtttgtctcattaatcatctgctctggtgaaatatgtacgcacatatgcagtacaaaaatttgagaaagcattttgatcctgtcgagggttcaaatgctgtaaacaatacagtcaagcctgggtgaggtgagggaatgggccaaaaatgcggagacaaaaactaatgctctgttgatgtctagtctctcatctcttctatgctctgttcatatactggccagttcttgaatcaatcaggatatcatcgcctacgttcacaaacgagggcactgtgacaacagctcctgtttccacggttgctggttttgttcctcctacaaaatatacagttaaaagattattattctgatcgtgtcagctttaataagaaaacatttttttttctaattgtgatattcacatgcagttataccttgtgcactgtcaccttgccctgggtcagtatcagttacagtcagcctaacggtgatggggagatcaaaatcaatgatctgcaggacatattaatgtcagtgaccaatatcctattctgtgcaagaatacataactaatcaaacagcacattatcaagagtttgaaacaaaatatgaacatatgaactgac

SEQ ID NO: 90138 - DNA, 4174 bp, Oryza sativa
tgcaaatgcatcatagcttggcaaatctcctacacacccagcataacggccatgaagagccaaaacagctggtggtggcttgcgagagcctttctcttgcttgttcaaatttatgaatttcgtcactgtaagctgatgacggttgaagaacgggttcttgcttccaatgccgagaccttggtccatctgtagccgacaagaaaactttgttcagagagtttactttagcatggagaattttgtataaaaacatgctacttttgaacaaaacttattagcccaaatatcatcaatatgtttgcaaaaatgttttttttcccaataacgcacaaattacttgttcactattcctttgaaactcttgaacaaatgtaccgaaacatttcctaaaattttccaaaatatcgatcagtctcattggtcttttcaggtgacaactttttgctacagagctacctggcaatgagtaaaggttgagtttgtgttcctagaaccagggtacaaataagcatacctggaatatacatctgtcaccgattgttgcaccattgacgaactctgtattgtctcgagttatattagcttgtagaaacgccattcggtctacgccagtcccacttaaggttgtgggaggtccaatcatgctcaaggcgccactaggcaattgtcgagaacgatgtgtacatatattgttattctcatcgcgtgttgtaatctcttccactatgaggccatacgtgaatttgctctgctttgtgaagctctgaataaaagatccaaaatgcagtttcctatatgttgttaataactgtccatgatagttaaaaggagtggaaggtaatatcaattgtgcaaacctctgttatattggctttaaatccaattctatcaacccagataggtggagcttcatacatattgggaccagcaacgaatataggactcaatttcctggagttgaaacagctaattttgaaggtgcggttcctactaaggttgtcgataccatccagataaggatgggcatactccagcttgaacgaaagatcatcctaatactcaccaaaataccatactatcatgtatgactgatataacagcagccaaaagcagcatcgaagctgatgggaaaaagaaaaaaaaaactaactaccaactcacctcagggttgagcaagttgctggatgtaacagaaccaatgagagacctttttagaccacagatgttgcggtgctcaaatgacacagttcctcctggttgaatggacgcctaagaggaagttgtgaggttatacaaaatgacttgcagtgatgagggaatgtatatattcacaatggtgtctagcatgttaagtacatattcgatctggaagaacaaaaggttgcacattaccagagttggtcttccttgagagccaggcacaatgctccaatctgtgatcacctgagctgattttgggtcatgttccttgagcttaattgcaactattactcccccttgatttgtctcatcagggcgaggctgtacttctatagtggagaacaaaccaagcgaatcgatattcttcagagcctgcttccccgccccattgttgtagatatgcccaggacgaagctgtaagatatcaacagccattttattgcacaacagtcacattggcacaactggtacaattatcagagaatcataatcaaatatacgcaaagccaagaaatttgttgcaaaatcaaacaacaaaatcatagccatctgctattaaaaatgttagtttttcttgttagacatggagcttgacagtgatactagcaacattaacaaaacttggatcaagagacattttattgcaaaacagtcacgttggctcaaccagtataattatcggagaaatcggctaagaaattcgtcgcaaaattaaacaacaaaatcatagccatctgctattgaaaatctgaacattaatttagacattgagctcgacagtgatagatactagcaaaattatttgtacgcaaacctgttgaggaagctccctgtcaatgagagggatgctggtgttgccgtcgacgacattgccgagcttgtccaggaactggtactccaccttggtgatgtccccctccaccacctcgcacaccacctcgccggcgtcgaggttgccgtggtagctgaccacctgcgcgcaatggaacccctcgtcgtggtaccacctctcgatgcgccccgccatcctcttgagcagcccggagctcaccttcctctgcctcttcaccatcccttgcagctccctctgcaacttctccggcagtacgcacggcttggcgcggcggacgagctgctggtactcgcgctcctgcctccggaggtgttccatcctctccctcgccgtcatgtcgtcgtcgagctcgagctcatcgccgtccggccgcgccatggggccgcccacgttgatgcacttgaagtgttcgaccgcgggccactcggtctcggcgtaggagacggtgaggccgagcgtgccgtccggcttgggcttggtttggagggtgacgtggtcgaacatgccggaggtggcgagcgcgtcgagctcgtcgcgcagctgcgccctggtgtagacgccgccggggcgcagcgcgtcgaagaggggggcctccgcggcggcggcggcggcggcgcgggtgcggcagttgaggaaggtgagatccgagaccttgtacctcttcttgccgtccagcctggagagcggcaccggcagcgcgctagccgcgaggccgtgcgcgtcccagtccggcgacggcttccctccgtccgcgcgcgccgcgccggcggagaagaagccggacaggaagccaccgactccggcgggccatccctggccctgggcagtgcttcttccatcatcggaggcggagtcgagggtgaagcagcttggcattgcgattgcggttgttaaggttggcgccaatggcgcgagagcaccacgacgacgacgacgacggatgcttctgaataatcgatcgcgcaaccagtttatgtttggaatgccagatttttctttttccgcaagaaccaagcaaaactgattcacacgaaaattctatacaaaattcatgctttccaaacaggtctttttgggtggggaatgccatacttgtgttcttcctcgagatcacaaacttgcctaattttgcaatctccatatttccccagcgctatatgggagcaaagcagccaggtacgatttgaaactatgcggccacaggataatccagaaatttacaatgggctaaatttgctaaacataagatcctcagagtgatactaccacacatatcgtcaggctgtgtgttcatttgcagctcatgatctccagtttttcacctcttctcatcccatttgagcaacatggggggaagttgcatgttttcctccctcttttcatagctcgatatggtgagaatgattgggaacatctccttggttgtccaggggcatgtactgggccatgatggcgcggatctctgaatccatgtacctctgtacacaggcacaaccaatgcaaaagaaaaagcgagaatttagatgccaattcagagttatcaacagagttaacctgaacaaagttacccatatcatacccggatcctgtatttgtatactgcgtatcctgcaatgcctgctaccactaggccaaagaagatcacccacaagaagttccatcctacctctgttgctgcatttttgcctaaatacagacaaagacaaattagtctactcacttaagtaaaatttcttctataatctatacactgacattctacactttcaatggttgcagaatgctgatcatgatttatgtgggtccgtcaaatagatcagacagaccgcaaaagtatatgaatgcacaagtagtggactgtttgatatgaagaaagagcaacatatgcatgaggagccgggagggacatacttatgcatgtatcatgctccttcatataaagcaagccgccactgcaaccgcattcatagcttccccatgtgttcttgcatttgcattccttgcactggcatgcagtcctttccttgcattcatcaatatctttcacaaaatatttcacatcagtacaaggggtcaagtgcacaacaagggtgtattgcaagtgatatttcactaaaacta

SEQ ID NO: 90139 - DNA, 995 bp, Oryza sativa
attcctgcagccctgggataattggtctcgtgtggacgcaactgtcgcgaagcgtatgcgaccactctgccttcttgcatcaacacacatcccaacccttggcgagatgcatcacagtagacttggaagtcttttgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaactgacggtaatagcccgcaagtccaagaaaactccggatctgagaaactgtctttggtggggtccactttgtaactgattccacatttgatggatccactgccacgccttgagcagaaatgacgtgacccagaaatttgacctccgataaccagaagttacacttgctaaacttggcatataactggtgctccttcaatttctcaagtaccagacgaagatgttgctcatgttcctcttctgattttgaataaataagtatgtcgtcaatgaataccacgacaaacttgtcaagaaactccataaacactttgttcatcaagttcatgaagaaagccggtgcattggtgagtccaaatgacataaccgtgcactcaaacaacccataccgagtgatgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatccacgcacatcctcttggtcttgtctttcttctccacaaagatcaccggagcaccccaaggtgaagtactcggtcggatgtaccctttctgcagctgttcgtcaacctgcttcttgacctctgctagctcctgggctgcaggaat

SEQ ID NO: 90140 - DNA, 3537 bp, Oryza sativa
aagtaccagcacgagggtgacctccggcgagctcgctcgtgtcgtccctgagctcagccgctgccgccaccataccccgagtcgtcgccggtccaacctccgccaccgtggcctcaagcttgtatagagctcagctgccggagcttgacgccctctgcccttaccgctgctcccttctccttcggccctcaaccgcgcgcgccgcgccttcaaccgtccgccatcgctgtcgttgtctaccaccagctgcgccatcgttgttgtccaccatcagccacccgtcgtcgtcctcaccaccagtgctgaaagaagatttggggaagaagggttggatcggatgtggaggagctcacatgcaaatatgttgccactctggatggccacataagctagtcaacccggtcagagatcctttagacctcaatgagtcacttaaacaagaccgtggatcctaatgtcgatttttcaagatcatggacctaagtgacacctcgctccaactttaaggaccgaccgtgtactttactctaggtaaaagttgataaaagaattgccaaacttacaagattgtcaatgaagacaactgtgaaagggcatttggaatcgagcctgtcaagttgttgtttgatagatccctgcaagatatggagcaagattttccaaattttaactcagattacgcaaacaagttaatacatccgacatcatgaactcataacatacaaatattggagggccttgagattcccaaaagaggacgatatctcaccactcaaaccaatttttgacaggtttctgcaaagagaatatgatcagcccaatttcattgcacagttaattagctcccattagatttaatttcctcttgctatttatgcatgtgctgatttggcattctgagggtgctaataataataataaaaaagatcaggctggtgattgatggtggtatcgaccaccatagattgtattaaaatttcatatcaaataaaaaattctattggaaataacatggggtcttaattaatttttactgccatgcatggcctctttagtttcattagtatcctaaaacttaataatttctaaattcacaagcaacaagtatatcatctcttttattaatttaattttgaactttaaattaataattagcaagttataattgatgggttctctttaattattttaatctaagccattaactatgcattgtgtatacaattaaaattttcatatttacaatagtttaacaatagccatacacgtttgcactctttttatttgggatggaggtaatagttttgttttttcatcacaatagtcatgttgtttttggctaatggaatgaattattacttacaagctcgtgattcttgcagggttagaaatggcatagctgcaggtcaaattatcccacgcaagatttctagggaggcacgggtcacccatccaattctttttcacctggtacttcgccttgatcgtcatgattgctgatactgtcaatcaccaaaaaatttcatcaatgcacatgacatgcttgaccatcagctagctcatgtatgtgcatatttcagtttttctcaaattttttatgaatttagtcaaattctgttaaattgtgtcaaaatttcagaaaatttcggtccaaaaatttctgaaattttcaaaattttaaaaattttaattctaccgaaatggctgaaattttagatgaaatcgaaattgaaaaccctgagcacataccatcttgtgagtcggtgccaatgttagcggtggagatgacagagtacacctcgacggcgttgatgagcggcggcatcgtcgagttggcggtggcgttaatggtgatgttgtactgcgggtgtcgcacaaagggtttggagctgtaggaggcctcggcgtagagaaacgatggtgtgaaaccatcgtcgaacaatatgccgttgatgttgatatagaattgccgtgtggcgttgttggggaggttctcaagctcggagaagtgaaagatggcgatgtaccctggcgctgggtcgttgggctgcggctgtgagttccagaagaagtcgatgttgttggaggcgttgattggcgtgaccgctgtctgcatcaccgccgtcggcgcctcgaacaggtcgttgtctatgttctgacccctgtttgtcgttgatatctcgttccacttggccgcatcaaaccaaggaaaccatactctgtcgtgcggatcatccggatacctggccattgaatcgatcagttgcatttcctacagataagggtaattttaccatccttaaaaaaaatattagaagatatcatattttctaatttaaaaattggtactttctcaaaaaccgtaaaatttatctacagagaattagagcaagtttaatagtatagccaactattagctccaatttatctatagccaatctaatagctcattcatacaatagtacatactacactattagtacctggacccacatgtcatacacactgtgtattggagtccatgctacagctggctataaatctgtagcccgcttcccttctctctcctcatctatttccttaaaatatgtttgcagctggcttatagcctgctattgtacctgctcttagctaaatatctggctcttatcgggaaaagtgatttcatcctttaagagatatcccctcattttgcatgttggtaatcagaaaaaatatatgaaagtatctgtaaatacgaatctaatattacgctatttatatcactaaacctatatattgtggaaaattttatgatatttgataaagtgcctaaagataccaagattttacaccaataattttgatacctcaaaatatttagtaccgggaggtaccaaattttacactaaaaaatatgatacctttcgataacttcttaagaatagtaaaattaccctatattgtgagactaacttttagttaaaatttatcgagtttgaattatcaccagtaatactgatgatagtataaataaatgatatgataataaatataaacagtctatacgcgtaggaaactttaacttagctcacctgatggaggtttcgtcagatgggccgaagttgagcctggcgagttggagtaggccctgagtggcgttcacctgcgggtagagcttgttcataagaggcctgaggtccaacccggagatgaacggtgtcccggcgccggtgttcaccaggcagacttgcacggagtcgtcgggcacgacgacgatggcctcccggttcaccggctggatcgggtccgtgatgttcaccaccgtccagaagttgacgccgatgtggaggtcaaacgacacgggcagcttgttgaggccgtcgtagttgccgtacatgaaggtggcgcggatgagatacttgaggccggccacgagcgaccggagcgtgtagcagttgcgcgcgccgtcggggaagctgcgcacgttgtagtagcgcgccgtgaccgccggcttgatgtactccggcgagacgttgtagtgcttgccgccgtcgg

SEQ ID NO: 90141 - DNA, 3865 bp, Oryza sativa
ccgattcgcatggatgcacatcatgcgctgccagtgccatcccgtgcgagatggcctttaggtctatctatttacctgtttctttaggccttcatttaatccctctacaagagaattgagttaaatttaaagagagtatcttaggaaaagaaaaaaaatacggtatcggtatgtcatacgtgaaaatgatattttagctgtgattgtgaatcacgttctggtgtgcttcgaatttgcacccggtgtatgcatatcttaggaaaagaaaaattagctctacggatcaaccacctggaatcaggcaggataaattcagtaaaatcaaatcccagtgccgtcgcccacaggctgacaggcatacgtatgctggttttaggaagagggcacggtcggccggccccataccgcatcgccgcccgccatgtcgtccacgtccagaagcaaagccgagtcaattcccggcgtcgcgtaactggcttgcgccgcaggaaacgaaagctgcagatcccatgtagacagatcatttattgacctttgcttacgaaacagcacaataggcggcggatgaggggattataaactcagagtttgttttcatcttgtttgcattctcaaattccaaaacgttactaccaaatatacatacagtttttcatttccgaggggaaatcaaatttgtgttccgctattaatccgggaagttggctgactaagctccatacgcaagtacgcaacacacagactgacaaatagaaatactctttttactcgtatatgtttacagcttgttggtacaaatgggcaaacacgctaataaaaaaaacacctgacaccgatgaataggcaaatggcttaaccatgaggccataacatctgattctatattaaaatgtaaaacaggaaggacgatattggcgtgcgtctgaacaaaaacgcagcatgccactgaacaaaacgcagcatgccgccgaatgatttaggggccgcggaattgtggcagcatgatcacatgcttagttgagaacatgaatagggagggtagttgatcatgcacccctcatctgtccagcaaaaattgtgtatgggctctatttattccagtcgatggccatttggccactgcaaagctgcggcttgaaattccagaacaacccacgcaggtccaggtgctgaatgctcacttggaatggaacttgcgcctgacagattcgtagctaggcacatgaataactgcaacacgagcgtttcaattagtcagtgctcagactctcagagcttgcatagggccatgctttaacttccaagtttcgacataccatcaccccatgatgccaatgtaagcggcgaagaaataatcttctttgcagttgaagaaatgtcatttaaagtgatctcctcaacagttttcaggaagtactcaataggtttcctgcacaacacaaagcactccaagataaacaaggttctctggcaaatggaagtgactatctaaattaataccctatgcaattgctggattacttagaaaaaatgctagcttaacagatttagcactgctgcatgcgtcaaatgtatgaacctctgcctcatggtactaaaacttctggctcacttctaccatgtatgtgcaccttttctagatgcaacggcatggtgatgacaataagtttatagcaccaatgggcacgcagaagaaactatagaaataaatcctgaatatatgcttggacgtgctggcagtctgacacccaaaatactttgggtgataccataaaaaagcatctaccacaccataaccacagcatcactttggaaaaggaacaccacaaccacagtaagtgtgtccagaacacagtattataggtgacttgtcaaactttgggacatgattgcaggaaaaaaccacaagacaactttagttgcctatgtaatatggtcaacatatattgcccaaccagcttggaaacataataatttacgcaagcgtacatagattgtgatagttcatggtgatgactcattattttacgcacattagtaaaaagatttgcattccatgcatataaacatgacatggaaatatgctatttaattaggaacatagggattaataggaaattgactccattaatgtactagcgattacttataagcatacctttcaccataagtcagtacctgtcttccaatatcttcagaggccacgatctgcgataaggaggaagtacaattaaaaaaacatttcagggaagaagcatgaaattcatgcgattggaacttgatcaggagtaagaacaacatactcttgattccaagtccatcagacttgaagacttggtagcctctttagcacgatcaagttgttcttgtgtaactgaacaaagtaaaagacagggaaaggacaacacataatgaccagtctaatctgaaaatagattgtaactttgaggtaaaaaattaaagaaaccttttccaggagttgcaacttcatggagttcccttgctgcaaatccacagcacttgatacaaaatctgggttctggtaaattaacatgacagtcaaaagcaaagtggaatgtatgaaaatccatgataaatgcagaaacttctatagaagcttgagtaaatcattgagcctttgacttgtatttcaatctgactgttcggatggttataattaaagaccagggcataattactggcctgaaatgtgcatttattagttactaccctcttgaaacatttgaaaccacaaaattgtacacgagatgaaatgagcattgatgtacataggaagaaactaaatactcagtttcagtgagtgctttctgcatttcttactgaggtacaatataacttcggttttagttactactacttactagcataagccaccaactccttattttaaacagtaagataaaattacagttgtttgtataaggcattaatccagaattcaggtaggacaaatgtaatggtgtggtaagagggacagacattacttagaatagaaagggtattatatttacagtagtttgagaatgatattcaaaaaaaaaagggaaagaattcacaagcagatttgattctgttcattgcttgaatatagaagggaaaacatatcattggttatgctccaaaagagacttacagtggttgcatgtattccaaaaaggccagaattgttgtaaatactgctgaaagcagagaatgattcgatctgtccataattgttcaagacacggagatctgtcggtacagaatcacagctgatgttaagacactttaccaaggtatatgcttattgatgctctgatatgcataatggttaaaagagaagcattaagcttacacaaccaagaatgcattcctttcccagggccaccggtcgagaaggaccctcctccacccatgagcacctacaatttatattaatcttatgtttcagtacaatagatttgaataatagagcttgcaacgcaataaaatatgaaataatccatcaattcctatatagtacagaatcaacagaccatataggttagccataaataattggatcacttcaacatattgttaggcatacctgaagcacagtcacaatcattgcagttttctcttgacgccagccacctggaacctcaaaggcaagtgcaatgtgtgtactctaacaaaaaatacattaggaacaagaaaagtaactgtgaagacagacttgagcccttgagaatgataatagaagaggccaactcactgtagaatctgcttggcaatgataatcccctcctacatacactgattttggctcttcaggacgtttcacactgggaaggtctgatagaagtggttctgcgactgaaac

SEQ ID NO: 90142 - DNA, 680 bp, Oryza sativa
cgcaggactggtacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacaccacctatactgggaaaaggttggcagagctttatctttcaagaatcatgtgtttgcatggggtacctaagaagattgtatctgatcgaggaagccaattcacttcaaaattttggcagaaactgcaagaagaattggggactcgtttgaatttcagcacggcttatcatccgcaaactgatggtcagaccgaaagggtcaatcagatcttggaagatatgttgagagcttgtgcacttgattttggtggagcctgggataaaagtctgccttatgcggaattctcttacaacaacagttatcaggctagtttgcaaatggcaccgtttgaagcattgtatggccggaagtgtcgtacgccactcttctgggatcaaacaggtgagcgccaactgtttgggacagaagtgttaaccgaagcagaggagaaagtcaggaccgtcagggaaagactgcgaatcgcccagtctcggcaaaagagttatgctgataaccgccgaagagagcttactttcgaagcag

SEQ ID NO: 90143 - DNA, 1000 bp, Oryza sativa
attcctgcagcccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttacacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggtttcggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcat

SEQ ID NO: 90144 - DNA, 668 bp, Oryza sativa
tcaagccagaagcaatgctcctattacgagctacattgttccatttagatatgaactccctcttggtttcagaatcagggaagtgctgacgaagaacaattaatccttgcatatagctcatggttttaagatctccagacatggaggagtccatgacagcagctagccaatcggttactatccagacatagccactgtccatcatccggagcttgttagctatagaaaatattctcatccctgcgtcaggattgacgtgcacaacaaacactcttgattccatcatgtttgctctaaacagtacatcattgattgtagctgcatttgaatttggaggaaccgctgctttgtatgaaattcttgcccgacttaatgcaagcgcatcactaagggctgccaccgcacctctcccataatcatcatcaacaaaaatagcagtgacctctttccattgatagtagtcaacgatgctagcaacggcatgcatttggaagtagtcactcatggtactccttaaaaagtacggatactctgatgcagaaagtgttggatcagttgctgcgaacgataaaagaggaacatgtagctcattaacaacatgtgaaataacatggcctattccagaggattgtggaccaatgacagcaaccacgtttttctccattaac

SEQ ID NO: 90145 - DNA, 631 bp, Oryza sativa
ttttcacggccactaagtgacactccttaggagcggcttgaaaccgtgcacacatgcaaacactaaacatgatatccggcctagatgcggtaaggtaaaacaagctaccaatcatagaacgataaagctttaaatctacctgtttacctccctcatcaaggtcgagatgcccgttggttgccataggtgtcttgatgggctttgcatcctccaagccaaatctcttgagtagatccttgatgtacttggtttggctaacgaacgtcccatccttgagttgcttgatttgaagtccaagaaagaagctcaactctccaatcatggacatctcaaattccctagacatcatatcaccaaattccttacaaaatacctcattagtagaaccgaatatgatgtcatcaacataaatttgacacacaaagaaatcatcaccaatgatttttgtgaaaagggtggtgtcaacttttccaattttgaaattctttgacaaaagaaaatctctcaatctttcataccaagccctaggagcttgttttaagagagaatcccttatatgccactagaatttgaccagttcccttatatgccactcaaaattggctgctcccttatatgccactagttcaag

SEQ ID NO: 90146 - DNA, 2332 bp, Oryza sativa
ttgctatagggcaatcttttagcctcgtaccccacgcatccccgcatcattgcgcgaatagagcttggtgatgatatggggacacgataccaggtgcgtcgttgaaatgtcagctcgttaagtactgatgatagtccttcactggagaaagtgatgttcaaattcagtggtcttagactttgggtaagatcatgcaaagggagaagcttcaacaataatcgaatgccatttttcttgttgcaacaacaatctgactaagacagaagctgtagccttaaaagaaaattttcaacaacatgtctacaccttttgagcggcagaaattgtgtgctttgttggccaagagtgacagccatggcggccaaccgtgaagctacgcagaaataggagcaaggaaacagaggaagaagaaaggaactggggggacgattttggatcgtcggatgataacgaacggtggatagagcagaactgcacgcctgtgactttgcaacccaaagtcagaggatccgcttccccagatgagccacgcccatgcgcacgcggcggagacgcaacggccaacggctcgtgcaacggcggatgctcgcggttttggggcggtgaaactcagggaaacccgctgagccgtagtacaaattcgacacgcaccggtgtcgtacaaatccgagagacacgatggtttccgcgcaagatgcacttccgcacgggcgcgctgccgaggatctcaattctaaaccgtatccagatgaattttactctgcttgttaccctatctatgtctgactaggttggatatacttatccatataaaggcgaaatgctatacgtatgacttgagcatctgacttctggacgactgcgtagtacacaacgtcagtaacaaatagaatatcttacaaagcctcacaccgtcacgcatcgcattgttcttataaaaggtaagtggaacccgttcaatattagatttgaagtcaatatccccaagccaataattcatcataactaaagtttaagttgcttttagaaaatttaggagtaactagcgacattattgactttcacatatactcggcaaagaagaaaaaaaaagatgatgtctcaaaatcaggttatctttaacctataactcataatatatgtggtagtaattactccctccctctcataataacttcgttttagacccttccattccatttgccctataataagtttatttttttaaagacattattacgtcagagtttataaaaatagagtataaatatattttgagtatataaagagagaaatgattacattgaaatttgataaaacgggagtatcatagacttttggggttttgtattgatatgtatgggatagataaaaaatgaaattattttagaacgggggaatatataaggctaaagggacttatattttggatcatatactatataagttactctcatgtactaccattaatgctccgttagcattggcgtccatcatatgttagagtcccagcttggttgaggcagggctgtgccgtcaaatttgtatgccctgtacaatgctctaagtgagacctaaatcaagtaccaaatatagctaaaataagggataatttcgtttttgcccccattttcatctctaatattgattttgcccctactttttggggttttcgtttttgcccccactttttttttgaactgaaagagatgtttgcccctgttttggatggaggttagtgggactgaatttatggaagaaaataaagaatttttgatttagtgaactacctttttacccctgtgaaatgtttcccaggagtgaaccgaggctgcagcaggttcatggaccaaccccgcgcttggcccctgagggccaaggagaagacgttcgccatgacccggtcgccaccctccgccgcctctatgatcgccgtgcagatctggagggactcggaggggtcggcgccatcatcgtacttctcggtgaggcagggctggagctttgggggtcctcggacattccgaagactcgccacaaagacatggtagccaagcttacctggtggggatgtggggggccttgccccctgcctggggtggcgcgacactcctgaggatgctgcgccttcccccgtagcggcggtgcgacactcaccacgccggcgctcgaaagaacctcaaaaatcacaacacgtcccctacctggcgtgccagaggtgtcggagaatgaactcctccaccagggaaccgtgaggcccccctttgtgagttcggccgggggcagcgggtgagattcgagggcttggtgagcggagctgtgtggtcttgat

SEQ ID NO: 90147 - DNA, 950 bp, Oryza sativa
cgtaggtatcatccttcagtgaggaatagggcagccataagtgagatagctactaatgagagagccactattgagataggcacaaatgagatagccacaaatgagagagccacaaatgtgatagccactaatgagagagccacaaatgtgacagccactaatgagagagccaagaaatccaaaaaaaggggtccatgtgatgaggaggcagtcggagttgttgatgagggcatatactctgacaccgaatcacttgtggcacagagtgatagcagctatgactctgacttggcggaatcatttgattctgaatttgactgctctgaccctgagtttgatcctgatcaagaaatagttgatgaggatgacgacgatgatgtccctgtctttgcatatgatgttcatgatccatgtattgatgttggtgtggtgttcccagatgtgaatcaatgcaagtcagcagttacacatcattgtatcttgaatgatcatgcttttgacattatcaagaaagacaagaaaagatttagagccaaatgcaagagtgcggatcaaggttgcaagtggctgtttttgcatctactagtcccaagtacattggatgtaaggtaagttcagatttgtatttttttagttcttttctgcattaagtaatttcagccttgtccttacttaacatgaattttgtctatgcactctatggctgcaggttaagataagtggaccaaagcacacttgtggttcttttaataattgcggtgaaacaatggcttcaaataaatgggtagctgaccgagtagttgagttgctgcgggatgacccctcattaggacctaagaaactgaaggaagagctgaagaagaaatactcagtgaatataccttatttaagggttttcggaggcaaggagagagcacttgacatgataaatgtgaggtgggatgacagct

SEQ ID NO: 90148 - DNA, 1521 bp, Oryza sativa
gatggcgagacccaaagcatccatattctgtcgtgtggatcgtcggggtacctggccattaatcggttgtgttccgtttgatcaattcattgtaccctcttggattgactatttatcatctttctttttcaactgtgtgtgcccaatggtaaagatcaaagatgtaaaccatttctattatctagaaaaaaacttggatgaatcttttaattactcacctgatgaactcggtagtactaattgggccaaagttccatctgccgaacaaggacaggccccgcttgtcgttcgcctgcgggtagagcttcttctcgagaggcctgaggtccagcccggagatgaacggtgtcccggtgccggtgttcacgaggcaaacctgcacgaagtcgtccggcacgacgacgatggcctccaggagcgtcgcgccggaggggtccgagatgttgaccatcatccagaagttgacgccgatgtagacgtcgaagattggcagcttgctgaggccgtcgtagttgccgtacatgaaggtggcgcggatgaggtacttgaggccggccacgagcgaccggagcgtgtagcagttgcgcgcgccgtcggggaagctgcgcacgttgtggtagcgcgccgagagcgccggcgtgatgtactccgccgagatgttgtggaacgagccgccgtcggtgaagccgtcgtccgccgcgtaggatatcttggtcttgtcgtccacgtagctcgggttccccggaggccgcagtctacgctaatgaaacctggagttcacttgtcgtagagtcagcaaggggtccggtgcgggccgtgggcccgattcctttcactgtgaagcgctacttaatgcccgatgaaaatttgtgtttgtacctttgctatcaggctgggcacgagcttggagcacgccggcggtggcggcggcgacgaggcatagtagaattaaccacgaccatgccgccattgttcccggcgttgaacgccccattgcacatgcaggcggtgagctactagaactgtaatctctatgtgaccgtgctctagctatttatagctagccttttttttttcgggctatgttcgttggtgggtattgggaacccatctcccacgtactaaaaacgaaacggtctaacgtaggattaattaagtattgtttttttaaaaaaaatggatcaatatgattttttaaataactttcgtacataattttttttttgaaaaaacataccgtttagcagtttgaaaagcgtatgtgtgtgcagaaaatgagatggagggagttgggaacctaattgaaacgaacgcaaccttaggctgtgtttgagggagaggtgattgagaagattgggaagatacgtaaagcgatgtgagccattaacgcatgattaattgagtattaactattttaaatttcaaaaatagactaatataattttttaaagcaactttcatatagaatttttttgcaaaacatataccgtttagtagtttgggaagcgtgcgcgcggaaaa

SEQ ID NO: 90149 - DNA, 724 bp, Oryza sativa
ttgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtgatcatggtagcatgggagtcctgcacattttctgaactgcactttttgtatgcccaaatgagttgatgcttttctagattcagatttcagagtcttgtaaatttctatacagttgccaacatttttttgtatccaatgacatgcttggcttgttaaccagctactagaatggttcagctacattcgctcatacaaatgattttgtaatgttgttgctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaacaagcttagcaattttttttttgaaacaacccgcagcgatgtttctattgatataggggctgcaggaat

SEQ ID NO: 90150 - DNA, 634 bp, Oryza sativa
cagagtttcagtgatggaaaacaacaggtttttttttcagatgggaaaaacagcagctgcaagagttttgaggagaaagttcggacaaagaaaaaatcaatcaatattttagcagcatactgaaccaaggtaaccaattgaacaagtagtttcagtaaacatgtatgcacaatgcaaaaggatatagcttctccctcaggcaggttaggggcatcaaagatcttgcagacacgctgctctcctttgcctttcctcagcatcaaccggatggtggctgcatgcgccagaacgtggcctcccgcaggtttcttcgggtcagttatgaacattccaccacctgggtccgcaatcactgaaacaaagacacttgtaatttgaaattccttattgagttactctttcttgggatagacaggattagtcctgaaagcacaccttggttggtgatgtacactgcaacattgaactcctcagctatcttagtaaggcgggagagcatctgtgccaatttttgctgcaagttcagagtaattagtacataactttaggccttcaactactttatgattatttatttgtgtgtgttttagccaacacaaatattggcaatacctggcgctctgcaagttcaccc

SEQ ID NO: 90151 - DNA, 945 bp, Oryza sativa
tgccacacggacatgacgtggcatcattttaactgacaaatgcgacccatttaaaatatttcctttttttccttctcttttttccctttcttctcctttctataagaagaaaggaaaaaaaagaagaatgagaagaaaacgaaaaagaaaataagaaaaaaaaagacacgtcacgtcaatgtggcatgccacatcagcgtcacataggatcttagaggggatgtgtcaatttaggacctagatgatacactttgacaagttctgggatttggatatacattttgagagtttagggatttatatgacacaaccctataagtttaagaaccgccaatacattttactcatttgacccgcttgtttagttccaaagtttttcttcaaacttccaacttttccatcacatcaaaactttcctacacacataatcttccaacttttctatcacatcattccaatttcaaccaaacttccaattttggtgtgaactaaacacagcctaagagtcatttgaatagtagaaactgaaaaccataggaatggaaaaaacacatgttctaacaagaattcaagtgcaaaaaaagagaattttaaaacacataaaaaaacacattaatgtccttttcattagaccgcaggagaaacgcatgaatcagatgagagtgatagactcaaaggaagattttcaataagttaaaactcttgctaaattttctctaaaatctctataggatcattcatttcataggaattccaaaggataggatatgatccaatgctttattgtaaaggttttcataggaatttttctatagtattaaaatctttcaaaattatcctttgtttttcctataaattaaagtgatcctaaattaagttgtttcgggctcgtcagctggaacgcaaaaatttcacacgacaatgttttatttcgatgacatttga

SEQ ID NO: 90152 - DNA, 1212 bp, Oryza sativa
tcctttgtgaattcctgtcctacaattctgaagttacaatggtatgacaggaagatctcgatatatggcatctcatcaacaattgcagcaacaccaccatctttgggtccacgattaagggcatcagcgtactcgtcgattgtgtttagcggtaccaagtgagattcaggaacattgagctcttcaatcaggtaatttctagtaaactttccagcctggtatccaataggtaaagcacttgaaagcaaactgtcaagcccagttattccagttgcaagctgttggactgtgagaatcgacgtcagactagcagtataacttgaattgatgatcagcacgacaaacagccatatgatcagcacaaaccgcccaagcgcacttacagtgttctgtcctgaagagagttggatgatatataagtccattgaaatgggaaaacatggaatagtttaacacgatgtcataaaatgcatcaaatggacttactgtgtgcaaaaaacattgttgagaaactaaacctgaaaaggaagaaaaaaaataatctgttactttcttactattaatatttacacaaattaacaagataaaaatattaaactatttgttgctcacgaataaaaaaaaagtaataaaggtgtttttttttttgcctccattgaataaggtttcacaaatgctcccagtctgagttctggttccagaaagatatgctgacctatgatataaccaaattcttttctttttaacaaaaaatagacatatccttaagaggagcaacggaaacgtaccaaaatattgttatcatctgccgtcttggagagcctcgaaactcctcattggtccgatgttcaagaatccaaacaactattccgacaaaaataaaaagaacacctgttacacaccacatttctaatgtgaagggtttaaggaaagcccaggcacttgaacttgcttctttcaccggcactactatcacaagccctgactcaatataaggctgtgagaattctgcaatctttgtcctgtttctcacaatagcaaagtcgcctacagcagcatcaagggactacaagaaaataaatacaaatcagaggaataaaatcaaacttttagaagaagaaagagcaaagaccaaggacatacattggcagcaaccatgttaataatgtcatcacagttaggattctttaaaccatccccaattactatgaa

SEQ ID NO: 90153 - DNA, 895 bp, Oryza sativa
aaaatgccatttggactgcgccggctttgttagtgccagatcagtgccttaatttctgtggtgaacttaattagtagccgcaatcttggtttgcagctcgggatccagctcaagaacaaaagaaattaaacatggtacttaattactactgatcgattgacagtgacactccttttagttgtgacaaaagtttggttggtagctgattggtctgccaatgattgacaacaagaacaattgtccatttgactcctagtgtgagtcccactaacctttttaccataaaatttctataaacctcaactcattcaaatttttaagaaaacatgtttcattttgtccttgaacagtgcattctaatacatggccacaaaatttgagtttttttaggaaaaaaacagtcaaaattgtcagatcaagtttgatactaatatatgcagctacaattaggtagtggattaagtagtaattaaaccagaagagtagaagtaataataatttggttggttaataaataaataaatattacctgcaagtagggcatggcctcgacgtcggcctcggtgatgcgcgcggtggtgccgaccttggagacgacctcgccgtagagcttgtcctggacgccggcgtcgaggacgaggtgcatcatggcccactccagcgcggtggcgctggtgtccgtgccggcgctcatcacctcggagcagagcgtcaccagctcgtcctcgccgagcctcttcccccgccccggcggctccaggtcgaacagcgagtccacgtacgcctcgccgggcgcgctcaccatctccacgccgccgaccaccgtgttcccgtcggcgttcctctcgccgccgcccctgatgaactcccggcgcgcgcgcaccagcggcgccag

SEQ ID NO: 90154 - DNA, 688 bp, Oryza sativa
aaatcggcggcgaaccgtaccggcgccgaagcttctcaggttgcagtttgccatcgggtttgccgtcgccggccacctccgtcttctcctcgccgtagagtcctcattagtgagcccgccatcctctcctctccttccctatgagctctccatcatccgttgtggcacaaaacgccggcgagccctggctcccatgccgccggacgccggtgccggtctccagccttacctgcttggcaccgcgtggggccgacatgacgcaataaacattgttttgtaatatataaaaaataatttaagaaatttggaacatccattttaacaaccataaaaattcaattggtaatatctttgccgtttgaattccgaattaacccatttaagtgtctgatttttcctaacaatgaaaataacctattatgagctttgctgcttgtatagtttttcttaacctagtacccctctgacggagcgtggggctcctcaccgggagaccgcgcaggcccccctttgccggttcggccgggggcgctaagtgaggttcttcgccctcgatctgaggaatgtcagcgagagaggaaatgcacaagacacgggcgacgtagacaggttcgggccgctgagaagcgtaataccctactcctgtgttctggtggatctgtgtgtgaaggaatacagagagctctgg

SEQ ID NO: 90155 - DNA, 710 bp, Oryza sativa
ctagttatgctttcttgcatgagcaaaggtttcagacatcattagcgtcccgtcccgactgaaaacttcatgaagagcaaacactgaaaaaggagcgcataagtggacagaaggaagagatcgagggagatacttgccttgagatgcccaggatgtcttccttgactgtgcaaaggagcccatggagcctgctgacaactcttccaatcctctgaattcactcatctagtaaaattgccataaaaaatcacaaccagagaataggaaaatgtatagatcattgcaaagaagattacttggagaaaccttccagctatgagatatgagatccttacccagcttgggcatgaatcactagtgcccacgcctatgtgagacacatgcctgacgtctgtagggcacccgatttccatctcttgttgcttctgcagtgctggataaccgaaagggagcaatggtcatactggtatataaccaatggtatagaaactgtgcattgctattgtggttcagctaattcatcaaaaactgaaaatagaggtagatgcagcaaagataaacaatctgcttcgcttaccgaatatttgagagattatcttcaaacctttgaatatccccttcatctttatctccattggtgaggtgcctcagtactccaaacaaagaaagaacataagtgtcctgaaggaaatactcacgaactagtgtat

SEQ ID NO: 90156 - DNA, 675 bp, Oryza sativa
aatagataagtgtattgattacaaattccacacggtaaaagctctagatcttgattgtttgaaactttatgcgcttgcatttactttggtaaattaaagcaacaatattgtttcagttctgcatgtatctattttaggactagcagtctcggatcagattggcaaaggcctttatcgtgcaactggccctgtagccatggttggcactctttcaaaattatgctccatcgtgttgttttgactcacatcagtggactggtccgtgttgtacatgttataacttgagttgggatcattgttgttgccggcatagaagttgttatatgtatcttccatgccacatcgcctatcctcgagctctaggcactcctgcagctgagctaccacatcggtcatagtgggtcgttgtgtcgatgtctgtgcggtgcatttaagggcaatgtctgcggccttccacacaccattcacatcatggtcaccatgcatgtgtgcatccaccacaccttcgatgttacctcgtgccaaacgttgccgtgcccactggatgatgctaatgggccctggttcacgtagaatagacggcttccctgtgatcaactccaataagacaacaccaaagctatagacgtcgctcttggtggttggttgcattgttgcttggtacctacatgttca

SEQ ID NO: 90157 - DNA, 701 bp, Oryza sativa
tcaccttgatacggaaaaagctgcctgatgagaaagaaggtcaaggcgaagtgagcatggctcagtttcttggattccttggactgtttaacatgttatttttctttccttttgcattgttcttgaatttcaccaagctggagccattccacaggctgacatgggagcaagttggtcttattgttggaaaaggtaggtttgcagtttacgcatgaccataatgtgagctataataatgcattgtgtttgtgtgtgtaaacctttgcgttgttttaaatataacattgtaggaagtcataacggaataacttcgtaaaagatcataaaagctcaaactatccatggactagcactaacatcaagctgttgtgttctttacaggtttgttagataatgttttgagtgactacttgtgggcaaaagcaatccttctcacaacaacaacagtagccacggctggtctcacgatccaagttccaattgctgccattgtggatacactaacaggtcatgctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgagggctgcaggaat

SEQ ID NO: 90158 - DNA, 691 bp, Oryza sativa
attcctgcagcccgtttttggggcctctttcttatgtgcgctctgatatgcgtattcgctctcgtgatgttctttgcaagagtctgctggcaatattccaagtactcaggttctgaagaacctgatgagcccaaagacgatagtgctggcaccgccgagattgcagctgaagccgttgctgaaatgcagcggaggaggccaaagcgtcttggtagcttcaaagaactcatgcagtttgttgataaaaaggaagaagaagtcaggaaatcgatgaagcggagaccaagtgagaaagataatcagggtgttggttcttcagatgcgcagtcagtggcttaaccgtagaagattctttcaggttcagtccttccttcgttctgcacatcacaaaaatgaaaaacatactaaagtagataacagcagtatacttgtagaatctagaaatccattttttctcaggattactcgaattatgtctgatatatactcttaatatgttcagcaattttcccatttttttcccatttgggaatgccatgaactgtgaaaagtgtatctgtttaggtgcttctctgaagcacatgtatgacttctcttttgctttattttttttatctttgacaccatgaatttgtggattactgaattgcctcgctggcattggatatttgagatcaaaagtaagaactac

SEQ ID NO: 90159 - DNA, 1130 bp, Oryza sativa
aattcctgcaccccagcaagcggagataaatactacctaaggatgctactgaacacagtgaaaggacccagaacattcgaagaaatcagaactgtagatggagttgtacacccatcattcaaatcagcttgcgaagcattaggatttcttgacgatgacagggagtgggttgaatgcatccgagaggcatccaactacgcatcagggaaccaactacgacatcttttcacaacaattttatgtcactgtgaggtaactgatccgaagagaatatgggaaagctgttgggaggatctaagtgaagacatgaatacaaacagagaaaaaatctcaactatcctacgcttcgcctaacagagcaacaaaaaaagggacatgctctgatagaaatagaaaagctgatgagacaagctggaaaaacacttgaggaataccctgatatagagctaccaaaatgtgctgaactacgggaacttggaaacagacttctgaatgaagaaatgagctatgacaaagacaagcagaaagaggaacatgatagcatatttggtaaacttaatgcagaacaaaaggtagcatttgattcaataatagagtcaaccaacaaggggttgggaaaactaatgtttgtcgatggctacggtggaacaggaaagacttacctgtggagagctatcacaaccaaactacgttcagaaggaaagatagtactcacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaatttgcttcgaggcgctagacagaagtctaagggacatactaaggtccaagggtgaagataacagcacaaagccattcggcggtatgactgtggttctaggaggagacttccgccagattcttcctgttgtgcgaaagggaagacgcacgcaaatagtaaatgcatcaataaaacggtcctacctatggcagcacttccacatcttcaaacttacaaggaacatgcgcctg

SEQ ID NO: 90160 - DNA, 766 bp, Oryza sativa
attcctgcagccctgcaatgtgaagttggggcgtgtcctcatagatggaggagcggctctcaacatcatttcccccgcggcctttgatgctatcaaggccccggggatggtgctccagccgtctcaaccgatcattggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccctggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggag

SEQ ID NO: 90161 - DNA, 2268 bp, Oryza sativa
ctagtcgccccggagccaaatgagcccctgctactttacttagcggcgaccccccaagtagttagtgcagcgttggttgtggagcgcgatgaagacaatcctcatttcgtgcacccccattctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgggaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagaggggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttccgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccaggcgcctttgaagaaaggcttacccggccgtcggcgcgacccgaccccttaggggagacggatgcgcctgaccgacccccgaggcccgtcggagtccaggcctcgggacccgaagggagcgctccaagctcccttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcacccaggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgatcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcagggctgcaggaat

SEQ ID NO: 90162 - DNA, 717 bp, Oryza sativa
attcctgcagcccgttgcgagtatatggattgctgcaagctacattgttcagtctgttgtggatgagggtgtttctccattcttgattacctacatatgcaattctctatttgttatttacatcccaatagttgaggctgcacgatactttgaggattctatcaacaacttttggacaaagttgaaaggcaaggatgttgcggacctggagcagtctgctgatctggagagcataaatcttctccatggaagtgaacaagagggcaatacagcctcaccaacaaggttgcctgaagacatattggcttcagaagcagtcttccctgtccaggccgagctgaatgtagcagatggcagcaaagggttggatgcaaaagggcgctggacacgtgctcgtgtggctagagtcagcatggtagtctgccctttctggtttctcgctcagcttacattcaacctgtctctaagatacaccactgttacagtaagtgttactaaggcctgcatttccatgccattatttaacctcgctcctgtccattggtaacatgtccttgtttctttgtacctgcagtcaaatacgatattgagcagcacgtctagcctcttcactttcttggttgcactagtatttcttggagaaacattcacgtggttgaaactaatcagtgtacttctctgcatgggaggaacgataattgttagcctagctgattc

SEQ ID NO: 90163 - DNA, 702 bp, Oryza sativa
atttgccggcatgcaacgagccggcgtgacgccgaacgaggtgaccctcctcggcgtcctcacggcgtgctgtcatgccggacttgtcgaggaggggctccagcaactcgacgccatgccggaacctcgcatcgagcactacggctgcgtcgtcgacatgctcgaccgcgccgggagactagacgaggcagaggagctcgtcgcggcaatgccagcacaccccgacgcgctcatctggggctcgctgctcgccgcatgccgcgcacatgacgacgtcgagcgcgccgagcgggtgatgtggcggcgcaccaccgacgccgacgcggacgccggcgactacgtgctgatgtcgaacacatacgcgtcgaatggccgccacggcgaggtggtgaaggtgaggaggcagatgaggaggaacgagatcgacaaggtccccgactgcagcctcatcgagatcgacggcgtcgtgcacgaattcaaagcaatcccagcaaattccatccgataaaaacacaacaagattcatcaaagaacaggttatccgattgatcgattgatcactgtagataacaagattcatagaaccaaggatgcaagatttccactggaaattttctacttctagctgtacatgagatttcagaaggcattatttggctttattggttattgctgcaagaagttgatgctcatttgggcttg

SEQ ID NO: 90164 - DNA, 754 bp, Oryza sativa
attcctgcagccccggctcgtcagccatcgggacgcacgtgacgacgccgaggaagtccttgctggacatgtgctcgaagaagaagagcgtccgcggccgggagggcaggaacaacgacgcgaggcagccggagcggcggcgagccacgaagttgccgtgcgtccaggtggtggagttgcatggcgcgctgcacagcgtcacgtcgcccggcgcgaggtcgtgctcgtcgcccgggtgcagggcgttgtagtgatccaggcactcccgcgcgagccgctcgttggactcctcctccctgagggcggcggcgcggcgccggtcgtgctcgcgggcgcggcgccgtctggagtagtagtcctcctccagcatgatcggccgcggccatagcgccgcctcctcgtcgccgtcacgtaccccgccgccgaccatggctgcgtccaggatttgcgtcgcgatcgatcggagaatccgggagcctttcaatctcgggaagaaaacgtcaaatatcagagaagaaatcacccaatagagcaaaatcgctcgggagatcgtttgattcgtttcggactcgttgccgttggagacaaactgggccttgaaataggttggcagcatggcatgatgggccccggcacgctgagcttcttttgggcctgagaggccttgtgggcctacatctatgggcccaaattgctatacttttacggagaaaattgcatatctagaatggcttcaatataataccattataaa

SEQ ID NO: 90165 - DNA, 1197 bp, Oryza sativa
gtggctagggtttgggagaggagagaggagggtttttttttcgagttggggaagaagacggctgaatgggaggagatggagtcgggtaggggaagaagagagaagaaaaaggacaaaagtcctgggcccacctgccggccggtcagaccggccctatgtggccggtcagaccgccgcacctggccggtcagaacgcgcatatagcgccggtcagaccgccaggcccccagcctactgtgcacagcccttgcacagttcggctacccccactcagtaaaaatcaataaaaaatttatttttggagcaattttgaaatatgtgagttgaaatattgccaaccattcataacatttgaaaattatgaagatttgcaacaaaactcgcttgagtgctaggaggtgaccttttatggtctatatgggttttgggcgaatttgattttcaaacaacttttgaaatatttgatttttgaaataggtttgaataccaaaaacattttaaatcttcttctctaccaacattgttttgaaacttttctcaaatttcttctcaatctcattttggggataaatctcattttagccaaaactaagaatctagtttcttcaaaagagagccaaaatggcattttcattcaaaaatcatttttcttgcaatgagaggcttggaaaacatatagggaaccttttaaaatattttccaagagatagttttcaaattacattgattttgcaaaagttttgacttatgttgacttgggcattttgaaaatactactagcacaactagttgatttgctcacatataaagggaagtagagcaaatgcaagagtgcaaaactcccccttaatgtgacatgctccatttttgcaatgaagaaccaaatggcaacaaatccaaagcataagagcaaatgagagcaaatatacataatgcaaaaagaagcaactatggtgcaccatctcaagccacattagagaagtctataacatttaactcattcctcaatttgcaaaagcgggtttcatcaagagacttggtaaagatgtcggctagttgatcctcggttcttatgtggctaatgactatgtcacacttggcaacatggtcttgtaggaagtgatggcgtatgtcaatatgcttggttctagaatgttggaccgggttattggctatctttatgggggctgcaggaat

SEQ ID NO: 90166 - DNA, 718 bp, Oryza sativa
attcctgcagcccgcagaagttttctttgatatgtaggattgttgcaggtggtgcccttaaaatctcatctctgaagcacctcaaattccacagtgactgcgcatgttcatagttaatcagaactcagaagttagcacatgacaaaacatactgcatgcaactttgtactacctgtatgatcacatgcaagataaacatgtctttgtccttgttttctttgttgggaacatcaatacttggcatttcctcagcagattggccaggagttactggatgataagaacacacaatcaccatggatagatcggttggagctctgctttcgttggtttccttgttcccagcgggaggcctaggtagacgatggggaagtcttcaactcggcaagagaggatggattcaaccagaactcgttgttcattgctgcactgaatcggtgtaatagcgctcttgcagaagttggttttgagtcccgttgcctcaccaaaaagagtcagcaatctcttgatagtgttggcttcagtggttgttggcttgaagaacagcaccgcgtcatcggcatacaccgagagcaaatctcttcttgcatttagaggcgaaagcaaaccagccagctttgcccgagaaaccaaagcttgcagagcatccatgactaagataaaaagcaacggcgatagagggtcgccttgtctcagtcctcgagccggtttaattgga

SEQ ID NO: 90167 - DNA, 772 bp, Oryza sativa
gtggatagcaccgaccccttttgcattctgtatgtcaagatggcgcggttgagtaagatcttgtctaagtggggtcagaagaaaatgagtaatttcaggctacaacttcagattgcgaatgaaatcattctccgttttgatgtggcacaggaaattagaattctatctgacttggagcggcagctgcgagctgcgctcaaagggcgctgtttggctcttgcatcacttgaaagaattaggattcggcagcgtgccagggtcagaaaccttcgagagggagacgccagcactgcttacttcttcatgaaaatgaaatcacaccaaaggaaattgaagatactctggctggagcatgatggcgtcattgccaccacgcaggaggatatggaacagatggcgaagacccatttcgaatatgtgatgggggcctcacagggtgatttaaaacaaatccttttccaagaaattcatttggctagggcaaacttatctgagctggatgatgccttcacggaggaagaggtctgggctacaatcaaggccatgcagaatgagaaatcccctggtcctgacggcttcactggcctcttctatcagagatgctgggatgtaataaaaaaagaagtcctagaagctcttcataaattttgcacaggcaactcacaaaatcttgaactcttgaatacggccatcattacccttctcccgaagaaagatgcaccgacacttttgaaggatttcagaccaataagtcttattcacagctttgcta

SEQ ID NO: 90168 - DNA, 604 bp, Oryza sativa
gtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctaccagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcaccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttattttaaacattaagctaattagaggtgagaa

SEQ ID NO: 90169 - DNA, 2701 bp, Oryza sativa
cacttccactgatacagtgtcactgctagcatcggcataagtttcgtatccctcgagatcttcctctgttactacgactgcatcgatggacctgctggggcttgaaggcttggctagcataccttcccataacggcaaaacaaaatgctcgttgtcgaattcggtggtgaacccatcaacttcagcctccacaatagcttcacttgattgttcactgaatcttactgggtgggtgcggtttgaactctgaatttgatggcagctggaagcgaggcactaaatggttcactcgattcttcacaagattttgccgagtgagtttggtttgagttctcgattgaaaggcatctggtgttgagattgctaaataatttaacagcctgtagcaaagaagaaacgaacaagaaaatttatcagaaacttcagggatctaattatatggaccagagcagtgtttatcaattcgtcattcaactagcacacgaaagcataagagattaagtgggttgcatgcctgccattgagatggtgctaaaagtactctgggccttacagaccgtgcatgatctaaagcagcttcaggagtcatgttcctgtacttaatctgcaagttacaccaaagataagatgccatatatgaaacaaataaaaataatgcatacaataaacatcacatgattaatgcagtttctcataccaaatagcataaaactatagtggtgcttcgtccccttccagccttacaatgtacataagtgctaccaccttgtgatgcatttcctggagaagaaaaaaaaaacatatgcataaatccaatttctagtgtaactcagagttgttgttcaaatgatggttacaattctgtccaatcaaacgaatttactttgggggcttatcatcagacatcaatatgcaagacaacagaaatgtcaaaggattttattactcgaataaagaatggttgcgaaagtcaaaaggaaaagtattgctcaaataaaatcaaatacttgagaatgattgcgacacattgacatgatttaataagatatctttcctgctcataaaaatgatttgaatactaccaaagttcaactgcagtgcccaccttaattcacttaatcatcatcaaagcaaactggtgctgataatatggtttagaacgcatggtggatggtacttacggtgaataaaatcgacagcttgacagatatcctctagagaaggggcaaatagatagtccctcgtgggaatctcgagatgattgatcccgtgagcctgataaagagaggaaaaaacttcttattgttcagaacaaaatttgatacaagcctgcttatgccaagtgtcatgccgtgatgccgattacaccatgtatattgagttaaagaaaggatatagaaaatggccacagcttgtttgccctgatattttgaatgtacatatagaatatgaatggtaaagatgcacgagacaagtggatcctggtgtatgaactatatatattgaacttcaagtatggggcttaactgttcacagatgaaaacaagaacagtagataaaaatatgcacgcacaaagatcttgatacatgccaagaaaatctgcagctacaaaatcaggtgaaggtatttatttacctggtataaggatgttggaaccagagtttcatacgattcattcagtgtgacaacgccccttactccaagttgcttgagatgcggtacatcactagagaaagggacagcacctagcaaaacatactggagatgggaggtgggaagaaaatcagtacacaccatccaatgaacagaagatcaccatattgtttgatgaactgttcaaattatcagatactagtttaaaactgcatgcatcgtgcatggatggtagacagagctaccaatgaaagtgtgaaatataaattggaaaggattcctatatgtgatcagtagctgggcaaattactcatattggtcataccatagctctagacctcaataggatcactaatcaaaatccctataaccatccttcaagagtaatcacaagcgtaagtgatacaaacataacacatgcgaatctacatgatattggtacaattcagaatgttgatttgctcgaaagtgtagtattggacccaaaaaatcagccgcaggccacatactgtgaatttacaacctgcttatcaagcattggagggtaacaaagcaagcacaatgaatcaactctgctcaaggacctggaactatgcctacactgatcgtccccaatatccatgagtgaaattaaagcaccaaatcgctccagaacgacaaggtgcagtatattgggagagagatgagggtaagattaacacacctggtcgatgcgatcccaccaccggaactcagactcgaaccggttgcggaggacgttgtagagcagcgtcgggtagaacagcaccctcgcgccggcgccgacgagcgcgcgcttcgccctcagccgcacgacggcgaccacctcgcccccgcctccgcccccgcccccgcccctcgcctcctcccgctcgtcctcctccgcctcctccgatcccccggcgccatcccgcagctcccgtatcctcatggccgcaacaatcgggagcgcaccaaaccctagaagccgactcgcctcgtggaattctcctcctgcaccgctggattttggggattttgggttggaat

SEQ ID NO: 90170 - DNA, 698 bp, Oryza sativa
tcctgcagccccgcacaatggattttgaacattggtgatggcaaaacaacatcagcggatggagaggaatggatagaaatacctgatgacctgatactgaagaaaggaggtgatccaaaggaagaaattgtgaagagcatatatccaaacttggtacagaattataagaaacgagatttcttagaacagcgagcaattctatgcccaagaaatgagacagcgagggaaattaatgaatttataatgaacatgatagaaggagaggagataacatatctgagctgcgacactgtatgcaaagcaacaactaatgacagtgaaaccgatgtcctatatccaacagaatttctaaatagtctaaacttccctggaatgccaaaccatgtgctgaaactgaaagtaggccttccagtgatgctactgcgaaacattaatcaaagttcagggttatgtaatggtacacgaatgaccattactcagctcgggaaaagattcattgaagcacagatcataacaggaacacatgtaggagaaaaggtatatatccctagaataataatgacgccaacagagtcaggatggcccttcttgctaaaaagaagacaatatccactcagtgtgtgcttcgctatgaccatcaataaaagccaaggacagtctctaaacatggtaggactatatctgcctaagcaagtatt

SEQ ID NO: 90171 - DNA, 702 bp, Oryza sativa
cctgcagcccccatagttatgcatgtcaacaagttgggttggcgatgttttaccctccatataggtctttgacccttcatctagcaagctgaaaaacgacccaactctaacaactaatttcaactcattgtgatttgtcctacaaatcatagcaacaaaaatatacatttagctaattgttgcatgttacctgtcgatgatatgggcccgggggtatcaggtttagagggaggaggccgccccccgataccacgtggccctcccccgaggggagtcaggcccaaggtggggtggcggccactccttcctcaaagactagtcggaggaggctgccccccgattccacgtggccactccttccccaaagactagtcggaggaggctgcccccccgatgccacgtggccctcccccgaggggagtcaggcccgaggtagggtggcggccactccttcccagagactggatggaggaggctgccctccaatgccacgtggccctcccccgaggggggtcgggcccgaggtagggcggcggccactccctggccgagactagagggagaaggccgccccaggtgccacgtggctccccccagaggggggatcgggcccgagttcgggcggcgaccgccccctcccgtgactagggttcgggctcccccgaccccctctctaggtcaccacgtacagtgggttaggtg

SEQ ID NO: 90172 - DNA, 730 bp, Oryza sativa
attgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcgccgtagacgaggaggcgacgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcacactcggagagaggtcgtgcgcctttgcttgctcggccattaggctgaacaagggaaacttggcccacacggaagagtatgagagctcagaaaacacacgctgagccccctacctggcgcgccagatgacggagctcggggctcctcaccgggagaccgcgcaggcccccctttgccagttcggccgggggcttagggtgagatctcaagctctctctgtgtgtggaaagatcgcgtgccaggaagaaacgcgagacacggacgatgtatacaggttcgggccgctgggaagcgtaataccctactcct

SEQ ID NO: 90173 - DNA, 2132 bp, Oryza sativa
caatcagtcatcaatcatttaacatagacgtgaatcagttggtcaaattcgaacctgaatagaaatggcatgtcagatcttttggttaattatagagcacacactcaagaactggtagacttatactccatggtcaattagctgtgtagaatgtttactgacttttgagccctgctcattcattgctcttctctcttctgctgtcaacttctttgaatcttctgttgtcgaattgtgatgtcctcggtacctttaattcctgtgcaatgtgttatctgtaggaatggaaaagggtgcacttggaggattatgtcaagatgacacaagagttcatggaggaactggaacagctcgaaccaaagaccgagacctgaagctcaacactcattcgtccagaaggattcactcaacaatgaattgtatgtgcattgtcaaatggttctcctcttgtttgtaaataagatgtttacaccattaattgatagacaacagttacagaattcgcagtggtttcaattttagtgcttataagcttgagtgcaaatacatataatttctgtgcttttgaatcagtccatattttacatgtgatgatgtgaaacaaactatcttcaattcagaaattgattgattggcagagaagatgacaggataaagaaggaaaggtgcagaatatttgctatagtggtttctaatctgggtctgatcttaatagaggcttgaacaaccccaagaacagttagggcaaatgttttctctaaaatacactatcttaaatttcgcctaaaccctgtctcaactcgttaacagctctaggtaagttccattcttatctctaactttttgcaaatgcaaaaactacacaatatatcaaaagaggaaaagaaatattctgaggagcatttgccctcccagctataagctgacactctacactgaattcggcgcatagccttttaggccacggatttgatgatagttatgctgggtttttgtagccattgcatctcttctgatcccattctgaattcataatggacgcaaaataagacagggatgtcaaatatttcatatgtgaatgaacctctaagtcaggtcattcgaattgatcatacgggccgatggaagggttcccggggttctggtcacagcgaggcctccaaccattcaccccatctgagctgctgcaagcctggttggggaggacattgctccccagatcaccatccaagctcatctgttgcacttcttgaggtgatagaatcctaatgcatcttacacagttcacaaactccctacataatccgcaacagctcatattagaataactaaccagtaaaatctttcatcgaatagttcacttgcacatcttgtacacgcattgtttttcagtttatgaataaacatatttttctgtcatattatcatgctggattaaccatatttcactctggtaaacatatctttagctgtcaattttagcaatctttattatcttggggcctattttagagcaggaaattaaaggttcacataaggagaaagatagatatacttactcccatgggtcatcaccaagaagcaggatgtcatcctcgtgatccttgtagaccagtttccagcctattctctgtcgatcttcaagttgaccctctataccaaacatgcgagccaaagcatgcttcaactcttcatatccagagtacctgccgatgtcaatagaccggcctacagctcctcgtttgtacacctataattcttagattaggcttactagcatacgagccacaaaaacacacatcttgaatgctacaccatcataacctaagctaaggaaaagccaataccttggtgaatgtccgcattctctgcagcagaggggcagcgggccaggaatttttgttcaagaaggcaccatcattgatcgcagaatcaatggaattaaaagccatatccgactgaccaaatgactgggaaaccatggaggttgatatttcttgcagagcatccttttgcatcgggtagttgttttcaacatcagttgatatgtgattctgatacttgacagaatcaagtgcatttatcagcaagtcctctgtttctattgggaatcctaacaggttatcattgtt

SEQ ID NO: 90174 - DNA, 1595 bp, Oryza sativa
tgcatggtttatacaattttgggggccaggagcaacatttggtaattttgagttgacaacactttgcttcacattattattcggctttggcaattccttggtcattagtggagttgctgttacagcgtcaatggaggttgggatcaacattggagcagtggacggtggcagcctttctgtgttgatgcaatgtctgtttttggttgattgtgtaaagtggtttccattagctgtggatggagatgttgaacaagagggcatttcctctgtaactacagattgtgtagcacccgaaatgatcatagcacctccagttttggggatcacattggttgatgaaattggttgaaaagcaactcctgacacatctgcaagtgagacttgtttctgtaaaagcttctgctgttgctcttgctggaccgtgggtagcaatggtgttgcttgcaatgaaggcttgatttcttgttggggcatcatttgttgctgagcaagtgaatgtgaatttgacaactgcttttgcatgtccgtgattaacttttgctgttcttggatcagaggtggctgtgagagtgttgatgtggattgtgacatcagtgattgctgctgcagtttctgtaatatctgcaactgaagctcctcatcaaacaacttagactgctgacttgccagatttaccaactgtccaagggacttatttagctgctgctgattctgttgttgctgctgctgctgctgctgtaactgttgtttttgctgaagtaaaagctgctgttgcagctgtaaattttgatccttctgttgatgagacaaaagcagccgctggccattaatcctttgcgggttttgagttggagatggcttctgctgttgcatctgattctgaacaatcacctgagcctggacgagattagattgagcttggctcaggggaatcacttgtatggagttctgctgtctctgatggttgacagcatcttgtttctgatcttgaggattgatgatagcaccaagctgattcaacggaattgccgccttggacagatcgttcatggtttgcatttgctgagggagcttgggagaattaaactgtatgcagttctgttgaaggagattgttctggacatatagttgccttgcaagttcatcagcagcaaggttttgcatggcagggttacctagagcttgcaggtactcagactgcgcagcggtgttagccaatgatgagctctgctgcctgttcatgttcatccactgaaccaaacttagaccaggtgctgtactgttctggttttgagtatcctttatgcatacctcctcaccaagccaaggcattgccctcttgaaaaggttttccatctctgactcgtcatctgttaattcagataaaagaatatgaaatatactaccataaaaaaaacatatgctaatgcgataatgtaattagcctatagcaatcctggtttcgaaatttatacacttgttatcctgttcagtctactataaccatacacaataacccattaagtaattccgcatcgatgtctaatgtttaacaaatatgcagaccaattgtttccagcacacatagaataagt

SEQ ID NO: 90175 - DNA, 3572 bp, Oryza sativa
  unsure (1)..(3572): unsure at all n locations
aaatctcccttcccatcaccgcggaggcgcagatacattcgccgccgtcgcgccaccaccggcggcggcggtatggcggccgcaccgccgccacggaggcttggcgcgctcgccagcgccggcctcctccacgggatcgacgcccagctccgacgcgtagctgagtacgtctctctccgcacttcaaattttcacgcatcgacgggtggatcgagccactgaggtgtggcgacgaacgccacgcatgtctgggctgtgggattggggtgacggggattcggtagctgtgcggagacgcacggcactgagatctgggcttgttaatcatctaggttttgatcgatgatgacagtcactctgtcactagtacaataaaatcgcaaaagttactactactacttagataaactattggagtactttgtttcaattattcatggaattgaactgccgtcacaatcgtggtcgtcattttgtggaagaatttctctgggttactatgcaatatatatagtggtaacttgttaataccattttgcaaattgcagttcactagatcgaatccctctaagctggagattcctggtatcaagctgggcgaggatgaagatgtcacagaagaagcggtgctgacctctttgaaaagggcgattcggcgttattctactcttcaggcacatgatggacactggcctggggattatgctggtcccatgttccttcttccaggcttggtacttccttttcactgctgtgggaaaatggatctgttgaaattcatccacatcgttattagctaaattcacaatttctttcatgaggtaaaacattccaaagcactgctcggagctagtatgttgctgttagcatccttgctttgatgttggttggtacttgctagagtactgcccaaagattcatgcttggctaaccattttttaattttgtagtcccttggttgtttcacttgcaatggctggccttttgtttgtgtttttcccttagaagagaacctgcatttctgtttaaaagcagttcacatcagacaagcatcaattttatcgccaagtgccagcatgcaatcgttgcatgtaatttgtacattttgtaaagaaaatatggatcacatacatttgtcttccttttgtctatataagattatctgtacattttacttctccattcctaactcagttttacccaggttatagtactgcatgtgactggtgcactaaatactgtgctatcaacagaacatcaaaaggagattcgccggtatctctataatcatcaggcaaggacataaaacttgcccaaataactctgaaaaacttacttagataaatctgtcatttcaatacacatgtgtgcttcggtcgtgataaaatcgtaaaatctgtttcaaaaatcatgagagatttgcatttgctgaagctgataatcggctgctgaactaatttgctcgtgcatttacttccctttgctgtcagactttggagaggttcagatgtgagaacatgttctcagtttctgttatcaagcccctaacgagaaattcattcctttttggcccttaaaaaaaatccatgtagaacatctttaaaagaatggaaagagagggcaacctttgaattcaaaagggcatacagtgcgtgtgtttcatgtccttctccatattgtatagctcattatgttgtgtaaagaaagtaacaaaaactttttaagtgcagaatgaagatggaggctgggggctgcacattgagggcacaagcaccatgttctgtactgtcttgacttatgttaccttgagattacttggagacgaatcagatggtggagatggagccatggtgatagctcgaaattggattttagatcatggaggagcaactttcacaacatcatggggaaaattttggctttcagtagggaacctacgcattttaatttccttttgtgtttttgctctggtccctatacaattctaccttgttttacaatcctagagaggtcctgctaatgtcttaattaactttcttaaggtacttggtgtctttgactggtctggtaacaacccattgcttccagaattgtggatgctaccttatttcctcccatttcatccaggtttgccttctccttacgttttatttctttttactctttaatcttaatttggtagagtgtaagttcatcatacaataatagagaaaattatcgtaggtactggctggagtgcatgctagtgcaggtattcactatatacaaacatggttctttggcagcttactttgaataagtgtgtaccgggttgctgccacgtacgtatattgcactagaatccatgttgtgggttgataaagtgttagtacaataggctatgtctccctttataaaagaaacaggggaaattagccccatttggaaagaatggatttatataattgcagaaacataaatacagaatatttttactctaatgatatgatagaaaatttatgaatatgctgacatggaattttcataaaacaaaaggaagaaggttcaggaatatgtatagattggttaaattcttcaaggtacgtgcctattctgaacatcataagcatatatttggtttaggaatgagttgggatgggttggactcatccttgtgtttttggatgggatggccctatctatctgtttggcatgagggatgaaatggtcccagttttaaggggatggctcacatgtcagcgagaccaaagaagtgggnttggattggtctgcccaattttcaaggggaccatgccaaccgcggatcttagaaaaatattccctttcaggttcatcccatcccatctatctccaaaccaaataccttgaaaagtgagttcaatccaatccgacccattccatcccttgaaccaaacgcatgcagcatgcttaatctctaataattttttaagtgtatcaatccctatattactagattcatgcattgctcctccagccaatttgtgtgagatagatcagcgaccatgttcttagggtgcctttacaacattctttttagtgttctgtagtctgtacaagattttatctgtcaatcagtatattttgtttgcgtatgtccagtacgtatatggtccccctcccgaatggtatacttgcctatgtcttatatttgcggaaagaagtttgtcggcccaattacaccaatagtgctgaccgtacgaaaggagctctacaatataccctatgatgatattaattgggacaaggctcgtaaccaatgcgctaaggtttatgagctttatactttctttgtctttcagattgtgcacgggtcaaacagcaaggacataaaaaacaactttatcgtgcaataccatagtgtctgttgctactcagttcttgttacttcaggtagacatgtctgtgtaggataagtttcttatttaataaagaaaaaagaattatgtattgcaggaggatctgtactaccgtcatccattagggcaagatatcctatgggccactctttacaaatttgttgaaccagttctatcgcattggcctggcagcaa

SEQ ID NO: 90176 - DNA, 1098 bp, Oryza sativa
tacataaaaaactcacaggtaaatgcttgatgtcagcttgtgcaaataggttaattcatcatttaattacttacatgttactccttgctgaaagcttcttcatgactgccccggagatttgagttaccggtatcgccatatatataaaggtgcatggaccttttctactgctgatcaaggttgggctgtatcagatagcactgcagaaggattaaaggtagttaatatgtgaatgaggttgtcagtattaacaacaacgatattttctttaagaaaccaactttgttcttgcagggtttatgaagtagaaattatcctatagtattaggcatcatagtattaccattatagccttcacatgtcacgtctaagtctaaccattatgttcttttgtggcattgatggcatcatttgaattatattttactaaatgtttgaatttctatctgatgtgattcctgttaattaccttcaggcctcattgttgttatcaaaaatttctctggaaattgttggtgaaccattaaaagtcaatagactttatgatgctgtcaattgtctgctgtcttggatggtacagatatcctaacttttgttttctttaatttcttatttaataatatccccagggtatttctgttccccttgtgacatgtcaaaagtctccgtataagctggaatagcaacttttttttattagagaaagtaaattggagaagtacgtagagtttatgaattgcgataacttatagagtaccaattaggtatttatcaaattttgcttcaaatcttgtacctcttgtctctaggtgccttaatcagtataataacttctgaattgtcaagttattttaatcaaactggctaataaattttctcatgctacatatttaatgcttctatgctcaatgttgtatatccattctgtggaatgatcaaagcctccagctgttgatttatgttatgatgggtctatcagtatgcttattgtctgtaattcttttggtacagaataacaatggtggttttgcgacatatgcactcaccaggtattatgcctggctggaggtgagtggttgaattatattgtctttggtt

SEQ ID NO: 90177 - DNA, 6786 bp, Oryza sativa
tcacaatgtaagtcattctagcaattcccacattcatattgatgctaatgaatctagatagatatacatgtttagattcattagcatcaatatgaatgtgggaaatgctagaatgacttacattgtgaaacggagggagtataagatttccttacttggcgtgtttgggagctagactgacccatatgcattcttgaaaacatggtctgaatcctagaaattgcatgcattttctttcaggcgtgcgttcttcctcctcccaagagatcttcttgtgccaactatgctagagttgtgaatcatattttgcaaggcctgaccaatttgcaggtatcttcctccattttcaattacatatgttgtgtattgtgcatgtcataaatgtttcaatttgatgaacatttagcttttgtttgttctgtctctttcttaagttgtggcttaggatacctctggagaagtctgaacctatggatgaagaccatgatggagcaaaagataatagcgacatggtaaatttctgataattctagactggcctggactgttaagcagcagactgttatatatctgcatgtgcggggtaaatctcactcttgagtgcccttttaaattgcagagtgataccgtagactcttgggaatggtggaattcatttagactattatgtgagcatagcagtcaactgtgtgtggcgcttgatgttttgtaagtgatgttcttgcattgttgcaccaagtgctttcttccaagtgaagatgtcactgataataaatctatcatgttatagttttggttttcattacaaaggttggctattcacttatcaggagcacactgccatctatgaattcactagggcggtggtttggggagcctgtaagagctgcaattcttcaaacaaatgtaactgtactacttattcaattaaagatgacatgcgatctcctttctttggagataagaataacccttcatggttctgatcactaaacgatttttcgtctcccaggcttttctgacaaatgccagaggttatccttgcctgtcaaagcgccaccagaagctgcttactggattttttaaccattcggttcaggtgtgttccttgtgcttccttctatcaagcctttcctctcttatcttttctgctaagaacccaatgcacagggtgcctccatttccattccaaatttcaaagggcatcttactgtaccttttctctcggatttttcaccctctgtttttctttaggttataatatctgggagatcaaatcataacgtatcccaaggaggagtgctctcaggtgatgaaaaccacactgaaggtaattcttgcaaaatttgagatttataatttattggttttgttatgtatttcaaccacacatgaactggatttatacatgaactgaaaatttcttttcaatatgttttaagtaatagtggtgctctacaaacttaactttgaaacaaattcagagagcaaaagtcaggacttgaaatgaaattagctgcttgaatttctgaggcgcactgcaaaatgtatattttttctttagcacatgacttatctgttgcctaaactgttgttttagatactgctgttcggcatgcattgagcccataccttgactacattgcttacatatatcagaggatggacccacttcctgaacaggaacgctttgaggtatttagtttatcagactatctctctgatttggcccatgagctgattcatttaagcgagagctttcttgaccttgaatttatttgctttattcagatcaattatagggattttctgcaatctcctctccaggtaattcctattctgtagcccccccttctttctcctcccctcatcattttgttttaatctttcctcacaacattacattttcttgcagcctctaatggacaatttggaagctcagacatacgagacttttgagaaagataccgtgaaatatacccaggtttctgctagatgttttgaatatctttaaatgttactgtgaaaatcactaatttaaagcgacagcaaatttatctttcgaatcgggcattctgattatcgcttctcatttttttttagagaaaatcgagcaattcccattccaaacattgccactaagaaaaaaatgacactttaaaggctgtaattgttccggtgcatctccaaagaccgtttttttttttttttgccaatatggccatagaaataatttacagctaggtccaccacatcacttgacattttcccctgtctgcatggtataagccatcttgggtttccccaggttatcttgagcaaagaaaccacaatgcaggcatgttccattcatactagcttgcaggtcttgagacttgactctgtccttaagatcagcaaagtgctggtttgtcatgacacagaaatagtagtcgcagtatgcttgtagccccgttatctgtgtaggccagcaccagtcatggggctgtatgcatctgcactggatcacactgatagtaactagactccgtgcttatcgtggtttcccggcaatgatttaactatgaattagaggcaatgctacctagagacatgagtgtgggtaaaactcgttcttttttttttttgtgcgtgcgtgtgtgtgtgtgtgtgtgtgtgcatgtgtgtgtgtttggggggggggggtacttgggttccccttaatttttttcctgttcaacataaactctaataccagtgttggctgtattaatgtttttctgtttttcatcatatgaacagtatcaaagagcaattgctaaggcattggttgatagagtttccgatgatgatgtctcaacaacaaaaacagtaagattggacctgccatattttatcttcctcgccaaatcatgtcttgtttctgtattgcctattgttacttgttactctattttcttattatcttacctttagaattctatgatttaacttcatttactgttccataaaggtgctgatggttgttggagcaggccgggggccactagtgagagcgtcgttacaggtggctaccttttctaatgaagcttctgaactcactaaaaatcttgacgaatgttcttgtgcttaaataatgcaattgcaatgcatgccattttttttccgtatacatgcttcactatctgaatatgctttcatattcaatgcaggctgctgaggaaactggccgcaagctaaaagtatacgccgtcgagaaaaatcctaatgctgttatcacccttcacgtgagttattcaacgaatacagcatttgtcattttcgttctcagatagttgattggatgtggaaagcttgtcagtgtaatcattgttgcaatcctttgtccttatgttttgttgatagtcgggtttttctcctgtttatcctgtacgtgtgcaaatatgattacatgatgactatctgatgtgctttggggcggtgaaacagagtttgatcaaattggaaggatgggaaagcttggttactataatttcaagtgacatgcggtgctgggaagcccctgagaaagcagatattttggtatgttgatccctgctataaatggacatttcatatcttttcaaagtggttaaatcaatggcttatatgcaaatatggtacaggtcagtgagttgcttggttcctttggtgataatgaactttctcccgagtgtctagatggtgctcagagattcttgaagccagatgggatttctattccttcatcgtactgaccttttctgtccttagtctatattttcatctttcttggatcaattaaatcccagatatccttttgttcttatatcatttgataacttatgttcctttgcagatacactagctttattgaacctataacagcatcaaaactacacaacgatgtaagtgcctctactatatcaatgataaccgtaagatatttatggagtttgaagtgaattggtttatacagatcaaagcacataaagatattgcacattttgaaactgcatatgttgtcaaactacaccgaatagcaagacttgcaccaacacaatcggtgagcgaccacagtttctgctgtatttatccctcatcaatagtgtatcctatcacattttgtgatatgttatcttttccaaagaactatttcatttgattatcaccattttaaaacatgtaggtttttacttttgatcatccaaatccctcaccaaatgctagtaaccaaaggtataccaagttgaaatttgagataccacaagagacgggatcatgcctcgtgcacggtatgtagctattgagttatacttgtgattatactttgctatgttacaaggtagaaacatctatatatttggcagaatttgactctactcattcccatcattttggcaggatttgctggatattttgatgccgtattgtataaagatgttcatcttggaattgaaccaaacacggctacaccaaacatgtttagctggtacactaaatggcaaaacctgatttttatgtgctggcaataactgttcttgaatagtgccttcaatattatcttttatgtatctcatcaggttcccgatcttcttcccattgagaaagcccatctacgtaccgtcgaagacgcctatagaagtgcacttttggcgatgctgcggtgcaacaaaggtattgtggtttatcgcactgcttttgattatgagatgtttgaataccccttacctgaaatctcatctcccgcattgctacaggtgtggtacgagtgggctgtgacggcaccttctccatcaccaatccataacagcaatggtcgatcatattgggtcggcctataagtaaagccatgaagccagttttgttttgttccgattttctttttagggattctttttgttgtcttttgaaagagaggagagaacagattccattgtatggtttcttgtgtggagtgactctttatcagatatgctgcgtgggagattgattcttcagccttaaagcaagtgataactgacagtggaagaaacgcatcttggatgcacaggaccagagcaacccagtaaaaaacaaatgatatatcttgatgggttgatgtgtaacatcagagcaggtacaataattggcggtagtagttccatgtaggattttgtgatgatctgtaggagaaaggggaagagagagagagtaagctggtgactaatttgttgtcgggctgcacgcgccgctcgaggagactgtggggcctgccttgcgcggcctcttctcctcgccaactcccgcatcagccatgcctttcgctgcgatgttgcctgcctccgtcgctaactgccgccgctgcccttgttgcctgccgtatggccgccgctgtcttccgacgtccgccgcacggtcaccaccgtctttcgcatgagccgtcgctaccccggtcgctcgccgcacaaccaccgccgtcttttgcctccgccgcgcggcctggctgccaccgtcttccgcatcagccacgcgacccggtcgccgctaccctcgtcgcccgtcgtacaactgccgccgtcttccgcctcaattgtgcggcctagccgccgctgccccccatcgcccgccgcacggtcgccgccatcttccgccttagccttgcgacccggctgccgttgcccccgtcgcccgccgcacagccgctgttgttttctgcctccgccatgctgcccggccgtcgccatcttccacctcaattgcacggcctagccgctgccatctcctgtgtccgccgccgctgtctttcgttgtcggtgacaggaatcgagggaataggagaagaagacatgacctgtgaggggatagaagaagaagacatgacctgtgaggggatagaaggagaaagagaatgtgaggtatgagaagatggtgggttccacgaatcaataaaatattcgtgttatagtatttctattatatatacattagctacactgcttattatagatgatatgggtatttttttggagccaacagtaggctatattattgaccttgctctcatctttcatgagctagatttgtttggagttgaattccacaatttccagttttttctttacaatgcttttggtacttgtggtgcatagtcatgagtaagacagaggggctgtttagattgtagataaaataagtaagttggtaatattagcaaaattttggtaggatttcttatgtatttatcaaagttgtcaaaaaaaaaaactaaatgtagacacatcgtcagcaactttgaaaaaaaggtataattgaaaatgacattattatgatataaaaaaaagatagcaaacaaattcagtgactggctaaggcatgcaaaagggtgaatttgtggcacgcaaaaagacacataattaattaagttttaccttctctacaaaaaatagattgatatgattttttaaagatacttttgtatatttttttcaaaaacacactatttaataatttaaaaagtgtgcgtgtgaaaaacgagagagatgatttccagaaatgacggataaaaaaggttcccgtttcttgtgagaattcaattatttactccaaaatttatactactagaaccacatgaaatttcaaaagcctaaaacctttggacatgtcattttggacctaaccacatccttgaccgtcgatttgtaccccaaatcatttaaacgtgatcaaaattataatatacacataaatttaatattaaacttcttgaacatgaaaaaccaatgtatttttttgcctttttgtttcaaa

SEQ ID NO: 90178 - DNA, 2489 bp, Oryza sativa
atgcccggtacaacaaagtaaggctgcatgcattagtaactcttccttcagccattaaactgctatattagagacactttatagccatgacaaattagacgtcttatgataattgataagcacaaaattataatgtgacggatgccttttcatacataagggtacttgcagattcaattgttaaacaggagtccatttaccacatcccaaattttaattatcaactgaaaagcagatctccaatattctaagtttctaatgcatattaatcagggttgagaagcaaaaaaaatcgtttcggtatcctacagaaatacgaggtgcttaaaaaagggacaagacaaacatcttctctgtccttgttctgaatgcaaaaggagcacttgaatataggcatacactatatgatgcttactgaactgctgctccaaagcttcattttttttatatattattcatgttacatatgaaatgttaaaatgacatgagaggtttacaatcacccttaaatatgaagactgattaaaacttaccatgtatgacatcaaacaattgacagaatcatacagtctattaacttccactgcttcgccaacaatatctggagaaatcttcgatagcaataatgccgcctaataataaaacaaaacgagaacagttcaaactattacaatgtcaagaataccagcagacaattgctatggaacagactaaactttacagataagatcataagagaatctacaatggttcttaataactatttctcatgcataccagagagtttatatatgctagaagagtagaagaacaatattttctcaagcttgaaagataaaatttaccttaagtccttctgcagtgcatctgatataggccaccatgatcagcagtagaaaagggccatgcacctttagatatgtggcggtaccactgactaagatctccagggcagtcatcgataacctttcaggataaaagcacaggtaagtaatgagatggcttgaaatgttgattagtataatcgtataagggaacatgcatgaggcatgcacctgcgttttctttatgtagccatgtgctagtttaagagtaggaccaaattcttcaatgaggccagtagccactatagcttgaactgtgaaagctgtgtcccacagctggcttccattataaccctacagcggtcacaaaaagaatctatagttaaagtaaacagaacacacttgatgcaatgcttctctaaaattatgctatgttaaaaacttcattggcagaaattatgccaaaacaattttccaatggcatcaatagacagtaaatcacacttgttcaataggtgtcttgtgccaaagttaccaactttcttgttggaagttagagtaaagaaaaaaggtgacctgcattttcatgccatcttctgcaatccataggtaatcgtggactcttggaatgtggagtttgaatgcctctgagtttggatcttcaatccagcaagcaagcatatttaatacctgaatagagagaatagatttgaatgacaagaacacaatgtattgcctgacatgactgagcagtttaattcatcaggtattaaagcatcaagagtagttacatcttatagctacgggaggaagaaacaaaaagaaactccataatctgaagtttaatgaaccattcaaaaataaattgcttctttgctacctatatatgtcttcacaggactataataggcttattttggcagaaatgttcatgttttaaaacaaaagaaacatagaaggggaagaagaatgacagtgaacttgccgcttgagagaaggtagtgcaactaaaacatttttaatctatataggccgcttggtggccacccaaaaaaagggtggtgcgaggagccatcgtcgctacaataaaatagtaaaccaagataaaaaaaaaatgggtgaaaatttaaaggggaatactgtaaaacacagtaattatgacagtttccctctaattgcagctgcacatgtattccattcaaagttgaaaattgtaagtgtgtacccatataatggaatggtttcccttttatgcctgcagcaagaaaagaaagaacgacccactttcttttgtaatgaaccaataagcaatcatagtcttcaaattaccttgtttactggaccaatgcaaatatatcgggtgttctcatcttcataatgaatatgctgcatgacagtgtccaaagctttctccctcaatttgttcccaggccaacgcaacatagctggttcaacaaatttgtggagagtggcccataatacatcctgcacgaatggatgtggatagtacagatcttcctgcaatacaatacccaaaaaaaaaaactttcagaaagaaaaatccagatcttattaaacacaaagtgataaaagcaagatacataggataaattatgtaaaattttgggcttactacaataacttttcaagccatgcacgataaca

SEQ ID NO: 90179 - DNA, 660 bp, Oryza sativa
aattctgctgagaccttggggacattgtgattgattatccgtaagacattacaacccatccattgtcctcttttcttgctttgccatgtagaaggtgaactgatctttctttccttctctcctttgtatgtgtataaaatttatagttatgtggaatgcacttcagcagcaattcaggccctgtactgcatttaaaaagctctaccctggacaccgcaagagtgaaatagacaactgtataagcaaagctgctagctttattgagggtattcaaaaaagcgatggttcatggttagtacaaggacttcacatgaaacaataagaacattgcgtgcatataattgtctacattgtctactgcccttggtcaaaaaaaaaattgtctacattgttcactctgtattttccaacaggtatggttcttgggctgtttgttttacctatggcacatggtttggtgtaaagggattagttgctgctggtaggacattcaaaaacagtcctgcaatcagaaaggcatgtgactttttgttgtcaaaagagcttccttctggaggctggggagaaagctatttgtcatcccaagatcaggtaaattcatttctatgaaatttgcacaatgttactattctttactttttttttttctgtatcatggat

SEQ ID NO: 90180 - DNA, 684 bp, Oryza sativa
cctgtgctctagctagctggagctagttaggtggccattcttctccatctccggcgagttgattggctgactgactggcggcggccatgtggaggttgaaggttgcggagagcggtggcacgccgttgctgcggtcgacgaatggcttccttgggcgagcggtgtgggagttcgaccccgaccacggcacgccggaggaccgcgccgacgtcgagagggtgcgccgtgagttcaccgaccaccgccttcaccaccgggagtcagctgacctcctcatgcgcatgcaagtatatattaattacatacgctcattcatcccttagttttttaaatatataatgtcgctattcgtttattaataaaagtattcagttgttatatacttctattttggttatggttatatcatcactgcagtacattaagaacgacttatatatagagagagaaagcattatgaacggtcaaatatatgtttaaaaatcaataatctcatatattaaagaacaaaggaagtaataaacacgaatggctctgtatctttcgaaaatcaataaccacctcatatattaaagaaaaaagggagtaataaacacgaatggttctatatctcttatttgtatatattatataataattacttattagttaaactgcaatttactccaatactttttgagaaac

SEQ ID NO: 90181 - DNA, 990 bp, Oryza sativa
aaccgcactttctggactggacactacgaaacttcatttttttattgaaatttgttgacaggtgtacaaaagtaacatagtatgtttgaaaggttgtactttcttaaatttttatgagatggttatcgagtgctagtttacagagtagtgcagtagtacttttctttttccacttccatgttcttgagcacaaaaccttttttttcagtttgaaaaaagtggatgttgatccacatatactggctacttggttcagctgactgcatttttcattgtttcagatattaagaaatgctttctccatgctattggaaacagcagaatatctacttaatctaagctttttgtttcaggttgcagcttctatgcaaaaggatgtggatgcacatgttccaagctacccaaatcttccctccaagttgatatgtcttcttcacggtgtcaatttgcatgtacctaaagctacttgccttccattttctctttgctttaagaactagcaatcagcaatactaaaatcattatctttacctatcaggcagacccagatactgatgaagtttatgcacagatgactcttcaaccagtgaatacagtgagcaaacaaaaaattgtggtttccgcaaaagttcctagtctgttcaaatgcactcatcaattgcttttatcagtatggaaaagaggcgttgcaaatatcagagcttgcactaaaacaagcaaggccacaaatggaattcttctgtaagacactcaccgcaagtgatacaagtacacatggaggattctctgtgcctcgccgtgccgcagagaagatattccctcccctggtatgtaggcttcatatcttctgattttctgcaacaaaagatctgttcttagcaccattgtaattttgccactctgcactgtaggacttctctatgcaacctccagctcaagaactgcaagctagagatatacatgacaatgtgtggacatttcgtcatatat

SEQ ID NO: 90182 - DNA, 2321 bp, Oryza sativa
agtcagcaatgtagcaggtgccgaatcgaattccagcttatggaggacttgatcttgatgtcttcttgttgatccatgatgtgagcaatggttgtatccatagtagccatgttcacatcattctccccttcttcactgaaaaccgtcctcggtttttccatatggtgctcttcacacagtccattcaaaataacctgtttcatcaaatcaaaacaaggcaaactcgaaataattttgttagcaataacatttctctctagcttgcatgttttatccacatgtataggagattctaaatctgaacatatgtaaactctatgcaccaaatatagtcctctatcatcagattcgccaaatatatgaaaaatagcactagttggacaaggcaaatcaaacttagcaaataatttcttcttcaaattattgagctcacaaaaatcatcaaactgaacatagcccaaaatatttaaagaagatagcaattcacgttcctgtacttcattagcaatgtgaacaacatgcttaaaattggcacacaaagaaacactagaaatagcatgttcattcactagttgtgttagggatataagtgaagcattatcacacaactcttctttatcacaaggaatagtaagtaaatcaacttgtgacaaaggcaaatcagaagtagtttccaccaaaatttgttctagattagcatggatagtggacaaatgtgactcattagaagcacactcaccttgagtaatatcagcaccatttaatttaccttttatgccctcttcagataatgtaggtgcatcagtcttctcttcttccttcgtgagtgatggagatgacatctcgagcatattgctcttctcctcatggtgaatgttctgagctccctgcaaaatgtcagtaataggaggcacaagcatagattgtttctcccttgggtttattaaaatattgctctcaacactgcaagcaagcatgaacaagttgcctatatgattatatgtcacgttaataagcccagcctgaatattggaattaagccctctgaaaaatctagtcattgtgttctcattagattcttgtaaatcactataagtaatacaaattttaaaatcatgaaagtactccctaacagttttgtcaccttgttttagatgttcaaatttctcaaggaaagcacgtctatagtatgaaaacacaaatatttttctcatcagtattttgcattcatcccaagtttcaagcttatttcccacagtatgccaccaaaaagatgcagaaccggtacacttattactagcagccttaatcatttgagcattagaaaaatcatactcatcaaattgtttttctactgctagctcccaattaacataagcggcggaatcatacttaccatcaaaaccaggcaatttagattctacccttgcaagatcactatcatgtacctcatatgtgatgcgtgaagaagtcgctatatctcgttgatggtgaagatgttgacgttgagcatgaccatctcgtttccccatgcgcaatcctgccatggttagtagcaaataagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggcaaatacttgctgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttctttccttttcttttctgtttttttggtgcatcttttttttcttttcttttttttatgcacctttctgccttttttttctctcacttttttcttgattttttttaacaaaaactgactcaaggaccttaatgtaaggttacagggactcaaacgtaaatataaaatttatagggactcaaatgtaaaagttcaaaccaaaattaaaaattatacaaaaatggaatgctgaatttatactgattctgtttttctgaacggatcttgaaacggacaccaaacaaaaat

SEQ ID NO: 90183 - DNA, 3202 bp, Oryza sativa
ctgaagaaatcgccatggcttcgttgagacgagctctcgacgagttctcttctctgcaagcagacgacggacactggcctggagacttcagtggtgttatgttcatcatgcctggcttggtagtatatttaaattgtatctgtctctggctaaataatttatgcttagctatttcgtggtttaatttctggtgatctagctaatttctgtacaaataaatgcagatatttgccttatatgtcactggatcactggacactatcatatcaccagagcatcggcgggagatatgtcgctatatctataaccatcaggcatatttttttccgtatatatggacgactgaccataaaataattataatatgctcatgtattcatggtttaataattttaattatagaagaacgtgtgttactccagtacttgcagtacgaatgtttataaaaacaaaaatgggtggtttgcataaattaaagcacgagttcagacttatttgctcagacaaaatataagcatatttttctaagtaacaattaaatgtcattagtataaaaaacactgagtaaatttcccaaaactacatataacttaaccaaactgtgtcaaaactatagatttaagataacgtatcacaaaacacaaatttaccatcaaaattatcattaaaatattgcaaaagtacatatctaataatgtttttgtcacaagactataggttttatttaaattactcgaactatatattattatattagagtaataagttatgatgaatttggtgctaaacctataattttgtgataactttattattaaatctataatattatgatactcgctcttaaatctgcaattccgcgataaatttaatattaattctatagttttatgatacaccattttaaatatataattttataatagcttggttagagaatatgtaattttgtgaaattcactttaaaaacatttgattttccatattttgtgactgcaaattctgcacatgcatgtgttatatagaacgaggatggtggatggggcagtttgatgttgagctcgagcaccatgtttggcacatgttcaaactatatcacccttaggcttctcggtgaagagacaagcaatgagcaattagccaaagggcgcatatggatcatattgcatggcggcactacctttgttccacaatggggaaagatatggctctcggtctgtctactatattatcgcatgaatccacacaataatgaattttgctaaacaattgctttcgttgatttttgtagggttcagtttactttcgaaacatcttgatttatataaacatgactaatataatggttaactaaatgataggtatatttagcactttctaatcgtaccaaccgattcatattttaattaaagtactttcacacgattggttttatagtacaaggttttcactttcgcgccaaaaatttcggccattttggtagaaacgaaatttctggatttttgggattttcggcgttttttagaccattttttgaaattttaacacaatttaactgaatttgactaaattcacaaaaaagttagaaaaatcgaaaatttcaaccgagataatcatttgcctgggtaagaattggaggcagggttcaatctatcgggaaggggaaaaatttcaggggtcaccgaaatttcgaaaatctttcagaaatttcgaacggaattttcaaacaaaatttgaatttaaacaataaaaataaagaaattttaccaagatcagagtatagatgagcatcgagtctattcaatccaaagcagaggaacaggagattgaaacacagtaacacgtaaggatgcgaggcttgtgcggcttgtgtcgtcgtccggtcatcgtcgtgctgccgaagagcgatggagccgccagcggcaactctagccaaacggaggatgcgaggcccgcggcttgtatcgtcgtcgtggtgccgaagagccacggagacgccgccggccactccaaccaacccgccgcctccggttccggccaccgccgcggccgctgttcgctagcttgggaggatggcgacctgctgcctgctgggcgagctgtcggaggatagcgaagcagcagcagcctttggtatataagtgaggaggggataggaaattgaggatttttaccatgaacattgttttgccgaaatttttgaccggagctcatgtttatcaggacccaccaatagacccgaaatttcgtaaatttcgttccgaaattttgaaccctgattagagggaaggtagaaaaaaaaagcccaaaaggcaaaaagaaaggagaaaaaacgaaataagaaaagaaaaacggcggaaaaaaacctaagcccgaaaaaaaaagggacggaggaaaagaaaaaagatggaaaaaagaaaataacagcgaaaaaagaaaaaaggacaaaaagagaaccggaaaccttaattattatatatataggtataaaaaagaaaaaacagcgaaaaaagaaaaaaacggacggaaagagaacaggaaaccttacttatttttcttattaggtatagataagccatatgacttttttctagtcaaacttctttaagtttgaccaattttatataaaaatttagtagtattttcaacacaaaacaaacatattatcagaatatattcaatgttatatttaatgaaactaatttgatattttagatgttgttaaatttttctataaatttgggccaacttgacaaagtttaattatgaaaaaaatcaaacgacttataatataacgcgttgattgatttcggacaaattaatttgattcactacagatacttggagtgtacgagtgggcaggaaacaaccccatcttccctgagctatggctgaccccacaatttcttccttttcatccaggtatatatatactagtaataatcatactgtatactcctacatcaaatagtagctagttgcacacaaatcaaaaacagtttaatggcaatgcctggagtttatatcagacttaaggttcatgaaaattctttaattttgaactgaatttacttttgtgcaggcaaattctggtgcttaactcgcatggtatacctgccgatggcctacctatacggcaagaagttcgtgggccccaccgcgccgaccatcctggcgctgcgagaggagatttactcggccc

SEQ ID NO: 90184 - DNA, 6363 bp, Oryza sativa
agtcaatttatagttggttgttgagaggatttagaatagcccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaagggatgttgttggaccatcgatgcaaaatgaggaaaatcaacgaagggaggaacaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggagacggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaatatcacttcagcttttgtggcaagtgagatgtacagcagtgttgttggtaacattgtctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataatgatacgtactatgacctacatacatttacatcggttgatgatcgaacaaagagtatgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaatgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaattagttgtgggacaagttggatgagttgacaacgaagcaaacagatgagcaatctcgcagaccactagttgaatgtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggtagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggtgtcgtcgcgcagcaggcgattccatggtgtaacaaagctttcgatttaggaaataaaatgctgttgtgatgtaatgagtgttcggactaaatacttctatcgtgtaatttcaattcaatgttgttgtaatgagtacctccgactattgttatactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgaaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctagagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccgaccaacacccttcctccgtactctacagtcgggcctagcaaggcttggttgctccagttcactgtaagtaaataagttgttattatcatacgtgcttatttgcgaccggatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgacgcacgggatatcagtgccgatatcaccgcagtccaagtgaggttgaacagaggtttgcacttgactgacgttgagcagagggtaccttcgaccggatgcggaaagatgcggtggtcatgcgcatcttctcctgtcgcagcccgtgagtcgtacctcagctggtccggtcaacccggctcgcgcgccacgtcgagcagactcgactacggccctgtttcgccggtctgctcagcccagaggtttcttaagtttgtttctgtttttctcgaaacatcaccccgtcgtaacttgatgttccatcctcgcaggacctcgtttgccttcaagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactagggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttgtcttacaaacttgtaaagcagtactacttttgctattactactgcagtactacttgtgtttgtctcgtctatatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctctttgagttcacatatattgcagtgaaaacgacgctatataattgacaatctgaaggcaacctcttcatatcttctttcccactagcacaccacacacaaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaaca

SEQ ID NO: 90185 - DNA, 1977 bp, Oryza sativa
tgttggtgatgagcaggaggatctggtctgcccgcggacgcggctgcagaatgcggtgtggagttggctgtataagtgggtggagccggtgatgagcagctgggcgatgagcaagctgagggggagagctttggataggctcatggcacatccactacgaagacgagaacacgcagtacctctgcatttgctctgtcaacaaggtagcttcaatttattcttctcctcctctttatggtcatatcgtttattagatatgtatggtgcattggtgctgactgttagtttgattctggagggactagggtatgtcagatttgagctagacatatcaggattcagattgtttggatatatcaactgatatctgtcttcttattgattctttttaacaacattcaggctctaaacatggtctgctgctgggcggaagatcccaattcagacgcattcaagcagcatcttgcgagagtacctgatttcttgtggctttcagaagatggcatgaaggcacaggttattaacttttgtgtctttcatgcataaattgaatatgtaacatggttaatgcgtctactgtcggtactaccataactttgacaaatgttttacatctaggaaaattttcctattactatctagtgttttcattaaatttggaggaaccaggacagacctatgaattattgtacttccagtgatgttcaattgcataattagggggtacatcagtagaaatatcaattggtatggtaggaataaagctaaatctttaaacatgacacgcctttcgttctacaaaattatctatttattcaaggaaaaaaattgtgatagattgttatctcaatgataggtatatgatggttgccagagctgggagacagcatttataattcaagcgttttgtgctactgatcttgtaaatgagtatgcttctactgttcagagagcccatgagttcttgaaaaattcacaggtacagaatctctagtttaataatctaaatcataaattaactactttataagataatccagcatatattgcatattctttcttgaaggttgttaggaatcatcctggtgaccaaagttactggcatcgccatagatcaaagggttcttggactctttcatctgcagacaatggatgggctgtgtctgacactacagcagaagcactgaaggtcattatgtttctttgttctttcctttttgttactaatgtagacaaatgaagtataaaactagtgtcatattaatctagtcctaataggtgatagcacatcgaataagctcatgcataatttctacgctgtcttccgtagaaatctgacataatttcatttcaggctgtattgttgctgacaaagatatctattaacgtggttggggatcccattgaaagagaaaggctgcatgatgctgtcgattgcctcctatcttttgtggtatgcattttttttaaatacagctatcaaacctgatcttgtaatttcctttcagagtagcccacatacgtgatattgtggaaactatatctcgtatactgttatcagttgtgctaaccaggagaggttaaaggagtctgtcgcaccagacttacagggacaatgggcttaaatatgttacataacctttgtctggaactcagtatgggtgcagctgtgaaatccaaatccaagctcagaacttgcacaacttgttgccaactttatgtggccaaaatgttaaaaatcgaactaaaaatggtgattgtgctctcatagtctcattagtccttcggtttaaaaaaaaagtctcattagtccggggagattccttcagaaagttttagttgtcatggtttaaagatgtgaaaaccatctgctcaacgtattaatttttccttgcagaacaaagatggtaccgtttctacatatgaatgtaaaagaacttctacttggatagaggtgagtttctgcacactatcgcc

SEQ ID NO: 90186 - DNA, 1771 bp, Oryza sativa
ttgtggtatgcaaattgtaatctccttcaagactaacccccatatgtaatcttgtgaaaactatggtctcattagtctgggtgattccttcagaacgttcttgttggcatgattttaagatgtgaaatcgattttgtcaacgtattagcttttccttgcagaacaaagatggtaccatttctacatatgaatgtaaaagaacttctacttggatagaggtgagtttctgcacactaacaccctaacatcacaaaaaaactccatgattgtgcctacatcataacacaatcaatctaatttatgatgttgaaataacatcagcaacatgcatgtacttcaaattataaaacacgactatttgattcagcacgtcatgtatgttccagtacatttacattgaagaaatcaccagttttattgcaaattcttatggccattccagtaagcctgacaagtcttctctttttccaacctagattctcaagccttgcgagagttttccaaatatggtggttgattatccgtaagtgatgcaattacataaatcctggtagccccttttcactttgtagataaaataactccttgcaactcatactgttctataaattggcagatatccagaatgtacctcctcagtgcttcaagctttggtgctgttcaaagaactatgccctggttaccgtactgaagagatagaagaatgtgttagaaacgcatcaatgtttattgagaacacgcaacgcaaagatggctcatggtttgtagcaagagcattttactgactagtggatattttttctctcttctagtctactccctccgtcccataatataagggattttgaatttttgcttgcaacgtttgatcactcgtcttattcaaaattttttgaaattattatttattttatctgtgacttactttattatccacagtactttaagcacaacttttcgttttttatatttgcaaaaaaaatttgaataagatgagtggtcaaacgttgcaagtaaaaactcaaaatcccttatattgtgggacggagggagtaacaatttgtaacacaataacttggttattcggcaggctaggcacttggggtgtatgcttcacctatggggccttcttttcagtacaaggattaattgctgctggaagaacatatgagaatagttcttccatcaggaaagcatgtgattttataatgtcaaagcagctcaatactggtggatggggagaaagtcatgtctctaatgaaactaaggtaagttttttctctctctttctcaacatcattcattttttttatggttgaataagcctgtgtagttcatttggttggaagttttatgataattggcatgtaggatacacaatggtgattaattagcatagttttttaaagcacgactttaaattcaactagaactggcatttactgcgttaaggatattaggggtgttttgttaatttctcatcaccttgtacacaatattttgccttgggactagatcaattgagcattgtttatccccaaatcttctctagaagtgacatactgaaggtatagtagaaccaacctcacagccctagtaatggtgtgtaccctgctcagtttaggccttgagcatgggcgggcttgttcatacccctcaaaggaagccattcaagcaaatatttgttcttgaattagcatagggtttgaatcacagcccattcatttgatttgttgtgtatgttgaagttattacttttcatttgcaacaa

SEQ ID NO: 90187 - DNA, 523 bp, Oryza sativa
aataacatacgcggctttctggtgccttctgcaattgcttctgcagcagcccataaatgcaatacctcttctgctcattttcttgcaaataatctctagtataatgcatttttctctggataaatcattgcataagaaatgggtacaggttagttcctttaaatattattaatatttgcttaccaatatgatatttttcatgaatattggcatggtatgaaatggtttactaatgagtaatcatcgttgatgaactgtgtagattgtcgcaatgcaattattggggttgtctggtcattttggtcttggaaacaccaataaccttgccagcattgatgttgctggagctttcattgtaagtttaacaaagacttagttaagtgccttttatcctcattgcattctggtttgactagtgaatttcaacagggcatttcaagttactccacagttctttctggcatattgatgttcatgattacatatggatcacctctgctgttgtaccttgggatggtttttt

SEQ ID NO: 90188 - DNA, 926 bp, Oryza sativa
attcctgcagccctttggatagctagattagacagattctgaaagtatgtgtatggtacataaatgccagctgcgagatgaacaatcatgacttgatgtgtcttcacaggctaacaagaagacaagaaacagagcttatgatctacttattgaaattggacgtgcttgtgaagatgcagaaaatgacgggaggaaggagaatttgcaccagttctttggcatggtactttatgtcattactgtttttaaatgtcttgacaggaccaaactaatgaaatatgaggctctgagccataccaacctcgaactgcattacatttgatttatcagtgctacttttatgtttaggttgctggtggtcttgctggtcaaactccatatgcgattagtgcttctgtaactgggttagctcggttaacttatgagttctctgagcttattggagtagcatacaagctcctcccatcaacttttcttctcatgcagaggaacaaccgagagattgtcaaagtacagcacacaacacatttctggtttattagcttatctatcattctcttcacctccttacagtagccctatatttcctattcaggccaacttaggttttatcaaagctttggtggctaaatctaaagccgatgtattgcacgagcatttgaaaggagttgtcgagggtttgctgagctggcaaactgatacaaagaattccttcaaagcgaaggtactggctatttgcttttgatactataaagcaatggcatttctggtggtatttatataaacgctcacaaacaatgatatggttgtttttgtcctgtggaacttttactattctaataactagatatattcatatcaactcatatagacaatatatgacatgggagaaactaaaagagtgaaatatgcatgatatatcacat

SEQ ID NO: 90189 - DNA, 4300 bp, Oryza sativa
cagataagagcttgctagagaagttcattgatcagtcaactggcgagcccctagatttacttgaccagaaaacagtgcggttggctctcaaatcgacgaaaaagagggctatgcctgatgaagatgatgatgaggtggagatggaccctgaagggcgtatcattgtgcgggaagagcgggagaggcgcaaaaagaagcagcctatctcccgagacgacgaggccgacgacaggagcatggtccgaagccagtccgtcaagaggaggaagacgaccagctccggctgggcctacactggccatgactacaccagcaagaaggccagtggcgatctcaagaagaaagacaagatggatccgtatgcctactggccattagacaggaagcttctgaaccgcaggtcggaccgcaaagcggcggcacgcaagggcatgagcagtgtcatgaaggtgaccaagaagctcgaagggaagagcgccgccagcgcgctcgctgctaagagaacgcaaacaaaaaaccggaagcagaagaagagcaagtaaggagacgaagggacagagagagatagggcaaggaagctttgtatagctgaaccgatggcccttggcagttgggagggaaagttttggacgtgtacagtgcttggtgaggattcggccgtagtagttgtttttgctcgtttcatctcctatctgtcgaagagaaacactaggttccattcttgccaaaaagggagattttttgaggggaaaaagggggaaattttgacacccgtcggtatgacggtaccagattcagattagatttaattttcttgtaagtttttgattgatgactattgaatttgaaatttgttgcttcctgcccgctgacacttcgctgtaatggaagatgagctgtagcgaaatttccgaattccttattcgggcatacgcgctaaaacaatcgcgcgatcgtggagctgtacggggatgaaacgcaaggctacggcgtacttgattttttttcatagaaagtgattttttttcttagaaagtgattttaaaaaaaagacactgtcaattcaactttttttttttaacaagggcaaacttcaactgtaatatttaaaactttaaacttaaaaatggaaacaaaattaacttgaaaacttttaactcaaattttgaaactttcaactcaaattttaaaaactttcaattaaaattctgaaaacttttaactcagagtttaaaaattttcaactacaaattagaacttcaaactgtttttaactaaattatttgtgtttttttaataaaaagctaatgctaagcttcatcattagcactattagtgatgttttgcgcgagggactaggtagggtgcatgcggccacacactaatcatatggagcagtttgaaacaagggttaatttgatccgtgacattacaaatgtgcctattcagataattagtctatttatagccatgtcattcaaatttttacaaaattggaaccatgccattgttgtctcgttttctatcttccctatccgtgcgtagggcccgccccttagattcattttcttcctctttcctcctctcttctatttttttttctttttttcccatctctctccaacactttcccgcctcctccccaccaatccatcccgacccactcctcgccgcccgcagcaacaagccaccgacatcgtactcgaactccgcactgatcaagcgagagagaaggctgccaactttgtcagtggtggcgacaccagcatccaacaccaacattgtcgttagctctagcgcttggagtctgccaacgccactgcctccatgccgactatgtgcctctactggccccgccacgttggaccggccttcctagagctcgccggccagcctccgcatggtcagcggggagaaccagcatcaggaaggcaggaacgggcaaagcaccatggggaggggtagcggcgaaggctacttgttgcatcgttggctagaggacgacggctgagctagagcgctggttactcgagctccatcgcagctgcttgaatcaagtagttatttcacgagaagaaggctctagtggcaacaactcgggtttggggatgaccggtctcatcatggagccggcagcaacaagatccagctccggacggctgtaggcgacgacaatgtgtgaaggggtcgagatggattggtggggaggaggctgagaagtagtggagagagacgggaaaaaagaggaggggaggatggagggataagatgaatttgacgggtggggtccatgtgcatatggggaagaagatagaaaacgtaacggcgatgacgtggttctaattttgtaaaatttgagtagcatgattatgaatagacgaattgtaatgacatttatctgaatatgttaacagtgaaatttggtaagcccaaagttaccattggtttagagtcagtatcggcttcaaagttctagaatcagccgatgggagtcaagtcgccacgatgtcgtgttcttggtggagtcggatcaatcaaaggaagcttatctagaagagttcgagttcaagaaggatgcgacatgacagttatctattaattaggcatagtttgttagtttccttttatctttagaaaagtgtgtttagtgtccgataaggactttatcttttccttttatctttaggttagtttctttcttgtccgacaaggacttgtatcaacccatgggtataaatatgtgcacccggggtctatgtaatctatcttcacgatcaatacaattcggcgcatcgccaccttttaccttttctactttattttatcgcccagtgggacttggcacccgacgtgcggctgcatcgtcttcgatctccggcgaaggggtaagtccaatgttccgtcggcccaggcaattgtatcgtctacatcggcgtcgttcaaggctgcatcagtacattcgacctcttggattgctctggtttggatgatatatttgcctagctatttatcatatgtctctattaatctagtcttagcatatcaatttagctctatcggctgcttctcgctttagggtttctgccggtatcggctaaattgcgttgctagattagattggcctaggcatctaccaccctgaaaatcagtcaacggcttgattgtctagatattgtgtttcttttcatacttagtgctgcatcagttaagtttgatctactaaatcgtgcttagaactataatctctaacctgctttctgactgccaataagggtttcatcggggtttcagccggtgaattatctggacgttgcatcggctcataaggattgcatatacatataagttggatttcgccgatgacaacaaaggtttcactgtttaatctaatcttgtggatttcatgacatcggacctccagccgatttgttatattttattatcagtagccgattgcctttatatcattatatacattggacatatagccgattgcttaaaccctatcgctatcggctggtatcgacatcggctattatcgactatcggctggaactactacatcggcttgtcagccgatcggctgttttgatctactatttacatatcttgtcagttgcatgatcaaactgactggcacgcccgcatctcatcgtatttggacctgcactggagctaagcagatctcccaggccggtgtgttcgatttttttcgtcaacagaataggcatagttgcaatggtacagatcaaattaacccttgaaacaagggattgaagcctactaattcctttgaatcctatggaatgagtacctattggtctctcaacagacgatatgacctatcagtgtgttataaggaacaataccttaggactgattttttttttacaattttcgataaaaaatattgttacttatttaaaaattcacaaatctaggtgatatgtcacatttagaattttgagttttaatctttcttggtaagttccaagttggctagatgcaaaagtttatatatgaaagaacattgataatggtggggtggttttgaataggcatttttgaaaattactacttagcagcggtgtaaatctatccagaggatcatgccagaaacatcgaaacttccggttggtcttctcgatctggacaagagagctgaatggagtttccagtccttaggttcaaaactttcgatcccctagtttcttccaataaagagggtgatagggacaatcttcatggaacaagcaatccaaacacgtagagaatgcaagaacaacaagcaataacagtt

SEQ ID NO: 90190 - DNA, 1717 bp, Oryza sativa
agactttcccttaagtaggcaagagacaatccccatgagagaaaggcatgaaacaatcatcaatgagatcgcagagacaagtaaatagaatggtttctgcaaatataacagtaaaaggaaaacaaatcaatttgatcttaaggtgaaaggaaaaatgtaacagaatgctacttcacactagggttgcaaagatagtaaaattacattggtcgctctgtgagacaaccactcactcgcatatcttaagaattcatagtaggcgttgacagcagtcctgttgcacccagcttcaatggacctgaaaaaggatgtatttttaagaagtgaaggttgatcatattcacaacagtttagaggattttaacagcagacgcttacttgacattagatgtctgatgaaggtgtgaaggatggtgggaatcaaaagctttagaaagcaaatgacacaacttcttctcaacagattgaggaattttatcaattcctagaccatactttgaattaatgcaatcctcaaagcagaaagcaggtaactgtgcttgcaacaatcttaagaattgcaatgagttcagctctaaggtccgcagtttttgctgatctgaaataagatgcactcatcatattttgagctgaagagttttgagtactgaatcatgcaatttgtaaaattccaatattccagaccaccagtttaactgagaactagcataatgcctgtgttgcaacggattttttttaaaatagctcattacatatattttaaagcctataaaaatatagtctaatatattatcatcatactaattctgctgttactttctaggtgactgttcagttagctataggggtcagacatcacaaagtcttgtctcactgttcgtgggtcttacatggtagttgggtggtggtggtggcagacccacaactaccactaacatcttttgagatagtatagatatagacatagcaatcaactaaaggcatcgggacacatgattataaatccatcaaaatcctattacctattgaaatcgttataaagtcgacatgcatcaaatatcttaaatttttttatgaagtatcctgcatcctgatgaagcgcaagaaactgaaaacagaaggtaaggatagattcacctgtcaaagaattaaaaacctctggaagcacaacacctatattgttcttcggaattggtgtcccaaagaggagagataatgttggcgcaaggtccacctgacaaagaaaaaagagtagtcaatggaacactactttaggattgttcgcaagtatagcttagatgatgacaaaatgagtggtttataaataaaatattcaacaacaacaatgatttatatatgaaaacatactcgatgagtggatttgccataggtatccagagataaagaaaggatgaaactacattcagtgatagagtaagagttatacctgaagtgcttcattctggtcataaggtgaacaatatgaactctgaacactgtgtcctataaaaagggcaagggagtcagtttcttcataagaggatcctccatgattaccaccttcggtcatgccatgatcactaaccacaacctgaaatgtcgggcggcagaaatatgcctatgagatttaatgtagacctttatctttccagaaaaggcacagacttgatcaacggttgtaaacactactgaacttaacaagctattatagtttgct

SEQ ID NO: 90191 - DNA, 953 bp, Oryza sativa
cacagggagggaggtgtcctccaaccattagatcaggtgcaagatactatagaccaggcccacatgttcataacaaatgtggtctgagctgaaatctttcctgacacatgaactaactgtcaatcaacctgtgaacctgtggtggaggatctcgatagaattacatcatcatataattgagtgtactacaatgttttggcaaaagtattttccccttgacagatggcacggggaagcaacatcgttgccgtagtcacacaatgtacacagcaccacaacgaccagccatggactattcacagaaacttggatgctacacggcaggaagtccagaaggcagcagttgctgcttttagaattgctggattctggtagatgctgcatggaagcaagacggtaacacaatcggtcagttagctctagttacacagacaccaaaaagagcaaatatatgcaccctcatcaggtactcatcagctgtgggcttatagctacatgattaaatcaaagatgccactctctatccaaggatgcaataaatctaattatttaaatgcttgaaaagtgtaagttgtaaaaatacttttagaggaaatggcactgctcaacaggtggaagaaactaacctaactaatcagaggtaaactaccaattcaaaagctcacagaattctaacggcttatgcagcccctgtagtagaaactaatatggggagtttctagagaaaccaatgcttggcaattgtccagatcaatacaccattctttgatatgatgttagcgaaccactttagatcatcctaaaccaccttagatcatcctaaacattggttacaagtagactagtaacaatagcttacccaatagcagttgcactccatgatgctatattataaataacttttgttccatcccatgctttctgaagcttgcttttcctcttcttagctgaaa

SEQ ID NO: 90192 - DNA, 865 bp, Oryza sativa
gttcccgttgtttttggaggcgactggctactcttcggaggatgttcttatgcaagagcctaaagcaggagtgagtgaattttacctgtgtttctttaggggtatctcttctcttgctgattctgcattcctgtaatatttcacaaggaaaaaagtgcctactttgcattgatctggtgtttttcttgggatccttgcagattttgaagccagctttcaccattatacttgatagagacaagcaatgtatacttctattaattaggggaacccacagcatcagggacacactaacagcagccactggtgctgtggttccattccaccatactattgtacaggaaggtggtgttagcgatttagttttagggtacgcgcactttgggatggttgcagcagctagatggattgcaaagcttgcagccccttgtcttgctcaggcattgcatactcatccagattataaaataaaggtacagcgctttgcactgtttttgtgctctcctacccactgttgtaatagtgctgaacgtcgtatcagcacaaccatttagagacggatgcacttattctgtattgtgttcatggtaaatttgtatagattgttggacattcacttggtggtggtacagcagctctgttgacatatgtcctgagggaacagcaggagtttgcatctactacttgtgtctcctttgctccaggtatgtgtgctatgatgtttttctgagagttatcttgctgcacactgaacaatgaaaattgaaaatactgctttgtcacttttccttattccactggccatctcctttgttaacataaacctgcatctcatgcagtaaacattataggataacggactaga

SEQ ID NO: 90193 - DNA, 722 bp, Oryza sativa
atcatccataataatagatatctttttaccaaactgaccagatctacgagttgaagagagcacagacccatatacaagctgattatattcctcacggcttagaaaaggtgtgtccagctttgtcaggagtacagcaccaataatgtggtcctacaaaaaggtggaatataacgagcttataatataaaaataaccgttacagcattaataaaaatagtgtgatttttaatatattactgacaggatgagttcactgatttaaatagatagatgcacaggaaaggggaagcctgattatacaccactgaatgtgctcaacagcaacagtgtggaagaaccgaaacatcccaactgcatatgcacagtgttacctgaatgaggcctctgacagcatccccactccttggaccaatgtactgcttatttgcatcaacaatgttgatggcctcagcacgagatatttcatcttgtggaaagtgcacattcatttcatctccatcaaaatcagcattgtatgtgctaaaaagaaatacagtgtttgatcaacagaagtagacaaataggcagtgttgctgaagatatgttgtaatacctgcaattagcatagtgcattcgaattgtcttctctccaggtagcacacgaacaacatgtgccatcatgctgggcttgtgaagagtaggcttcacatcacaagaaaaatgaaattagagacattgcagag

SEQ ID NO: 90194 - DNA, 2188 bp, Oryza sativa
tacacgcacgccacccgttcaccaaaatgcctgacagcgacagaggcgataagagatacgatgaatttactagtcggtagtgataaagattggctgtggtgtaggccttgctcgccaacatggcagcgatgtatgctgtctaccatggtcccgaggggctaaaggcaattgccgaccgtgtacatggactggctggtacatttgcccaaggattgaagaagctcggaacagtgacggtgcaggagctgcccttcttcgacactgtcaaggtcaaggtcgctgacgcgaatgcgattgcccaggaggcctgcaagaacgagatgaaccttcgtgtcgttgatgcaaccacggttcgcttttctgttgatgtttcccttgtattgcaaccgagtgagtttgttgatgttgagtgttgagcattcaattcaagttgtgatgtgttgcagataaccgttgcctttgatgagaccacaaccttggaggatgtcgacaagctgttcaaggtgttcaatggtggcaagccagtaagtaatcattcaattggcgcaaaaatttgtgtgcttgatagtgaaattggatcgtgatattaaaatgatgtgtcgttacaatcatttttaggtgaacttcactgctgaatccctcgcaccagaggtctcaagctcaattccgagtagccttgtgcgcaagagcccctacttaacccacccgatctttaacatgtatgtgatgttaaaaggcatgctgcttttcttcactaatttcttgcagtgttaaaagataaaactgaacttatgttgtgggcttccaggtaccatacagagcatgagcttctccgctacctgtacaagttgcaatccaaggacctttcactgtgccacagtatgatccctcttggttcttgcactatgaaactaaatgctacagtggagatgatgcctgtcacctaccccaactttgcaaacatgcacccatttgcacctactgaccaagccgcaggatatcatgtgaggggaattcagcatttgtttagtttctaaatgcaaactgttcatcagatgatctgaaatggcttgttttgtgatgaaggaaatgtttgatgacttgggcgatctgctgtgcaagatcactggctttgattctttctctttgcaaccaaatgctggtgcttcaggggagtatgccggattgatggttatccgtgcttaccacagggtatgtcatcataaataagttggcatagctctcctgttttgtttcacattttatatttacaaaccatgttataaaaactgcaggcaagaggagactaccaccgggatgtctgtatcattcctgtgtcagcccatggtacaaatcctgcaagtgctgctatgtgtggaatgaagattgttgctgttggaactgattccaaaggtaacattaacatcgaggagttgaggaaagctgctgaagcaaacaaggacaacttggctgctcttatggtactgttctttttgctctgtaaatgttatcatttatctggtcttctggtagtactgtggaatgcctatggtctctctggtcaactattcactgttaaatttagagctagttttctaatactgtactatcactgcatcaccttttcgctatatttagcgtgttgcttaaagtcataaggctatttctgtactttttgttgtttctaatatatattaggatagaaaccagatagctgctccataacatgatccctatagtggctgtatttgtatacattcaataatttgaagttaatcgacatatataatagaaacaaatccccagttagtttagtttatctttttccatatgagcaattttatagtctttgagaaggtaccatgagataccactttttccattgtaaagttgatacctcctggtatctaattactaggaggtaccaaattttacactaaatttttagtacctcatggtatcttctcaaggattgtaaaattgctcttttccatataggctatagtccgcgggtgatttgtgaataagattttttttattatgggcatagaaacataatagttcactcaggttgatttgatttataaaacaagattttgaaatatgttggccttatgcgtaaagtaacagaatgttgcgtggttgctctgttcaccaggttacctatcttcgacccatggagtctatg

SEQ ID NO: 90195 - DNA, 744 bp, Oryza sativa
aaactaacacagagatgaagccactatttgatgagacagaagcatcttttgtcaatgcaccaatagaagcaaacttggtagttggaccaagtaaagtggatgttgctaatgagtctgagttaactaaaactgatacaaacatgatcgttcttgatgccaattctctggaggatatagagacggcctttaaacaagcaagcaatggcgttgttgagtccaccgtggacaatgaaaccccacaggtttctggtgttgatattgacccagaatccatagagagttctgaacattggatgtcattgatgcaaaatccgtcgacgacatatatgctgctttaaggagcacacaactgctgctatgaacagttccttcgaagaaaacgaagacaagcatggatgcggtgatactgtaaaattcaccatgcatgatgagcttccagaaggaacacatattgaaggtaacacagttggagatggtaaagagcctgaaccaatggggattacaagcagcatggatgtcattgatgcaaaatccatcgatgacatatatgctgctttgaagaagcagtcaagtgctgctgcgaatagttccttcgaacaaaacgaaggcaagaacggatgtggtgatactgtaacattcaccacgcacgatgagcttccggaaggaacacacattgaagatagggataatacagttgaagatggtaaagagcctgaaccgattgggactacaagcagcatggac

SEQ ID NO: 90196 - DNA, 2619 bp, Oryza sativa
cattagacaattatactataagtttactttactgccattgggcctaaaatacatgaccagcccacacaggacttaacccacacaaaaaaaaaaaacagtagcatcacgattcacgagcaatggatcaaaaacaagatgaaatattgaagaaagatagagcggagcttctgcaagctcaggcagagctctggtgccacacttttggctatctcaaatccatagcactcaggtgcgccgtagagcttggcatccccaacgccatccaccgcaatggaggctctgcttcactgcccgagctgcttggcactctccctctcgcggcaaacaaacgatcatgcttgcctcgcctcatgagattcctagtctctttcggaatcttcaaagaagacatctcaagggagggaacaacaacaacaacaagcgtgtatcagctcacaccggtatctcgcctccttgttgatggtattggcatgaacagcaacactgagcacacatgccaatcaacctatgtgctcgtgtgcgtctcacagcttcaagtaggggcatctttgtgcttgggaattggctcacgagcagcgatgagaacaccccatttggaatggcgcatggcatggatttctgggatttcaccggccatgatgccgagtatagcatgctgttcaacaaagggatggcgtccgacagccacttcgtggtgaacatagtcatccatgagtgcgccgaggtgtttgtgggggtaaggtcgctagttgatgtcggtggtaggaatggcgcgatggcgaaggcaattgctgatgcctttccacacataaagtgctatgttttggacctccctcatgttatccatggcaccccaactgatggtattgttgagtttgttgcaggggacatgatgcactttgttccgtcagcagatgttgtgttactcaaggtactataatttttgaagtgatttttttaggtttgcactacacatttttcctgtttctctaaacaaaaatgcacaagagtacaaaagaaaatgattgttgaaactgagcttggtcaatgcggcctatagtggagtccaagctcatggcggtaggaccgtgcggccatgggtggaagccatagtcgctgaacagaaccagacgccatcgctcctaaagtccaaaggttgcaggagggagaggggatgaaaaagggagaggccgacaagtgggtctgatgccacattggatgccaacataggcttaaaaccactcgtggttagcaaaggttagggaatgttaaatatccggttttatctagttgaagggggtaaatcgtacctttgtaatagttggggtaacttaataggcatgataaaggtcaaaagctatatacggttgtgtcatgtcttttgttagaaaaaatgaaataatggacttgtcttaaaaacaccttgcaactacgtaaccgtatattttacacccatcaactaacagaagttcaaagcttccaaaatagtacatcgtaagagcagtacaacccggtttaatggtgctttcttagttttgaaattcaaatatgctttttacttgtatgacacctaattaaaaagatatgtaaaagtagttaaatgtaagtgaaacaaacatatttttggatgtcaaaattgtgaaaaccactataaaaaaggctgggttgtactgcacttatttggaccggttttggtaataagagggtgcaaaatgttcggttcccaagatgcttccttttctttatcacctacaacacatgcgcacttgcacatctaaagtttgtgtcagatgacttgtatcttcacttaaaaagatgtaataattcataggttgtttttcctctattcccctaaccatgcctccagaacaaaaaaaaaatgatgaattgacctaattttgtactttggttgtggatggcagtttgtactacatgattggagcgatgaggattgcgtaagaatcttgacacgatgcaaacaagctataactaacaaggaagaaggaggcaaagtgataattatagatacagtgattggatcaccatctcaacagatacttgaagctcaactttcaatggatatatgcatgatgacgttgacaacaggcaaagaacgagaagagagagattggcataagatattcttggaggcgggctttacacgatacaagattatgcccatcttaggggttagagcacttattgaggtttatccataacatattagatgaatatgtcataaaaacaactttgtatctcgaacaactacatgatcctctttgtattatgaatatgttctacgttgattactcttaaatgtgtgtgaactccttgtattgttctatgtatgccagttagttattactaatctcatgtctacactacaccggaccaggtcatttgtgacgggtccaaatccttatcttcgacgggtttgtccctttgtcatagattagtgatcactgatgacttaacctcacctgtgacggttgaaggtccgtcaatggtgagagacacctatgacgggttacaattagcaaccattagtggtgagagatatttctgatgagttataattagaacctgtcacagactatgtcacctcaagggctgcaggaa

SEQ ID NO: 90197 - DNA, 1117 bp, Oryza sativa
ttgagaactagaatgttcaaattccaattttctagcaacatcaccaaagacaatgaaactctaaacacttccagtgcaccaccttcacgaaaaacaagacacatcatgcggctccaactaacaaattagtggcaacacatcagtcatccacccctgcgattaatctccagtggcaacacatcatgcggcttcaagaagaacacaccccaattaaaaacttggcaccgataacttgcaagatctaaaatcaaatcacaagaatacaaacacatacatcagtacccatctgatgcatgacggtggaggcatcgacacgtagtgcccacaggaggaggtggacactgtggcagccgccgcttggggatggaggaggcggctagcccttggaggtggctgctcggtgatggaggaggagccggatccggtttcccctgacctggatctggcatcccctaacttgcccttggaggaggcggctagcccttggaggagccggatccggtgttggagaggccggatctggcatcccctatctcgccgacgttcccgccgggcctcggcaccttgctcagcttgacgatggacttgacgaattgcgtgaagaaagcggccttgtcctgtgtgaaccgcctgacgaggtggctgcagcggccgctggatctcgcccttcctcgtctgtcggatctcgccacgccgacgctcggggatgagacgctgacgcccggccacatctagccacatctggccggcgcccggcggcatctagccgcatcggcgcccagtggcttggatcccggcgcacggaagaagggagaaagagggaggggcggaagaagggagagcgcgggtggaggcggaagaaaaaagaagaagaccgatgggcgtgggttcggagctgggaggagaggggagggttatgagagcgattttttttatcatctttgacgggcacacaaatatttggcccatcacaggtgactttacctcacatctgacgggttcctttttggcccgtgtcacaggtgaccttttttttttcggggaaatgggaataaattactcaggaataatattgtttcttacaagatatgaaatagaaacacgactagagaggtcc

SEQ ID NO: 90198 - DNA, 1050 bp, Oryza sativa
agagggatccatgatagagggataaacaaccgaggaggtcgttgtgtgttgcattgattacctaaaagatgggaaagcaattggtttaccggtacctcgacatgaaggtagattatctgggaaaggaacaagaggaaaaaaagaatccacgacaatgactacaaaaaagtgaaagatgctcatttcactgtgctgcagcaactcgcaatagtggagccgtacatggagcaacacctgcaggaattacaagcaacaaatgtggggcgatctaatgcatggatcatgaagaaacacaagcatcactttactaaatggttcaagaacctctatctaccagatggccataccatggaagaaagaacaattaaaatgctggccgacgggccatcaagtgtgtataccttgtggcaagcatatgatctgaatggatacacgttttacacaaaagcgaaagacaaaaggagtgcatgccaaaacaatggcgttcgagtagaagcaatcgacacaactgggcaaaagagcacatactatggattcgaagatgaaatctgcgaactagactacgggccaaatatgcagattccactgtttcggtgccgatgggtgaaacacccagccggcgtgtttgtggacaactttgggctgacaattgttgacttcgacaacgtaggccacaaggatgacccatgggtgcttgccgatcgggtcgctcaagttttctatgtgacagacccatctcatttgaagaaagacatagttatttcgagaaaacaaaggattttgcaagttgatgatgtcgaagatgtcgaggcatacaatcaatatgagaacatgacattattcacagattttcgaaacaagatattacgcgtcgaagaatcaattggggaatcgctgaagccatacttgagaaatgaaggtgtagggaaaaatgttagatgctaatttattatgtatatcatattggacgtatcgatgaatttatttgtattataatgcgtgacaatgatagatgatgaatttttgtatatggatatatatggtgacatg

SEQ ID NO: 90199 - DNA, 786 bp, Oryza sativa
acaagcaaagcctacaaagctagcggcgggtgaaattgaagcggtgcctgaacagccaatgcccgatcaaccagagccatcacaaccagagccatcgcaaccagaggaatctaagggtgccgatgtgccagtgatggtaaggacgcacaagcacaaagcaaaaagtgcgtccaagaaacagtatatggtaacggcattccgaggaagggagaaagatatcataaatgccgaatttgataaaagaaaattaaaagggttcaagcaaaccatggatgactatctcaactatatcaattccccagacgtgccacacgaatttgagaatggcaaaccattcatttacgactggcaactaagagaaggaccgtggcaactaagaaggtggcacaattggtacattagggcaagcaccatgaaaggcatttcatcattcacagttgccgtgggggagaacatcttctggagcggtccttgtctactccaagtccatttctccgatatgcatcccctctaccgtaggaagaggctggacgccaatttaattgccatctggtgtctgtaagttctagacttgaacatgttaataaatcactacacctatatgcgtagctcatttgatcatccattgttggcaggatgaattacgtggaagctgaagagatgaaaaaacctgtcgcctacctaaacccgtgcaggatgtaacgctccgctttctgcgggacgttaaaagctaatttattgaaaatcctaattgcgaaaattttgttctttgaggggctgcaggaa

SEQ ID NO: 90200 - DNA, 1817 bp, Oryza sativa
tttatgtcggcgaaaggacgctacgggccttcagatccaaggcttatgcagtaaaaatcctgaaggtaactgaacatctgaatgatcatacattttctgaatttcaagcattaatcatcactccttgaacgataaattgttcttaaaattattagttggttggatccaaaccaaaaaaggttgtataatttgcattgaggaacatacactgattaagtttggtgatccatttatatcataagaatcttgaaggcaacaataatatagtatagggaatggaaagattcaggatgcatgaaagataatggcatgtggacggtcagataaggttctggggttaggtcatattggcactacgatattgatgatattataggcctaactaagcttctatctccttttaggaattttccatcacatcctatccaattcaaaagtgacaccatctaatgttgaaaccaaatgagacaaaaagaaggatatagcgtataaactatatgagtagcatctgttatcattttctttactactacctccattcgtctcagaatatagctacttctggctataccatccaagtgcatagtcaggagtaactatattttgggatggttgtagtagtaaaaatatgaaaatgaaaataggctaaattaggttcatgttcttaactgaatttgatccactcaggtgtgtcttctaccgggtaatgtgttgaccatcacaatgtcaaagccttatggattcagatacaggagtgggcagtacattttccttcagtgtccaacgatctctccatttgaatggttcgtctgcccttcaatctactgcttcagtcagccttgctctgactatctactactactactttcagacacaagtaactgatggtgttctttcttgccccattgcttcaggcaccctttctccatcacttcagcacctggagaaagggtgcctgaagcaggcaccctttctccatcacttcagcacctggagatgactacatcagtgtccatatccagaccaggggggactggacgcaggagctcaagcgcattttcgtcgagaactatttcgtgccaagcgttccgagaagagcttcatttggagctctaggcatggcagaacagaagaggtcaatgcactctccctgtcaattgtcatttctgatcctaagagttagctatggaactgagcactccctcatctcttctgcagtccaccaaggttgcttgtagatggcccttatggcgcgccggcgcaggatttcaggaactacgatgttcttctccttgtcggcctcgggatcggtgcgacgcctttcataagcattcttagagatctgctgaacaacatcaagctggctgatgagctgatggtaaggtttctttaacatcagtaggctagctgggttcccttctcagccttctgaaagatgcatcattgcattgatgcctcctcccttgtctgaattcttcaggatctggcaatggagactagcaggtctgacgacagcgccaacagcttcagtgtgtcgacggcgagcagcaacaagaggagagcgtacaggacgagcagggcacacttctactgggttacaagagagccagggtcattcgaatggttcaagggggtgatgaatgaagttgctgaaatggacaagaaggtgatgccttctgctccctgaactagtgctgctctccttgcaatttttgtgtactgatgaaggtgatcatgctttttgctgttgcaatcagggtgtcatagagctgcacaactatctcacaagtgtgtatgaagagcgtgatgccaggtcg

SEQ ID NO: 90201 - DNA, 2507 bp, Oryza sativa
acatataaaacttcagtttccaatctgagcacgacaacatcacgcacccgctgcctgtggcctcaagcagtgacctatgcctcccctatcacaaaaacgagacccgtggcggtcagttgtcttttgagctgatagaatttttgctggtgggtctcacgaatctgtcttccatagttattaggatcaaaccggatcggcggtccgaccggggaaaaccaggtcagaccgggctggcttttggtgatgggctgaggcgaggcccgctgagcaaagtccaccaaaaatcgctggaaaaggatggggattcgaccttgggcagtgacctatgcctcccctatcacaaaaacgacacccgtggcggtcagttgtcttttgagctgatagattttttgctggtgggtctcacgaaatcgctggaaaaggatggggattcgaccttgggtcgcacggttgagagctgcacgcgctacccaccacaccatcgcttcgcttctgttggtctaagacattaatcctataatactttaaatcgcggttggaccggccgaaccaccaaaccagtgaaccgagacctcgaccggctcattctccggtccggtatagaaatcttcaagtaaactatgctgtcttcaagtgtatagaaatcttgtgaccgccacagttcatagaatatactttactcccttcgtttcatattatttttttcactcaaccagttttagctattaaatatttttgtttcactgattcaccagttgcacatataatagttcattttcttaaaaaatagctaccatatgtacccacgtgtgaaaaccctgttttcgtgtgcgatttgtgctgcccatatggaaagatactaaaaattattttttatagtgataagcgcccttatagcaaaaaaaatatttagacctagtagcctgcaagaacaggttttagccaaatgcgaaaatcattttttatagtgataagtgcccttgcaacaaaaaataaaatctttataccacaccaataagtaattatatcactacgtgaaacccacatctctatcatatgttccatccacaacgtgcatgagacccacccaggttcatgaaaaaaggcccccaaatatccatcatctaactctccgccaccgtacaccaaaaaaataacatatgtaatttggatttcctatcacaacgcacgagcatgtttgctattcttaaaagaaagaaatgagagagatgaaaggaaatggttcacttgaggtgccttatcttgaagtcgagtttcgaaattgaccctgaattgaaataccagatataacagatccctaatcttgcaaaaccgggtcacattaggtcccaaggcagtattgctccccggttttggtgacgtggtggctgagtcagcgtggggcccatgtgggtcccacatgtcagtccataatcttctcccacctatctcacctttcttcccttctcaacccaaacctccagggcagccgacaacaggtagggagaagagtggcgactgacggctgcgtcatggacctgcacggcgaagagcgcgaaaaagcgaagtaggaagggctcccgacacatcgtccccttgggttacaccacaacattgttgcgtggcagctcgccgcgcatctgcgccgtgtccgcattgtggtcgcatgtcagccacaccgtcgggattggtgagagaatctccaagagttgggagatggagtacgttgcgacgcctgagtatactcgcgagcaccactgactccatgagtgcccgtgcatgcacgcgaagaggacgctagacgctgaattgcgggagaggtgtgtggtggccggtgaccagtagggagaagggaggcggtcattgggcggcggcggtaggtagaagcccgacgacggcgcctggcgattggtgggaataaggttggcagccaacaagaagcttggcggtggcgagcgttggggagaagggcgcatgcatcgaggacgatgcgaccgcaatgtggagtagatggagttgacctcgaagacgatgcgggggagccgtgcgttcgcctctgcggaggagaagcgaagctcggggacacctgaacacatcggcttttgagcagctcgacaggggcgactatgagcttggggggtaggagcttggccagcgtgacgaggcggaagccccagccctcatgcgtgctggtgaaaacgacattgcagttgtagttgggacccgcgccacaccccgcacgcacgcaagtccatgacgtgagcgctcccggccgttgggagccacgtcagccggcagcctccgccgtcaagcttttccccgccaaccgacacccttctccctacctattggcgaatgccctagaggtttgggttgagatgggagtagaggggagtgaggtggaagaagattgctggttggcttgtggggtccacgtgggccctacactgactcagccgccacgtcaacaaaaccggaaagcaatactatcttgaattaaaagtgat

SEQ ID NO: 90202 - DNA, 710 bp, Oryza sativa
atggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcactgcggcggtgcacagagcgcgctccagagctccggtgtgcacggcagcgttcccgtcgattggctgcaccagagaggatgaaatcaaaaggagaaatattcgccatggtgggctgcaggaat

SEQ ID NO: 90203 - DNA, 3118 bp, Oryza sativa
atccgtgtgtcattgtggcgttgttggttggttggttggttgcaggagagtataccgatccaggaggtgttcgccgtgctcaagagctcgccgcaggggctcacctccgccgatggcaacggccggctcgagatcttcggccgcaacaagctcgaggagaagaaggtcagaattcagaatcgtgtgttcgatcaagaacgagtttgtgtgttttgggtctcgcgtacgtataaaatatgtgaaattggcatgcaggagagtaagctgctcaagttcttggggttcatgtggaatccgctctcctgggtcatggaggccgccgcgatcatggccatcgccctcgccaacggaggggtacgcgtcgcccgtccccgtcgccgtcgcgtcagttgtgtgtgttttgaccgccgtcgatctgacgcgtgcatgcatgcgtgcgtgcaggggcggccgccggactggcaggacttcgtcgggatcgtgacgctgctcttcatcaactccaccatcagcttcatcgaggagaacaacgccgggaacgccgccgccgcactcatggccagcctcgcgccgcagaccaaggcacgtcgcgcgtgcgcagtgcgccacgccatggacgaacactgacctatctgtgctcgacggaatgactgactgactgactgactgatcgatggtcggtgcatgcagttgctgagggacgggaagtggtcggagcaggacgcggcgatcctggtgcccggggacatcatcagcatcaagctcggcgacatcatcccggcggacgcgcggctgatggagggcgacccgctcaagatcgaccagtcggcgctcaccggcgagtcgctccccgtcaacaagatgcccggcgacagcatctactcgggttccacctgcaagcagggcgagattgaggccgtcgtcatcgccaccggcgtccacaccttcttcggcaaggccgcccacctcgtcgacagcaccaacaacgtcggccatttccagaaggtatcatgcatgcatccatccgccacttctcgtcggagaggtgccaactgcttgcttgctctgctcaccatcaatggtggtcaggtgctgacggcgatcggcaacttctgcatctgctccatcgcggccgggatgctgatcgagatcatcgtgatgtacccgatccagcaccggcagtaccgcgacggcatcgacaacctcctcgtgctgctcatcggcgggatacccatcgccatgcccaccgtgctgtccgtgaccatggccatcggctcgcaccggctgtcgcagcagggcgccatcaccaagcggatgacggccatcgaggagatggccggcatggacgtgctctgcagcgacaagaccggcacgctcaccctcaacaagctcaccgtcgacaagaacatgatcgaggcacgcacagcacacaccattaatctttcagttttgccgttaatttttttccctatcgatcgagtagtagttgtcatcaaatcaaatcgcgcactttggatttggatttcagccgttcgtgaaggatctcgacaaggacgcgatcgtcctgtacgcggcgagggcgtcgcgaaccgagaaccaggacgccattgacgcctccatcgtcggcatgctcgccgacccaagcgaggtaagtgaagctcctcaagctcgcacggacacatcacacaagctcccaatttcctcttcttctacaaataaatctcacgacgtacgacgtgtctggaacgtggcaggcccgtgccggcatccaagaggtgcacttcatgccgttcaaccccgtcgacaagcgcacggccatcacctacatcgacaccaaagatggttcgtggcaccgcatcagcaaaggcgcgccggagcaggtcagccggccggccggccaccgtcagctcagccatgaattctgtaccatttgcattgcatcggtgaatttgatcttgttggtgtgcgtgtgtgtgtgtggcttagatcatcgagctgtgccgtctacgggacgacgtgagccggcgggtgcacgccatcatcgacaagttcgccgaccgcgggctgcggtcgctggcggtggcgaggcagaaggtgccggaggggagcaaggacgcgccgggcacgccgtggcagttcctcgccgtgctcccgctcttcgacccgccgcgccacgacagctccgagaccatccgtcgcgcgctcaacctcggcgtcaacgtcaagatgatcaccggcgaccagctcgccatcggcaaggagaccggccgccgcctcggcatgggcaccaacatgtacccctccagctctctgctcaaagacggcgacaccggcggcctccctgtcgacgagctcatcgagaaggccgacggcttcgccggcgtcttccccggtacgttcccagtgaccttcacaagtacaagatggaaaagcgaagccatggcgcagaactgatgatgaactgatgatgatgatgatgatgcagagcacaagtacgagatcgtgcggaggctgcaggagaggaagcacatctgcgggatgacgggggacggcgtgaacgacgcgccggcgctgaagaaggcggacatcgggatcgcggtggcggacgcgacggacgcggcgaggggggcgtcggacatcgtgctgacggagcccgggcttagcgtgatcatcagcgcggtgctgacgagccgcgccatcttccagcggatgaagaactacaccatctacgccgtgtcgatcaccatccgcgtcgtgctcggcttcctcctcctggcgctcatctggaggttcgacttcgcgcccttcatggtgctcatcatcgccatcctcaacgacggcaccatcatgaccatctccaaggaccgcgtcaagccgtccccgttgcccgacgcatggcgcctccaggagatcttcgccaccggcatcgtcctcggcacctacctcgccctcgccaccgtcctcttcttctgggccgtccgcgacaccgacttcttcacggtgaccactcatcacccaacctcgcacgcctcgccgccgcgcgctctgacgccgtgtgtttgtgggcagaggacgttcggggtgcacccgatcggaggcagcacggaggagctgatgg

SEQ ID NO: 90204 - DNA, 2434 bp, Oryza sativa
cgaacgcacgcagatggcaacgctgatcgcggtgtacgcgaactggccgttcgcgaagatgaagggcatcgggtggtcgtggggcatggtcatctggctcttcagcatcgtcaccttcttccccctcgacatcttcaagttcgccatccgctacttcctcagcggcaaagcctggaacaacgccttcgacaacaaggtaaacacggagacacggattctaatcacccgggtggacgtccacccatttatcgcatgttaattataggaatgagtttggtcgattgcgcgcgagcagacggcgttcgcgaacgagctggactacgggaagagcaagagggaggcgcagtgggcgatcgcgcagaggtcgctgcacgggctgcagcaggcggagacgtcgacggcgctgttcgacgacaacaaggactacctggagctgtcggagatcgcggagcaggcgaagcgccgcgccgagatcgccaggctacgggagctgcacacgctcaagggccacgtcgagtcggtggtcaagctcaagggcctcgacatcgacaccatccagaaccactacaccgtctagctagcaccatcgatctcacacgcatgaataccatacatgatcgatgatgctgctcgttagcttgataagtgagacaggatattctttttttttctttttttttggcagcttaatttaacggggtcaggagactgtcttaatttggtcagatgaataatgggggtacgtagcttttgttgttttaatggttttactttggagaggttgtaggtttgttggtacgtttgattggtcgaagaccagaataaaatgagggctaatttagtactttgtttgtgcatatgttgaagaatccatcagccttttcctaatgtttcaaactaagttttagcatgtactaattgttcttaggtaacactctttttaattccttgaggggatattccatcttttattgcattttatcagaaaaaatgaaaaatatatatatatatatatatatatatatatatatatatatatatatatgtcacatagcaatccataaatatgcaagtttcatttgaacttctacaattacaatagaaaaaaatatatgactataaacacatgtatacaagttagagttaattctgttaattttttataacttaggaagatcgaattttaattcgcatgtttgcaaagtggtatatagcatatcaatctatatttttttactatttttctaaaaaataagtatttaaatgacaagaaaaaggagggaatagccctcgatgggttcaaatacatttttatcattgtttatagagatcgcttggcacgattcgactcgggcacgaccaaggcacggcttgagatcagtcatgccgtacccgcccacgggttgcacatacggcctaagcacgacccaataaaaactcaggtcacttcgggcggtcgtgtcgcccgaagaaacgaccagcccatcgtgctcatccttcgaataagtctattttacctcccataagtctattttgtgtccttcatctccttggaccgtgccgataggctacagcgtgcaggagcggggcatgtcggaccgtggttgtgcttattattgggctatgtcgtgccaagccagcatgtcgtgtcgaggaagaggccaaggcacgacccaacggtcgggttgggtcgggttggcacgggcccgacaacaatcaagccttgttgtgcctaggccaagccaaatcttcatgtcgtgggccaggccgtcgagctacgggccttctggccaactatatcgtccttatacagtttctctaaatcccgtggaactatcatttactattcaaggttatacaaagattctagccttggagtatagaaataccgaacttttcattttatatattaaaatatttaaagaacaatttctattttcaaagtatcacactcctaacattctctggaatggtggttttaaagagcaccctttcgaagagtgttttttatgacgtcatacgcggttagcgcatgctaatgactgtgtgaatgagggctaactattctgccctcctagagggatgtaagagggccaacggccccctagtcgctttcctggaggtcctaagggatcgtctgcaacaaaatggccagccccatgtacaacagttagcatatattaaggttgtgccacattttgaaaaaaaaaaccactccagaagggtgttagagttataatactttaaaaataaaaattattttaaaatattttaatgaataaaataaaaataaaaaaaatctacaaatagcatatattaagaggactgcggtgtacagctcatatggagtaaactgtgggctggggaatcaaaattagtgatgaacaaaaaatggtaattgttcggcccataagaacattttggtggcccagta

SEQ ID NO: 90205 - DNA, 3940 bp, Oryza sativa
gagtgggtcgtctgccgcgtcttcaagaagctccagtgccacctcgccaagccccgcccgccgcacgacgacgtcgacggagacggcgcctcgccgccggagatggtggacgcctcgtcgctcggcgagcttggcgagctcgacgtctcctccatcctcctcggcggcttcgcgccgccgtcgggcgagctctgccatggcggcggcggcggagacggtttcggcgcgcacaggcttcatgtcggcgcgtacatgagctggctgcaggcggcggcggcggccaaccagggcatgttccagtggccggcggccacgcaggcggggctggtcggaggcaccgtgttcgcggcggcgcacaaggcggcggggacgatgccgttcggcggcgggtgcagccagcagcaagcgcgggacgtgggcgtttctctggcgaacgtaggaggaggcgatgcgttgttcggcggggcgccgctggcgaaggtggacatggaatgcggcgagcaggcgccgcagctggacatggacgactccacatggagagccttctgaacatggccacgccaccatcaatttggataattattaagcaaaccatgcatacacgtattatatactcagttatatactagatgaagaattaatgtggtcgtcatccaagatatccacagtacagtacactacagtcagttattaattaattaatcaaaaatgaaagtgtagtgttgtcacctagaaaaaatgtgccgaaaatattttggtggagacggggccctcaagtttaatacaaagcagtaagtctattttgcatactcatcttttacccacgattgaatcgcatccttcaaccacaaaaccgggtataacgtctctcctaacttcgaaaaccgatgcaaatcgactcctttgatggttcgggaaacggcttttgctaacgtggcagaatgaccgcggtcaaaaccgtgagtcagcgcatgggcccacatgtcaatgaaatgtagcaatcatatgtggtagagcccacatgtcaattacatccttttatccttccctgtctctcccctttctctcccctgctgcggaagcggcactgatggagtcagcgaggagatctacagcgggcagcgacgaagacaacattgtggccgccggcgaattcacaatatcttggggacgacagcccatggctgattaagatgttgctatgattgcctgtcacctctgcaggttgcagcgagattgaggtggctggcgagggcggcggcgaggatgaggagggagaggagccacaacgaaagatgctgtagggaggtcaccatctccccattgccgggggtgggttcacctctaccaccagatcgaatctagatagggtaggagaggctacaggaacaggggtcctcccatgcccttggcctggctcccactccctcaccggctcgcccgctctgcctccctcgcacggagtcaaacatgcaacccccaccttctaacaccgccgcccatctctagagaggggaacgccaccagctgcccaccatcatccaagcgtttccttgggttcatcaccttgccaaccccatcgctcctatcccaccatggccgacgagttccttggggctcctcttcccgctgcccctgccctcagatcctccaccgttgcctgatgcatccagcaaacagggatgtgtctctggtcaccatgtttgtctcctcaccgcactccacaagggggacaggaggctccctgcagacggtgtcgagggtggcatggccagggcaccggggagctactccgccgcaaggcgatggatcggcagcaacaagatggagtgaacatcgactgttgcctacaaggggagagggggaggtgagggaaggagaaaagaatgtgtctgacatgtaggccctatgctgacttactggatttgaccacggtcaacccgtcacgtcagtgaaaactcctttccaaaatgctaaatgagtcgatttatactggtttttaaagttgggggagacgttatacccggttttacggtcgatggatgcaattcgatcgagggtaagataagagggaggaatgcaaatcgccacctcctcaaccgccttccacatgaggcaaaatgggctttcgcgcgcggctgcatcatgtatcatgggtggcctcgtggactgacagttgagatggcacgtaagtagattccattccttgtagcttgggcctggacctgggcccgttcctgggacggagaggcagcagagcacgcggcacgccccacaatcgacctcttaatccatcctcccctgtctcctcgcccatcgccctcgactcccgtctcctcacctgccgcctgcgcccgtctccatcctactagaagaggcggcggcggcgttctcctgcttccccccgcatcatcgctctcccgtactccatcccatccggcctcgaatcccgtctcctcgccctgccgcctgcgcccatctccgtcatgcgagctgaaggtggcgcccggcgtcctcctgcttcgtcgctcgccgcctcatcaggtattttctgttattcttcaagatacaacgttagatctgcctctgccctgctccaccaggggtgggcccagtagtaattcaagggtattcccaagatttttggacaaaaaaatatgtatatgtactctatactttgcatatgtattcaaacaaataaaaaagatgccttaaactaatcttgggccctattttaccattgggcccaaattttccactcccctccccctctcctctcacggcctgtttggcaagagaagggaagaggaatgggagtttcaaggagggagttgatggtgggattgatcatgggagttatatttttagtccccattctttgtttggtttcacatcgaattctctacaagtctcacgaattaacaggcctcccccaggtaagagattggtgggaattggacctcttaattttccatcccaaaccccatcgaattcctaagtcttccaaccaaactacaaacttaaactcccagatatcatagactcccattccccttcaccaactccctccaaccaaacaggccgtcagcccatactgagtttgggccacaactcagcccattcggctattcccctcccctaaccctaagactagaggcgggctggagcgtggaggcgggaggcgggcgcgtcggcgcgggcgtggctaggcggcagtaggcgacgcgtcggcggctcaggcgtgcgcccgcggcgtgtggtgccagtgcggctgcgagccggcgactgcggcgtgcgacgacgtctgcgagccgggccggcgactggggtgtgcggcgtgcatctgcgagccggcgtgaagcagggtcacgggcggcgcatggacgaccgttgaggcgtcgcccacagccggtcggcccctctcctcccgtcctctcccctcggcccttgcatgcctcctctcccctgtcctgtggccctatgctcccactggtcacgctgctgcggccgctccctcgcgccgtgctccgccgccgttgctaggccgtctcgccgatcatgcctgactcgattcaatcgattgccggaggtgaggtaacccttcaatcctcatcatttcccaattcgatgtaatttgttgcttgctcaactagtccaacaagacaagtatatactggatttgaacccaatttgttgtctaattttgtagactaaacaccaagggcctgttcactttggtgccattttcaaccttaccaaattttggtaaagttgtcaaaaaaagtggctacatttagtttgttgccaaattttggtaactatataataaatcctaccaaaattttgacaagttaccaaaattttggcatagttgccaaaattttggtgccaaaatttggtaaggttttttttggcatcaaagtgaacagcccacaaattt

SEQ ID NO: 90206 - DNA, 2046 bp, Oryza sativa
actcaagcaaagctgtagtttgtttattgtagtgcatggctacctaattttgtgcattaaccaatgaatttatgaaaatatgcttatagccattatatatattatataggttggaactgtacgaaactatacatacatatcatttattaggcttgatgttgtatttttttatcccttcctatttcgaataccccaacccaaaaatcctgggcccgccactctgctccacctacttccaagttgttgattttgatttttgcttttagcagatgtaatttggtgactgaatctcacgtcaataaattgtgaacaggcacattgcatccattcttgtgtactcatccaaacatccttagaatagttgcattagaatgaaaaaagtaagctctctcataattttgtatactcatccaaactcacataaatttcttagcaagagtcagaccacaaactactcatagtcacttaaattatctttttatcaaagaatattcttatttcacttcacaaaattttctagacatactttgtcacaaaattactttgtcatatttttataaattttaagtacaatctataaataaaaatttataaatataattttatatataattgataatataataaaatacaagttaaaattattaataagaaaaatattattaataacaatgatatttatgtatttataaatattttatcgaatatatttatatctattaatattaaaatatatttatctatttaaatacatgggtcatactattagtcgaacataaacatccttctcttcttgacaggtttttggattttggagtagcggtgtgaaaaaggattagatttctcattccctctcatttccttttccgactacacgaactagagattagatttctcccgccatacatatcctgtccctaacccaaatgcgtgatgtggccgccgcttgcagcgctgctccgtcgcctatcctctcacccgtttgactctcccgccatccacgctaaccttgtcaagtcctcctccatctccagccctatccctgccaccgccctcctcaccgcctacgccaatgcgggcctcccagccgcggcgtcccgtctgttcgacgaaatgcccacccgggatgccgtcgcctggaacgcgctcctcgcctgcctggtcttccatgctcggccctgcgccgccgtggccgccttccgtgacatggccaccgcggggttcacacccacggctacaaccctctgcaccatggccaaggcgtgtgccacgtctcgcgcccttcgtcctggccgtcaggtccacgcgcgcagcatcctcgcgtgtcaaggcgatgtcatcatggcaacaacgcttgtagatctctacatgagctgtggccttgttgaggaagcgctgaggctgtttatgtgcacggattgcccgaaggatgttgctctatacaatgctgttatttcaggttgtgtggagaatggcagattcagggaggcttctttattctggggaggattgagcttaatggaattacgctgacatgtgctctcactgcctgctcagcaacagcgaatttgatgtatggtatgcaggtgcattgcaaggctctccgtggtgggtttactttagagacgatcttatgcaatgcacttattgatatgtacgcaaaatgtgggcggacaacggctgctcgtatggtgtttgatcgaatggcttgcaggaatgtggtttcctggtccagtatgattgatgcttatagtcaccatgggcatggggaagcagcattagatttgtttaaaaggatggatgaaactgtaccagtggtcttgccaaacgccattacatttcttgctgttctttctgcttgtggacaatctggtcttgtggatgaaggcagagctatgtttcatttgatgaaaagacaatatgggattaatccgggaccagagcactatgcatgttttattgatttactaggccgtgcaggccagattgatgaggcatgggatctctattgtagtttcagtacaacccgaagtgagctttctggtt

SEQ ID NO: 90207 - DNA, 569 bp, Oryza sativa
  unsure (1)..(569): unsure at all n locations
tcctgcagcccagacggctcccagctgcggacagacgacggcggacgagagaggcgacggtgggctcgcaaaacaggaatagagaaacggcgaagaagaaatgtctgacatgttggggacggtggtgggtggggggggggggggacggncccgtatgcacagagattatattttccagtgatcacacacgaagtcacgaactaaactggctaatgaaaaccatgcacggcaaattccaaaataatcaacctataattacgtaatcatgtgtacgtaagatcaaattgtttaatacgaacaaaataattatgatgtgtatcagatgatttcgggagcaaggaagacggagctgttcatggggcagccgtaccgtaccatgccggcgaccagccgaaaccgaggctgggcaccgttgagcactcgagcatgtgccgcacggccccgtccaccaatggaccggcgatcagaggcagccgaacgacgaggacatgggcgcgcaccttactcggcggcacgcgacccggttttctttcgcgcaccacggcaacatcgaacgcctgtggtattaa

SEQ ID NO: 90208 - DNA, 846 bp, Oryza sativa
agaacagctcccactacggcaaatggccagagaagaatagcaagacctgcgaacggcacacaagctgtctccagaaaaggtccctctctcccaatcatatcctgaatcagtcgtttccatcctttgaaaagcatcacagggcatttgtagatggcaatcagcgtgaacattataccatccagtatgagtccacatgcagcagataataaagcaccaggaatatcgagcaatctgtaagacaaatgttcctcattttatatatcataattcctcacacaacaaaaatattattcataaaaatgccacctacatgtatagcatcatgtttccctgaaaatggcatagcatttggggatactttcaccttaaaagcttagaggaatgtctgaaatgcttttttggctttgggaatgttatcttaagtcaagtagaaagagtgttacttgcatattaagcttaggtccataagataaggaggaaagaggaggaggaaagatgatccagaaaggttggcgattatgagttgtgatggtaaaatactaaacaagaaccggaagcataccttatctcatatggcttgttatcaggaggtgcctgaagacgaagatcgtccataatagaaaaataggagtggaaaagcaggtctttcacgtccctgactatcgtacagctcccagtgatagtactccacgttccatcctgcaatttgagataattagcacatgaaaaataaaagtttgtaaaaatgaacatggagaaagaaaaattctaccacaaaacaatgaacaaacggcttttcttttccttttccaaccgcaccaaatgttgccattatcggtgctagaa

SEQ ID NO: 90209 - DNA, 3127 bp, Oryza sativa
ttgcatgtgctaagcacatcagtgaagtctgagttacgtagcctcacacaggttaagattagttgcttgaggcaaccaaatgcacgggggcaagcataagagaatgacatgaaacgttttccacatatgatcttgtcatcttccatccgttgtattccatgtttttctggcaaaatcataaacttcgtactgacgatttctctatttgccatggcatcattgatggagtgggcgatgctgatagattcctccctcaaatagaatcccacgctcaaaaaattaattttgcactgacttttatgtgctagaatactttgggttgcttcgatgacagagatgttgcttcttattctcaaatcgtctttggctagcatggaaccatccttaggcttaaatgatccaacatggagaatgatcttagacaggacgccagggagatgcctccaccgtcttgagaggacactagtcctcacagcatcacgtgttttgagtctatccaatatatgaatcaaaatgtcgtcgggaagtgcactgagcctgtcttcttgattagctttgtcaccctgcattagtattatacataataagtatttctgcacttttgtaggcactcataagtgacattaatatctcataaggaataaacattccttcttttctcgaggaatatgtaaaccaaaccttaatactcataaataataaaaaaaggtaaaaaaaacacacacataaataggaacacatggaagacgaggaaatgctgctcttagtgtagttacctctgccacgctggtgccgtttgatgccatgaggaggaaaaacaagaattcagtacaacggatggtgtggaaattgtaccactagtgctgccgcgcctcgtatctgttcgtccggcggcagcgggcgctcatggtatttatcggcgcagccggcgtgcgcgtactgctcggttttggccgaggagtccgattcggtttttacacggtgtactacgtaggtacgggaaatggaattcgatccggactggacgcgtggcggatgcgttgcatagtcggccacgggcacgcacgggaaggcgggaagcggcccagctctccgatgccaacccagccggccagcccacgcccgacgacatcctgcgcactcgtctgttccgttccggattcccatctttccaacccatctctatcatttttcgcgtgcgcatttttcaaactactaaacgagtttttttaaaaaaatttctatataaaaattaatttaaaaataatattaattatttttttaaaaaaaatagctaagacttaattaatcacgtgggatagtttttcatcctgcactgccgaacaaaagataacctatggccctcgcgcgcgtaaattttcagttgattatctgggccgcacctgagagcagtagtgtcgtgcaggctttacgcttcagcccatgtagcggcctacgcgtaacgcgtgcatgcatcgctgttcgattcgttgaagttgactcaacatacaccttcgattggctggtcgagctctcgctcttcttccaggattttaattgggaaacatgtactgcaaactctatgcatatctttttttttaattacacactacaacacagacactcacaacacacgcgcacttacccctatgagcatcttcgaagaccgggccggtaaatcctggagagattgacgaagtcaccacaggtatctcgcctgacgaagtcaccactaggggtgaaaatagagcggatattatccgctccgaatccgtccgatgtgaggatatggtaaaagtttttagatattcggccggatgtggatgcggatgcggattttatcatgtaaatgtggtatcaacgatatccgacggatacggattatccgatattttgatcggattatccgatgcactatttggcggataatccgcaactttcagtctttcaacccatatattgtaacccatttagcccatctattgtgacctaatccactcctcccgaaatctctctctctctctgccgaatgccgtgcgccatctatctctctctcgagtcgcctcttcgcctcttttcccacacgcgccaccgcaacgccactgcaggctggtggcaccgccgccgatcctccattcctcctagcgcgccggccgctcctcctcagctccagccggcgccgccgctggtcgtcgtcggctcctcggcgtcgccgccagtgccagtacagtcgcccgcgccatccgcgccatcccaattgtcggcccgtcggcccgtcgccggcgccaggccgccagcgcccaggcggcaccgtcgcctgcgcaatccccatcgccagctgttgttcccctgttccagtccgacgaggtgatggccaacgacgaggctgtgtgcctgtgtgcacacgtgcagtcctcactgctgtctgtcgtatgctgtatgcctgttgtgtgctgtactactactgcagtactgctgtatgctgcgtgctctactgctctatgtgctctatgttgtatgcctgtatgccttgcctcacgctgatgagtgatgacttttatttttccattttaagcaactcagtgacaagtgagctattgaactgaacacttatattattttttttatggatcatggatgtaccttgaattatattgagaccgggctaattgtattgctgcccccttgttgtatggattgaatacaaacttgacatccgacaattttttgtccgttaccgaaccgactccgcaccgaatccgacgtccgaaataatccgctccgcattcgcatccgcacgtcatccgcacccgctccgcatccgcttaaaaaaaatggtttaggatagatatggtatagctattatccgtttgaatccgctccgttttcacccctagtcaccacaggtacctcgcctaccgggccggcaaatactggagagattgacgaagtcaccacaggcacctcgcctaccactgaaagcacagcgccgttaaattctgaaaaattcgctcccatggcctaccactgaaagcacagcgccgttaaatcctgaaaaatttgctcccccatggagagtcgaacccaggacctcaggtgctactgaggctcttaaattactaggcta

SEQ ID NO: 90210 - DNA, 3288 bp, Oryza sativa
tccactcccaattttgttggagctcaaactgtttggctccaattttggtggagctgaaactgtttggctgagctccagctccaggaggggtggagttggagctgaagctgtgccaaataggcccttagtgaggtgcaaagtgtgtgacggaaatataaacccaagtagatatatactccctccgtctcataatataagggattttgattttttgtttgcactgtttgaccgctcgtcttattcaaaaaattttggaattattatttattttttttggtacttactttagtatccagagtactttaagcacaatttttcgggttttatatttgcacaattttttttaataagacgagtggtcaaacagtacaatcaaaaactcaaaatcccttatattataggacggagggagtatatgacacggcattcacacaacaaaaaaaaataaaataacattacactacaaaactatgaacatcacgcacttcgcaaaatggaggttccctgttttctggtctcgatggaaaatccctgctgaatgcaggtatacttcagagttcagacctcggtgtagctacagcaatcaacccaaaagaaaaacataaattgttatggctcagaaaaaggtactacttcagaaattgtaaaagtgactaggaagaaaatgtaaaataaatctcataatagcaaggggcaagaatttaaaaacagattgactagggagcttttggcctagtaggaagtcttcacttcgcgtttagatgcttgccttaaagagtttgccataagaagttcaaatgccaacttcatgcaaatctccttgcattaatagtagagcattgaattgattacagaatattatttcagtatttgtaagcaaaaacaccacagagaagcagagtaccaaagcttctatcaggcacattgaggctttttttttcgaggggacaggttgggagtttctgcaattcactatagaagaagagagttgattcagtttataagtaaaaacggacaaaaaccttataacagcacggttaattaatggaaaaccggtgagaaccatgacattgacatacttaacctaagaacaacagcccactaagggaaaaaaaactcctaaacgaagtcttcaagaacgttgcgtcgacagaatagcgacatcgtccgatcctaacaaatctaggttttcacctggagaatttccttgcagtggagttgaacgaggggtccaatagcaatgcctcaagaaggtgaacggcgccgagggcgtccccgttgctagcaccggaagtggagcaaggctttcgcctcggagtccccatcaaccatagcatccacagcaaaagccaccagatgtcacctacatatcgaagatcacaacaaccggactccatgccacccctgacctgactaatgacgcgtcggatctgaacctagagccagatctagccgtcctcctcaccaccaccgcctgctgacgccacagcgccaccaccagcgtgggagcaccacaaacgccagcgccagacgtggggcaggccgcttgcagcaccgtccaacgccgcgccgccggcggatccgcggactccaccaccgccgtcgccatccccgccgccatcggccgcatccctgctcggcgttgctcaccccgaccgtcgccatccccgctgccatcgccatccccgtcgccagccgccgccccgcaagattcgatcggagcggtacggatctggtggtcattgccgtcgccgccctgggcgggtcccctgtccgcctgagcgctagaagcaagaagccccgctgccgcaaggagagggggcggccgggtcgtcgcctcgcgagtggcctttgggggagagcaacacgataggtttttcccaggcacattgaagctgaccgcagttttgttcactattcgccattgttttgactaaggccagcttctgtgaagcagtacattgcccaaggaggtggccgcggcaatgagcttgtggcacagggtcgacatgatgggaggaacatttcgagtagacttccagcggtatatggaggaacgggtgagacgtagggtttcagaaccatagtcattgcacaatatgagttatcaacgcgatacgttatgcgagatggctacacaaatcagtctactttataaatatttatactaaaatgcattttttttaacgacatttatccaaattttatttggtttcatcaataaccataataactattacacagcttgcgatttacacaacttgcgactatgagcatatggtactaaacttgcaacaaatacaaactgtttaggactagttaatcgatagtcttcactgttccagcttcagatgtgtgaaaaaactgaatcctttcgataggcgatgttcttccctcgttgattgctttctttaccaaatctctctctttcttggtccgtggatatcgtgtaactggataataggacttgcacacctcacacctatcatcgtgcaataatatgtcttccaaattcactgccctttttatgacttgtttatgtactccatgcatttttttccaggttgaaagccataaaatatgagcatggtcaaactgtagtgcttgaaatcagacggttcccagtatatgttgtttttctcacataaagttctctttagcagttctccctcaattggtttacattgatggtccgtcacctacataaagatcagatttagattttagtgttcaataacacaaaagttcagagaagcatcaacagtgaatatatactccatctcgttataaatatttgatgtttatgacaagccaaaatattggctataaatagatttaagctaaatgtacacaagccattttttctttttaaataaagtatttgagaagttattagtggtaaaaatttcgggagttgaataaaatctcatcctaaactttaaatatttatgactatagggtgtattaaataactgtcgggtaaacgagaatgaagaatgaatgtagtaccttaatactgagcatcttcaaaagaggtgccgcttccaaaagaaacagtgtccaagtgatgccgctgtttggatgaatacggtgcacaccaacaaacgtcaaattatttaaaagaggagccaatcgtgttggggtctcaggtagaatccatatctgcataagataaaagaaaacaagactagcaataaatacaaattctcgtgtgaaggtttgctaccaatattagcggtgcttcgattgacttaccttttctctttcaaagttcaaccacagttcacg

SEQ ID NO: 90211 - DNA, 644 bp, Oryza sativa
tcgtctggcttttgatgcactgttcagtagagaaaggcttccccaaagcttttctcctccgcaagtagaaggatcaaaggagattagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggtaataagtggaattttggttcatttttctgggtcatattt

SEQ ID NO: 90212 - DNA, 691 bp, Oryza sativa
cctgcagcccagtaaaattgtcatgttgtgtcccctttgagacaaaacggtatttctgacttggtacatattaactgactcttacacgccctcttcagctggctgtgctcgaggctgaacagaaagctgaggaagaggctagtgcttccactagttccaagaaagacacgaggaaaagcaagcagaagagtggcatgagatagctttggttcgaaatatcgaaatagagagtggtttaggccaatgctttaagccatctgggattttttcctttctgagccattggtcagctcgatcgattaatccacacgaggtgcctataactacctgtgtaggttggcttaatccatggttaaaattttccaacgtactgtatttgcgattcctcggaagcattcatggagagattgtacacagttctattcatcggaaattcgttactacgtacaagttttgagttctctactgttcagtgttcacagcctgcgatgtaacacggtacaccctaacagtatctgggtgcggtgtaaattcactccatccgtttcaggttaccagacgtttatagacaaactattttaagtttgactaaatttatagataaatatagtaatatttataatactaaattagtgtcatcaaatcaataatcgaatatattttcataataaatttgtcttgggtgaaaaat

SEQ ID NO: 90213 - DNA, 1910 bp, Oryza sativa
tagcaccatatgaatgaaaagaactatgtagacgagacaaacacaagtagtactgcagtagtaatagcaaaagtagtactgctttacaagtttgtaagccaaaagaaacagtcacataaggactgaagaggtagaacactactgacgaggcctcttacccctgtccctcctaccctgcgccctaacgtgcccctgggagtacgtgagtcggtccgggggtatggcacggccaacccgtcctgcctgtacaggtgtgacctctggctgctcctgagtgtgcgcctctggagctcctccaagctgagaggagcctagtacgtcgtggtggtgtgcaccatgcaagtcgtcgtcgtagaactagctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtggacgagggatcgacgctccgtgagaggaagagctggcgaacgcgctcgaagaggtggcgaacgcgccggaagtgctggcgaatgcccctgcggagctcgcggaagcgccggtcgtggctgtgaacgcgctcgaaggcagacgagttcctgcgatgaggaaacgtgcagttaaaacatggtgacatattcgtgcaaaagctgaaacaaaaatgaactaacctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtcgaaacaggtgccgtaggtcgaggtcctgctccgacggtaggcacgcgaggccgtggttataccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatattggcactgatatcccgtgcggcatcggcctatgcaagatggaaataaaaaattcagtaattgtcctatattatgcaagataaatgaaataattgtaaaaactaatacaaattcgacgtacccccacgaagtagtctcggtcacggtgcgtgggatacgcgtccgtgacagcagcaacgtgcggctctggggcgtctggagtgaaggtcacacgcgcatgagtgcgaggaaggtaccagcgaaggtagtcacggtagttctcctccgtgtgtaggaagagctcgttgatcacctcctctgtagctaacacctagtcatcaacgtactgctgtacacgtggagcccaaagtgcgcctgctagctgtccccgtcgagtcaacctgtgaagagaggtaaattatatggctcgatgaagtaattaccataaaaattttgaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcaaacacgaagtccgggtaacctcgtctcacctggacgtgagcgtaacgacgctgcaataaacatgatcggaattagacatgttatgtgatgataaa

SEQ ID NO: 90214 - DNA, 2093 bp, Oryza sativa
caatttggctatcgtttggtgcgcgcgcgcgtgcgtgcagtgcagtcgtcgattcttgaccgggacgcggtgcggcgcgtggtggcgctgctcgtcgaggcggacgaggcggtggatgcggcgtctccggcggccaccagcgcgcgctcggcgctgcgggtggtggattcgttcgtcgtgccaaggttccactacgatccgatcaagaaagtcttctacgagtacgtagatgccgcttcttcctttccttgtacatcctcttgagaatttcgctatttccttttcccgctttggtgttgaactgtggttagaattgctacattgacgaaattgagttctaagtctggctaaatcttcaatgattcaacaaagaatttatgtagggcatagattccaaaatgatgctactgattttcttttaaaataattaaacctcatttctgtgtgaagagaaaacttgttagatgtatagtattttttttttgtttggattcagtatattgtgcttcactagatgagattgttagcttcttaatgagtattgaactattgatttggttttggaaaaaaaatcaaatgacttgattttatgtgacaattaaagatttgccactccaatgagatgcagttgagactactgtatgtatggctaggttaacatgtcgcctgctccatcctcatgccaataagacatttagcggcaatatttgcagtggcaactcttgttagatatggaagtaacttctggcctactgcaccatggatgcacacatctactccctccgtcccaaaatatagcaacttttggctatgaatctggacacacagttgttcagattcaaaacgcttatattttgggactgagggagtatttaattatgagcatcattgattacacatagattctcttgatgctaggactaatgagcttaaagactgtcctattatttctaaccaagactgaattataagttataatgagttaacagccctgaaatatgctattatataggcataccagcagattagccatacatggagaagctggagataaagcagccctgtacagggacaggtatcaggttctgcttcagaggctagctcgtgatatatacttctctaagccagcttttgacactgttatgaccgaagatgataattgtgaggtatttttttttgtttcatgtcatgattttcacaaaatattcttagttcttgtatgtgaaattacttacacacttttttacatgtagataacttctattcagtccctaattgggtgcactggtcggagatggattatgggggtcatatcacagttggaggaacgtcaattctacttggaggatcttactggagctgtgccaattgacttatcgaatgctatatcctgagagcccattatttgtcatattgtagtatgatttatctaaaaattgaatagtttctttagctacctatgaaatatatataacaacaaaaggtctgctcaaatttgagtgataacatatcattaattcaggattcatgtttgacactaaaatttaatttgatccatatcaatctcttgcttactcagaaaagtgttatgctttccttagcacaaaacacaaaatcacttcaggtttcttcgttgaaaatactgtaattgtagcagaaggggaattgctttcaaatggcattttccaggtctgtaattcttatcaacaagaatgtgttcagctcttgtattgttgtgttcaatctgattttattcctatcatctgcaggtaaatacatgtggattccctcctttagaggatagagaagcatcactttcgatgcttatggggctagatttcttcggtggaggtgtcataccaactgaagaaacagtaagttcaaatatttctgttccgcatgtaatctgacttttcaaaataacctttactgattaattttatcaatggaaatatcaaacaggtaaggctatcaaccttagagaagaaggccatgaatgatatgtttgttatactttcagatgtttggcttgacaattatgaggtatcttcatttgtactaggccctatttcaaataaccattattattgggg

SEQ ID NO: 90215 - DNA, 1614 bp, Oryza sativa
cagttttagcttacaagcagtttgtcgcccagctgtttgcggtagacctgaatgagacccgcgctgtcaatcgtctgcagcttctccttcagtatcttcctgtagcgatcgtctttgtcgtccaagcttctcatcagttcgatctgataagacggaatgtgtcaaggatatgtataagaatttgcgggaaatgaagagcatttcaacagttatcattgtgaatatatagagcttgtgattacctgtctctggaatgcttcgaattcatcggagctcaaggagccatcgctgtttgcgtcgagaagatgcatgagctccttagcatctttgcccccagcaccaaggtcttccatcacctctgtgagctcctcaatactgatccttccatcaccgtttttatcaagctggcagaaagcacggttcgtgcagttgctgtctccttgatcactagctgggaggtcacgaagacgcatagctgctaactctgctgcagccaacatgatagccttcagccttttagcctgtagaaaagaatttcaatgaatgatcattccaagtcatctagaaataatttgtctataactttagtcttttataagtcatagggcaatagattttatttcactgagttcatccaataattttttgccgggtcggccaaaagattcggtcgaccaattggctagagcgtatggctgttaaccataaggtcggaggttcgagctctccttctagcgaagtttttcaaaagttcatccaataattacaatatgtcattcacaattaatgacatattgtagatatggacgaaatccagtggcggcgtggatttatccaaaagtgatatacaacacaattccagttaaaagggtcaggatcaaataatcaatcatgtatcaactaataacataaaccaggccatctatgttgtaagctctgaagtaattagtaataggctactgactatttttaagtaaaaaggctctgtacagagtacagactatatgtcctgtatgttagtcagttagttcaaacatattatgcactaattatactgtgaagacatttgttgatatttttcaacttatttgagtaaaaacacttatcttactaatataaggggagctacctgcagtaatttgctaaagcaaagaatatgtgctctgttgtattgcaaaaggacagagtgatgacaatgaggaaactcacctctccaggatctgtaagtccacctttgtagagagagtgagatgcctctccaccaacagcaaatttatgcatctccttggttcgtatctgtatctccatcagtggcctcatcttcccaggttcacttacatcgatggccacatgcaagctctggtaaccattttcttttggccgtgtgacataattttttgtccttcctggaacttctttccacatagcttgaatgatttcatgtgtcctgtgacaagccctagggccccagtctaacgagctgccatcacaccgaggttctaagattacccttaaagctagtatgtcatttacttcttctggttttctgccatcttttactagctttttcatagtactgaaacggcttttataccgcccttgaattgagatgtc

SEQ ID NO: 90216 - DNA, 717 bp, Oryza sativa
gctagctactagttaatcattgcttaatcgatcatgtcgcgtggcagggaggcggcggcgtggtgttgccggcggcggaggcgatcgggcgttcgtcgtcgtcgtcggactactcgctggggaagctagtggacaacttcggggtggcgctggaggagacgttcccggcgcagccgcagcagccggcgacgacgatggcgatgacggccgtcgtcgacactacggcggtggcggcggcggcaggtggcttctgccggccgctcaagacgctggacctcttccccggcggcctcaaggaagagcagcatgacgtcgtctagccctaattagctactactactactgctcttaattactttattaattaacatgcatgatggatggatgggtcgatccattattatatattaattaaccatttctctgtctccacaaatttctgcttaattcagaattcagagttactcctagctagctataacttcttttttttccctttttttgagaaagacttcttgtttgctagtgttaatgcatgcttaatttctttctctctcgatctctaaatttactttttttttctctatagttaattatagctagcgttagattgtacgtgtactaggtgatacgaacgtgagcacgtacgtcaagctagcatgcagaggatcaaatcgaggtcggttgtgcacttgcattgactaattaagtagtact

SEQ ID NO: 90217 - DNA, 682 bp, Oryza sativa
aacagaactgtatgcctcgtccacaaccactagcttctcctcctcctcgggatgtttctttatcatcgcttcagcaagcaaggcagacaattcatctatcttcttcatggcatcagcttctcgcaacctgaactcgtcgttctcctgggttaggctctgcagtgcgttctctttatctagtaatcgctccttcagttgtgaattttcatatgttgcctcctgcacagacttgttggcttcagcaacagcagcttctgtgtaaatcagtttctcttcaagactctctttctcagtctttgcctcatgcagagccttgctagcctcagcacacgctgattcagtgtacaccagcctctcttgaagcttttctttctcctcgttggcaacttggagttggtgctcggcatcttgcagtgattccactgccttgtcgacttctaattgaagagcactaatttcttcctccgactgcttgtttaacctgacaatgtcagtctccttagactcacattcttctctgtacttgttcacctcagcctccaatttatcaacatttttccttaagcaagtgatgtcatagtttgcctcatcaagcattacctcataactctccttggtgctttttagggccatcttaagatcaccaatctgcgcgagggcatgctcgtggtcatcttctttg

SEQ ID NO: 90218 - DNA, 701 bp, Oryza sativa
ggctgtgcgcgcaaggtacaggccggccgccagatgcacgcctcatccacgcgtcgcacatctgactcgggtacgcacggattgaggtttgcatccggtatgcaccaaatttttttccgatggttacgccggcggctggccgcactcgccggctggggctgacccgccccgccggtgtgggaaggcggctcgccggagtagaggagcggatgtcttctcttcgcatcgccatcgccatcgcttgatgtactctctcctcctcgtccgcgaggagcggcggcagcggcggaaggaggtggtggagtcggggacagggagggcggggacggccgcggcggtgaggaggaggagcggcgacggcggggcagctcagcgaggaggaggagcggcggcggcggctcggtgaggaggagcgacgcgcgatgggaacggacgggagaaaaaaaagaacgaagcgaaatgtttttttctaatggcaaaggtgggtaatttttttttccaaaagcaggtgaaagcgtagggtagagattattttgatttatactacaccaaaaactggcttggagcaaaagcagctgtggcttttgggtcctttggttggcttttggcttttgcaaaagcaaaagcaggttgaaaagcctaacgaaacacactctaaaatcatgtttatgaaagaaatgaaatgacagtgtttaatacta

SEQ ID NO: 90219 - DNA, 1438 bp, Oryza sativa
ttcctgcagcccccctggaagttcgtggtgaactgctagcacaaatcctcccaagagtggaccgacgcgggtggcaagttcattagccaaccccacgcctgacccttcagggccatggggaagaaattcgccatgaccctgtcgtcatccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggccggcccccgtgcccggaccgaagtggtgctccgaacgaggaagcgccctccgttgcgtgggcggcgcgacgagtgtcgcgccggcgctcgatgtcgaggcaggcatccggccccccacgcacatctccttgggtcggaggcgttgacgagggaatggcggacgaacggcgggtaacggccgccgcttgccgcgccctccgcctcgacgacatggagccggcggcggcagcgccagaggtctcggtggcggaggaccgcccgccggcgcctaggcgctgctgcgccgtcatgaccaagtcggccacatcatccagccaacgtcgggctggagtctctggatcggggacgacgggcgggtgacgcaggagcgcgcccgcagcctggagcgcgccctggggcgtgccgccatcgccgtagacgaggcggcgacgcgccccgtctcgccgtcctcccccgtcgcccgcgggcggcgaagtcgcggatcctccggcctccccgagcgcctccccccgcccaagatttcggcgagagggggacggtagggtgcgagcccgacggcgcgggttctgctccccgtcgtcaccgctagcgttcggagagagcctgtgcgccactgcccgctcggccattgggctgagcgggagaagcttggcgcacacgaaagaggacgagggcttcaaaagacacgcgcgccccctacctggcgcgccagatgacggagcgtggggctcctcaccgggagaccgcgcaggccctcctttgccggttcggccgggggcgctaagtgaggttcttcgccctcgatctgaggaacgtcagcgagaaaagaaatgcgcaagacacgggcgacgtagacaggttcgggccgctgagaagcgtaacaccctactcctgtgttctggtggatctgtgtgtgaaggaatccagagggcggagagcgagagagagttcaggctctaggaaccattcgccagagtcccaactccccctcctttcttttcccccctcttcttttcttaggcctgggcctcctttttatctggtcaggggtcaccacatgggcctctagctgcctaagaagggaaacatgctttttacaatcagggctgggctgcaggaa

SEQ ID NO: 90220 - DNA, 508 bp, Oryza sativa
caaggcggtacagcacccgagcggcggcgtggtgtcgcaaattcaggtgcatgagggcgaccgggtcagcgcagggcaggtgctgctgctgatggataccgtcgacagccgcacccagcgcgatgcgctgcgcagccagcagttgagcaacgccgcgcagcgggcgcggctgcaggccgagcgcgacggcctgcaggcgatcgctttcccggcattgctgcaggcgcggcgggaggagccggaggtgatgtcgttgatgctgttgcaacagcagctgttcaccagccgccgcgcggcgttgcagagcgagctggcggcgatcgcggagagcatcgccggatcgcaggcgatgctggaagggatccggcagtcttacgccagcaagcagcggcaaaaggccatgttgcaggagcaactgagcggcatgcgcaagctggcggcgcagggatatgtggcgtgcaaccggctgctggatctggaagggcagtatgcgcagatcgacggccag

SEQ ID NO: 90221 - DNA, 729 bp, Oryza sativa
cctcatctcatcttcttacatctcccactgtctctctctttcatgtcttcctcctatctcatcttccagtggcttgtcaatagggatgaaaacggagcggatagtttccgtccgctctggacaaaaacggatacggatacctttcggatcggataattctcggatatttcggatacggatacgaatatggatattttctcccggatacgaatacgaatatggtatcaaggtttccgtcggatacggataataattcggatatccggtgaacagtgctattcggatatccgcaggacccatgagacataccccatttctttctaactctataaccttcaatatacctttatagattttaatagtagtttatctcttaatactagtccatactattaatattatttaaattttaaaaaatatttataaattatacctcattttatataaaataagctaattatatatgttgatatttatttctattagaagttgagttggttttcgtgttccgagaaaaatttgtttccgtattcgtgtccgatcatattcgattcttattcgtatttgagataatccgtatttgtttccatattcgttttcgtatccggtaaaaaatataaaaacgaatatggtatgagcattatccgtccgtatccgctccgttttcatccctacttgtcagcgagcaagttccttcccacccgcgtcgcggtcagcgacccccccccc

SEQ ID NO: 90222 - DNA, 1752 bp, Oryza sativa
attggagctttccgtgaatcgccattaatggcggtgacattgacagatctgggccgaacgagtcccccatcagcagggggcggccgagcacgccgtcgtccaaccaccggccatccacgccgtcctccatccaccgcccctccactcccggcgccaccaggaggagcatcggcggcacgccgtccacgccgcgctcccgcaacaacggcgtcggcggcggcggcggcggcccgttcaagtccgagcccaactcgccgccgtcggccaccgcccgcccccgcctctccttcgaccgctcgccgagatccgtcgactccaagcccgtcgtcgagcgccgggttcccaagatcggcactccacctgatgtaagtgcattcatatatgcaagcattgttgtgtgagttgttgatgctaattgtgtgaattttttgttgtgtgagttgttgatgctaattgagtgaaatttttgttgtgtgagttgttgatggtgattgtgtgaaatttttgttgtgtgagttgttgatggtgattgtgtgaaatttggtggaatgcagaagcagccgaggaaggaggcggagctgcaggcgcggctcgagtccgcgcaggaggatctcaagaaggccaaggatcagctggccttcgccgttggcgagagggatcgccttgtcggggagctgaatgaggcgaagagggttgctgatgagacgcatgagaagctccaggatgcgctcatggcgaagaggtgggccgaggaggcaacggagatcgagaagttccgggcggatgagctcgagcaggcgggcatcgatgaggcgcagaagcgggaggaggagtggcagagggagatcgagtgcgtgcgtggccagcacgccgccgatttggagacgttggtcactacgacggaggagctggagagattcaggcgtgagcttgcgatggcgaatgaggccaagaaagctgcacttggccacgcagacgatgccatgaagatcgctgaggtcaatgcggagaaggtggagatcctctccagtgaagttgtccgcttgaaaggactgcttgattcgactgcagagagcgaggagagtaaaaaccgtgaaaccgaggagcttgttaagaatctggagtccgaggtttcagttctgaagggcaaactagaggaagccagaattattgaggagaggttagccgagacggaaaaactgattgaggagcttaaatcagaggttgctgatgcgaagaaggccgaatcagaagcccgtcagctattcgaagaatggaagcacaaggcaggattgcttgaaatggaattggaggcagttactctctcagataagttcaaaggtgaatcgcttgcctccacaacagaagaattgggtaagatccagtctgcattacaagatagagaatctgaaattgaagtgctcaaaggaaagacaactgccttggaaattgaggtagcaaggcttttagcagatgtcaacgaatccaacgagcaatttgatgcatctcagcaagaggtgtttgggctacagacgactatagatgttctgagaaacaagcttgaggctgctgaagaagcagcttcagaggccttaaacaatgagaaggccgcgaatgtaaagattgaaggcctgaccgaggagaatgtgaagctaataagcgagttgaacgagactagggatagagaagagaaggagaaaagagcagtggaagatcttactgctgcattgagtgaggaatctgacaaagcaa

SEQ ID NO: 90223 - DNA, 4636 bp, Oryza sativa
tgttagattaccagtaattaattgcttccacgatgcttattatggaaggattagtggaaacaaagatgcaaacgtatatacggtcctatcaagaacgtcgtttggttgagtagaacaaaagcaaccagcaaaatgtccctatcgttggtgcctgcctgaatgcaactcccaaccaatattcaccaaactcaacgggtaatgatgttgagacaggaaatactcaccaaactgaaattttacgttgtgcatgtttgaagcgtttttttcatggataattgagacggatttttttacttgattagcatggtaaattgatatttttcagaaataaactttacaaatacttcagaataattggctaaacaatgcagtagaagaattttcttttctaagaaattgtatctttagaagcatgggcaaataatccatgaaaaaattagagagaaaaaaaaagctgagcagaacaagacctagtatatcggagtaatagaaactaagtacacaggaaaaaaaaacaatatttgattatcttaaaaattgagaaaaattaaaacatggtgttaatttcaatcttgcggcaagtggtgacttggggtatttttgatatgacagaaccagaagaagatacaagcaagcaaccttgcatgtccatctatcaaagtcttttgaataaatgggttacttatctatctctatctatctccgtactgttctttcttgcgtccagactcttgacgacgtgtgacaccatggtcttcttgttagacttgtgcaagaaacaaatttttagagatgcagacaaagatggaacccggcaatttttccaaagtctgcacctggggccttaatttctctgtctatatactacctagctacctggccttgctctgtctaaaaacctagccatcaaccaatcttttatgacatacctctctctcctctcgcgtcgtcctccccgggcgactcggaaggcgacgacgccgccgcctcttcgtcttcagcgcctcctcccccgcctcgccgccgcctgggcgggcactggcaaagccgtgcgcccgcaaggacggagcggcggggcctctctccccttgcacccggcggctggggacgccgctcgtcggcgtcggtggtgcccagatccgccatggctggccggatctgggggagcggcagtcggcggcggggaatgaaggtggcggcggtggacgacgtggagcgggaggtggcggctggggacgccgctcgacggtggcgatgcccagatccgtgcggtgctagctggatctgggggagcggcagccggcggcggggaaggaaggtggcggcggtggacgacgcggcggcgctggagttggcggtggcggctggtggcgactgtggctggctggcgttcgcgtcggtgactgcggttgtcgacggtggcggctgactgctggcgaggaggcggctggtggcgaggcggtggctgctatggtgactgctgaagcggtgacggtggcggcggctactgatgcaccggctggcgacgaggcggcgactggcgagctgtggcggcggccggatggctactgtggtggcagctggcgaggcagtgccgcggcagtggcggccgtgtctggcagcggcgactgccgacggtggcggatgcggcggcggggaaggcgcggagaagtaggcatggcggcggggaaagatgcggcgacgggggtacgaacgcggtgtcgacgaccggaaacgggcgttgatgaccgcgaaagggcggcggtggcggtggaaggaggcatggcggcctcagacggctagtcgagggtgtggcagacggctgcatttggccggcgcggcaatggttggaggagggtcggagaccggcttggcgcagagaggcgcagccgatggtagcggaggccggctcggcgcgagaggcgcgggcggcggagatggaggccagcttggcgcgagaggcgcggccggtggagggaggccggattgacgcgaggcgcgtccggtggaggaggccggcttagcgtgagaggcgcggccggcagtggaggaggcgaccttggtgcgaggaggagctgccggtggatgtggcgcggtcttcggcgcatgaaggctggccggcgggggcgccggtgcagtggtcccacatgtcggcagaggttgagtggtggtggagcatctgtgcatgagccgtggattcgcacgtattgagcagcaggtgaaaacctagcccggccttggccgggccggcaacgagggttaattccccctcctgagggcgttgtcgtgctgtctcatccctcacgggtggttgctgggcgaaagcccagtcttggctcctttaagccccgacggacggcggcggcggttttccgtcgtttctcttcttgaagacgtcgttttggcatcccttagccgaagcctctcgatcggtgcaagcatgctctaggagttggctttgtgttggttctgagggtgttcttttgggcgatctcgtctgtattcctttgtcatctagcggcggttagtccggtgttagccttctcccgattatatgtcttggcgctgttggtgtgtgggtggcagtatatttttttctttttcctggttacgaccctccagggttgtaatcttataatttttttcctgctctatcaatacaacttcgcaccgtcttgtgcgagtcgttcaaaaaatcaaccaatcttttcttgtgaagaaattctggagattatttggaggcacgataagtgccgcttgctgattcttcctggaaaaggatgtggcagaattttgttcttgttgcattgccggggacaaataaaaaatacagaagttttcaataattgtaggacccccttaaatatatatgcaaaatggcgcagcgataaaaaagtactccctctatatcagttatatcaggttataacatgttataagtcgttttgactttggttaaagtaaaactactttaaatttgactaagtttatagacgaatttaataatatttataataccaaattactttaatcaatgattgaatatattttcataataaatttgtttgggttaaaaatgttactattttttttataaatttaaaatagtttgattttgaccaaagtcaaaacgacttataaacgtaaaacggacggagtacatgctaatgttcttctatatacgagaggagctgcctcggagctagatgtattaattgtttgattagatcgcattaaggatacacatataaaattaagttttactcacaaattaatttttatagttaataagccgttacggtttataggacacgctcaaaggtagcttgggatggacatttattcaccctatgtcggaaaaaggacttctccatacaaaggactatcaattaaaacatgctaattaaaatattgtgtgatgtgtgtaaagatcggatataaaaatatactctctctgtctcaaaataaatcaacttttaaaatttaaactttatcctaaaataaatcaacttatacattcttatctactttcggttcgcaaaccgaaaaattctattcctttgatatccattatccacctattcactgatactaatttgctatcaataagacgtgttttggactttatctatattgtttgaaatgaatgaactgttagttttttttaattattgagggaagcattattatacatgctgaaatcatctatagttgaagcgatgcaacagtggtggtaaatctgtcacccacaaactctcaataactaccctgaagtcatttaattagtataataaaatattgcttctagagttaatgtcttcttccttctctgcaatataagtttatcatactaaaattcgatggtgaagtcacatactcacatacatatgtagttcaaatgctattttaataattagagtacgtgcatagaattaaaaaaaatctaacagttcattcatttcaaacaatatagctcatgtagcagtgctcgtttttcgtagcaaagctcaaacatttagctagtgatgacgaaaagtatcaatgggagcttgatttgcatatatcagcattttttcattagcacgcacaatatcattcacattacacacacatttatataagggagaatttactatttgccatatataagaggtagctggtctgtgattactttgtacaacaaaagtttcatccttcagagaccagataatacatagaggattaattaaacatacatacataattaagagcagtctacttataaacaccaaacgcctaatatgtaattagtactacttgactgtacaatagttaagtccatctcttgagtccacaactccacaacagccaaagaccacctgaccgaagcctaattaagggcatgtttagctggaaaaagaaaatccctgatgtgatatatgcagacacatatttgaagtattaaacgtagtctaataataaaataaattacagattccaccagaaaactgcgagacgaatttattaagcccaattaatccgccattagcaaatgtttactgtagcaacacattttcaaatcatggtgtaattagacttgaaagattcgtcttgcaatttcctggcgaattgtgcaattggtttttttgtctacatt

SEQ ID NO: 90224 - DNA, 3091 bp, Oryza sativa
cgacatccaggccaaggagtgtatggtcttcgccggcaccaccgtcgtcaatggcagcgcaatctgcctcgtcgtgcacactgggatggccactgagatcggcaaaatccacgcgcagatccacgaggccgcgcaggaggacgacgacaccccgctcaagaagaagctcaacgaattcggcgaggcgctcaccaagatcatcggcctcatttgcgctttggtgtggctcatcaatgtcaagtacttcttgacgtttgagctcgatgggtggatgccgaggaacatccgcttctctttcgagaagtgcacatactacttcgagatcgctgtggcgctcgctgtcgctgccataccggaaggacttcctgccgtgatcaccacgtgccttgcacttggtacaaggaagatggccgccaagaatgctcttgtcaggaagcttccaagtgtggagaccttgggatgcaccaccgtgatttgctctgacaagaccgggacgctgacaacgaaccagatgtccgtggcgaaacttgtggcgatcggagatgctgaagggaaggtcaggagcttcaaggtcgatgggacgacatatgatccccgggatggtagaattcacgattggcctgcagggaggatggatgcaaaccttcagacgatcgcaaagatttctgctgtgtgcaatgatgccagtgtggcacattcttcacatcagtatactgcaactggaatgccgacagaggcagctttaaaggtgagaatcgataaactgtatgatattctcattctgttaaaatgctccagtttttggtccaagaatatggtgcatagtttgttaatccactagttgcacatttttcaatcatgatttgagcagtctaggaacattgcctactgaaagtaacgttctggcatgtgttggttctaattcagataatgctgcttgatgtttggaaacattctgttgtaaagctctgatataacttttctttattggtttcttctaggtcttggttgagaaaatgggaatacctgaaggaatgaacggattgtccttggatccatctgaaacattaggtaagctagaaatgccttttcggcttagcttagtattacctatcagtttcaactacgtgcttcttaattaggatattcttctaatcacgcactgagctgattatgaaattgtttgctaacaggctgctgccaatggtggagcaatgttgccaagaggattgctactcttgagtttgaccgtacaaggaaatcaatgggagtaattgttaagtccaaatcaggaaggaatgctctacttgtgaaggtgttaattctttatttcttgctatatagtcatctcttactgatctgctggacatgtattgttcactgcatctttttagtatgttccagtggttggcgttgtcattagtgcctgattttgtgttcttaataacagggagctgttgaaaacttgctggagaggagtagccacattcaactgcaggatggttcagttgtgccgttagatgaaaaatcaaggaaagctattttggaaaacctccatgaaatgtcaattaaagctctgcgctgccttggttttgcatacaaagaggatctagcagaatttgcaagttacgatggtgaaaaccaccccgctcacaagcttttgctggatccagtcaattatgcagcaattgagaccaatttgatattcactggtcttgctggcctaagggtaagatgatgcttctcatgatatgttttcaaccagattgtttccttttttttttaactccaatcaaggaaaattcctgtttcttcttggttcaacaaaatatgcatagtaagcacggttatggacttcaaggcatataaggtctaaataagatatacttgactaggagataacagaaaaggctaagcatgaattctgtatagctaggataagctaatccaaacaagtacagtcatcaattatacagaaagtgatttgctggggaccagtatttaagatcaatgatcatcttgtgtaattttcttttcttggcaacctatcttcttacagtattaatgtatctttctcattgatgttttaaatatgacaggatcctccaagggaagaggtttttgatgctattgaagattgcagagctgcaggcatccgtgttatggtgataacaggagacaacaaagaaactgctgaagcaatatgccgtgaaattggtgtgttttcacatgacgaggacattaccttaaagagtcttacaggaaaggagttcatggcacttgaggacaagaagacactgctgcgaaggaaaggtggcctactgttctctagggcagagcctaggcacaaacaagagattgtgagactgctcaaagaagatggtgaagttgttgctatgactggagatggagttaatgacgcccctgcgctaaagctggctgacattggagtagcaatgggtattacaggcactgaggtatgtacttatttcagcaccataggttgttttcagccagtgctttctttctttaatttcctgtgcagaaatatacaggccttaaaattttcatgacatttccctttcagtccttttttggttgttagccctttgtacttgtctgccaatatttcagctaatcatctatactgttctgagttaatttgaacaacattggttagagataacatgaatttataggtcttttattgtcccaaaagtactgatatctgtgacataatttgaattggtatctcacttatttttcttttgttcaggttgcaaaagaggcctctgacatggttcttgctgatgacaattttagtaccattgttgcggcagttggtgaaggaaggtctatttacaacaacatgaaagctttcatcaggttagtgatctcagagcctgtttttgttgttgttctcactttttgcttcaacacttgcttttgtcacttctattttggcagaaacaaacagactaatgctgcagtaaaacattgtttcatctacatttgcacctcatagttgtgcaagttatcgtgtttttttgtctgttctgaggattctagctgtctttcttcactgctgcag

SEQ ID NO: 90225 - DNA, 709 bp, Oryza sativa
cataataaggtaggcagaaatgtgtataatttgatctaaatatttcatctatatataataattcacagaagcaaaatgttgccaacagaacaatgctgctgcctgctggtttgctgtgagctcagtatagtaccatttaggacaaggaataaaagaacagcaaaggttatcaacttcccaaagagtgatgacctgttttgagaaaatctctttcctgaactttcttgtattggacatatttctattgaataaacatcatttggtgatcattgttacttgatcacaacaaattcagtgacttttgttactgatgagtctgaagaatcactgttagcattttactcgcccttctgcttcctggttcgcctcttggggcctgatgagcttgtacaccttccgacaaacttgagaacctcgtcgatgagcaccaccgggagtgcaacaagcaacaccagcagccactcgttcaagctgagcggcacgatgccaaacacttgcgcgaggaacggcacgtagaggatcaagaaatggagcccgaacgacactgacatggcgaggagcagccatgggtttacccaaggaggcatcctcaggaggctagtgtcttcggagagggcgttgagtgagttgaacatctcaatcgccaccaggacagacagcgagagcgttgtcgccttcactttgccaccatggaagtactcgcatggat

SEQ ID NO: 90226 - DNA, 700 bp, Oryza sativa
tcctgcagccctaactggaagagtgatctggccgagtggtgtagctgacaatcctgggataacaccgtggaagggtgcattactcggttttaattccgtgcgaggaatctgcatatcgtccagggtcttagcgaaaaggatgttgagtgcgctgccaccatcgatgagagtccgtcggagcttgacattgcgaaccactgggtctagtaccagggggtaccgccccgggtggaccacttggtcgggatgatccgagcggtcgaacttaagtgctatctctgaccaccgaagatattggggtgtgttaagctgaaccgcattgatctcccgttctgttagcttctgttttctcttagactcataagccaggggtccgccgaagatgtgattaagttctttgcgatgatcttgaaaaccagtcggggcatcgtcttcatcgtctttcttctttgatgtgccttgatctccgtctgaaggtttacgtgcgttcttgacgtattgctccgtgaactgtttgtagacgaagcaatctttggccacgtggttggagttgggatgatgcggacattgggagttcattatcttgtcgaaggtgttgacgcgggaacgttgtcgggaagatggagagatggtcgccacaagttcttcgggcttacgcttgcgatccttgtagttgttacttccactccctcctgcagtc

SEQ ID NO: 90227 - DNA, 1664 bp, Oryza sativa
tttttggtttattgtgcagaagcaatgttgccgagtgaagtggaatttgaatcactacgatttcggaacttcaacgaggagggctatgaagagggccgagtagacgacatcaatcgactagaagaagctcgagaagcagctttaattcagtcgactcgatatttgtaagggttgcgccgttatcataatcagaatgttcgatcgcgagcctttttagtcggcgacctggttctgaggaaaattcaaacaacacaggatcggcataaattatctcccttatgggaaggaccgttcataattgctgaagttactcggccaggttcttatcgactcaagcgcgaagacggtactctcatcaacaattcttggaatattgaacaccttcgtcgattttatgcttaggcatttcgtttgtatctttcctctttgactgctaacttcaagttttttccttgaagttttcagtcagggggctactatgataataatggagtgtgatttttatgaattcaatttgcttacttgatgtatcattgccctgtttgatttcttggcttagtcaatgaggactgaaagttttttaacaacttttgcgggttttaggctcaacaaggtttgacaaaaacttttaagaaatcaggaactaagttaagatatcaagcacaacataaattcatcagtattgtacaaattgtgcctccatcatcattattcatcaaaatcattggtacattagttagtcagtcttttcatcatcagaattatcaggaccagtcggtcgatgatcggtgtcctagaatctctcaactacatcagcagcaatcttgtcagtggctttctgcgcatcgctgatgaggtcaagagcagcttcttcgctcgtcccatctgcaaagccatcaatggcatcaacgtcaaccctcggataaagagatttggtcattgccaacgctagacttgctcctatacttccagcttctttgatgttcttgaaatatatatccggagcaactctcagcttgtcgaaaatttcagaagcatcaagtgcactcgggccgttgttattgaagaacatcgcttgaacaattggggcagcagcgttagcaacctcatcccaggctccttcaagttttttgatcttgccaaccaggacgtcgaattgagcttgagacttgatcttgcggtctgcatcaacagattcacattcataagtcagcatatggaggataatggcttttgaagtattgattgtcgataccttcaacttcctttaaagccaagtctttttgtcttgccagttctgccttgtcattttccagaatttgaatctgcttctccaactgagatatcttggcagcttgcactacattaaccccggttaatcatgattacaaagacaacggcacaagttagttgggcagagtttgtgcgtaccttttgatgagccactcagttcaaaattggattcctgaagctcagcaattcgatccctcagatcatgctcatttttcctggcaagctcttttgtttcgtacagctgactcctggtggcttcgagggtcccgagatgagggactagcctctctaaggttgccgttttagcttcgttcctaagatgaatcctctgcaagacagtttaattagcgcctagattaaatagcaaacga

SEQ ID NO: 90228 - DNA, 788 bp, Oryza sativa
ccgcaggcacaccgaacacacacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacctaaagaaattcgagtagtacgttgaaaagtaggacctgcattctttaacccgaagggcattgtggtgtaacaataagttcctatgggagtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgtcgccgcactttctgccggaccggccttgcgcccggccgcacggcgagacggtgctcaatcagccaaacttttgaccgcgcggcagtccgcgaggtcgtggagggaggtgttgtgcacggtacaccacttgccggttgggcgctccctgctgggagcgccggcctccttctttgtgtcgctcgcaggcctcccctttcggggggcccgcgaagcgccctc

SEQ ID NO: 90229 - DNA, 610 bp, Oryza sativa
tcaggtcttggttctaataaacctgatcatatcttatgtttgatgctatttgtacctggagttgtagttggagtgatttcaggtagtcgatcgcttcatccagcatcgaaactttgtcggtctgaagaaacaagaagattagaagttcagaactgaatggctctacaagatcgagatatgtatgaccaaagatgcaccacatattgcataccttggtgcaatttggaagtagctcttgcagcgccttcagcttctcattgatcctatcccttctcctctacaggtatccagatcaaagataagaaacaccaagtgcttataaaccagcaattctgatcgatttgcatgataacaacctaccctttctgaaaaattgtggaactcagcagatctgcttctcctggtaggggtaggccttcttgcttccatcggatcttttcaagaatatattcaccttcctggaaacaagatgtgcaataacagatctaacatttaaagataacatacaaacaagaacaatggtaaaactgtctgaaacgtatgaactactcctaagatcatcagcagagataggatcatgttcttccttgtcatgcatacctgagttttg

SEQ ID NO: 90230 - DNA, 1728 bp, Oryza sativa
aagacgagggcgcaccgggaatatatatacccccggatctttactcccggttgttgagaacaaccgggactaaatctttagtcccggttgttgagaacaaccgggactaaagatgatctttagtcccggttggtattaccaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatatatatatatacttagcatatatatgaatgatattattatattggtaaaaactctaattaagatatgtatgtacatattgcatgatttaaaattaataaaaattgtaatcatcatatatacttagcgtaggaattatattaaattaaatgctaaaaactctaattaacatatgtaaatgccacatgcatgatttaaatcttttaaaaattcgaatagtcttatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttcataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttagttcgtgctcttcatgtcttgggctctcgtgtagaatgtgtacccattgatctcatatccctggaatgtcgtgatcgacccagacggtccactcgccagga

SEQ ID NO: 90231 - DNA, 1403 bp, Oryza sativa
tttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggctcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccaggggggaggttgtagatacacatcgtaccgggcccagtgctatgg

SEQ ID NO: 90232 - DNA, 9159 bp, Oryza sativa
cccggttggtgttcccaaccgggactaaagatcccgggggggcctgacaggccttgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgtgcatcttgactcttgacaattatagggttagtttcagatactacgagaattagtttattaaagataaattgtacttcaaagagtcatgaattcaattaggtctacttgaaaggcacattcttactactgggctgttcggcatcgcttcttcggcgcttgctgcggctgcgttgtagtaagaaaccttaggaccataatatataatatatagggttatgtacgtaccatatacggtttgtgaaacttgggccataatagatggagttttgaaatttactcgaaataataataaaataaagctagtatacaatcgtttttgcaattccaaaatgatggtatagcaccccgattgaacaatacatacattactctggtccataatgtttgttcagtacttactccccgtggacaaattattttcagcgtgatcatcgatgaacacagtagtctagctctaattcattctatgagcagagtatatatgtaggatacaacaataaaatctacacatcaagacttgctcctagagtctttcatgcaaagttagactaactataaagcataacttgtgctactccgatgagatctacacatcaaacaatgctagccagcagcacaccaaagaatgctaccctccaaagccattgttgggatttttttttttgtggatttgctcttaatccatgaacttgatatttgagtggtttttatatacaattcaatacatcatctattctgagctgagaagttgacttgagggcatccaccaaaaataaatttctaaataaattgaaagccattggctttaatattatctgccctataaggtcattcctataagaatgttttgtaaatttgatgtatctgatgcctattgcggtgagatttggtggcatcatcaagcatggccacatccagtgcgaggatagccatccaaaggcaagaggagatggaaatggtgaagaggaggcagcaatcgagtgggtggtggactgttggcggcggtggggaagagggaggaggatgacttggcacattagttttgcattttgactctcccctttcacttatttagatgtttgaaattaaactcttgagaaaacttccatacttgacctaaaccttttctctctaacacaaactgccagcccttattagcttcatgcactggtagagaaatgttctttattcccggttgagaaccccctatagtcccggttttctaacggggagtaacaatccggaactaaagatcgctatctttagtcccggttcaaatacccgggactaaagatcgatcttaccaaccgggactaaagggttagtcctagtttttttttttcattgttcttttgaatattgatttcacaccaatctctccaaaatcataaaatcaatcgcaaattccaaatcgaaattgagatgctccctacatccccagatcaaatagcaacatcacaaatcataatattcacatcacaaattgtcagaaaaaaatcacaaattctaaaagaaaaattacatcacaatcaaaatcacagatacatcacagatcacaaatacattacagatcaaataacacagatccagatccagatccaatgaatcacaagttattaaaaaggaaaaaaaaagaaaaatctggccgccgagggcggccgccgccacctcctcctgccgcggacggccgccaccgcctcccagcacgggccgccgaccgcgcccgggtccccgccgccgcactccgggtaagctcctcgccggctaagtgttgagagagaagaatagaaagagactgagaagaggataaggataagtgtgagagagaggaggaataggaaatagaaatttttgaggatagcagcaagggattatatacggtatatttgatttttagtcctggttgggaacaacaaccggactaaagttaggattttagtcccggttggtaccatcaaccgggactaaagatctctagggactagcagcctctgacacgacatgaacggggactaaagatcatctttagtcctggactaaagatgatttttagtctcggttgataacacgaaccgggattaaagatgatatagtccccttacagttataaaccgggactaaaaatgtttttttagtcccggtttttaatggaaccgagactattgtggatttgggtggaccgaccaaagatggtttctccaccagtgatgggctctggtccaagcaatgttgcggatcatacatgggccatgtatgggcttcttggcccattccttgcactcgagatgggatgcttggctttggaaaaagtatgaagactcctctttaatccagatgtcaaaattggggtgaattggagctccctgtcaagtctcatgcccaaactccaacaattgagtgattattggcaataggaatgcacatctttagtaataaaacatatcacaacaaaaaaataatatttatatactttttaattgaaaaaaaagatcaaatgtcatataaaaagtcaatacacaactcgttgctacaaggacaagtagaatgaagcagttggagatttatcttggggaacaaagcatcaccgaagattcaattctttgcctggttcctagcgaaagagcggctaccaactagacacaacctcacgaagaattgcatcgtcgacactgccacttgcgagctctgcaaaatggccgatgaaaatgctgcccacctctgcctccactgcccaatggcaatgcacttctggcaggccattggaattcggccgagcatcatcgctacatgccaccttgcagccttcaccctacagataggatctcgacctgcttctggaatcatcgacataatgttgtgtttggaaatctgtcgccgtccttacatgtatactaattagccactttccttccactaaccagactgaggcccaacccaatgaaagatatgcagagtaggattactaagggtgcatgtggttggggtaatttttagagagtttgagagttaaaagagatatatctattaactgaaggaatatggagttgggaggaaatttctcctttacgttgtgttctgtttagttgaaggaatatggagttgggaggaaatttctcctttacgttgcctaaacaacgtacccgtcgatagcgaggcgcatgcagtggcttcgttaatctcaaggatttgccggcccagtcttcgaagatgctcataggggtagggttgcgtgcgtgcgttcatagaggtgagtgcgcgtgagttatgagtgtctgcgttgtactgtgtaattctaaaaaaaaatcagccatctattttcattaaaaatctagtctatatatattaattcttgccaattttaatttcactacctctaccaaacaaaaagactagtattaaaaatcaaattcattcatgtattaatcttaccatcaatttactcatccaaactcccgatactcttgccaaacaagccgttaaaaagcaagaagccaggccaaggcatcggcttcctttcttctgcacagtgcacactacttttcctctccacctgattctttcttatccctttcttcacatactaattgcttcttcgtgttagccatcgcaaccaaaatcgtgttagccatatcttagcaaataaggcacgatgtgagtctatgtctaatttctggcttgaaaacagttgtaatttcatctctcaccttgtttgtgaggagtaatatattcccttttccccgaaaaaaaaattgcttcttcgtagtctatgcctctaattctcttatatatacttgtaatttatccggtttggtaatagatttctcatatggatcgtaacgatcttttctgtggatgtattgtcgttgatcgtttcaatcctcctttgttatcgctgtggttgtacgtatgtatcttcgtggagcaagcctcttccacttctcagtcacgattaagtaacacaatttgagaaagaaatttgtaaattgtacaagttatatatgtcaaatatatcaaacaagttgacacgattatatatatggcgatagtacaatattcttgcataacattaatatctaaacacacatacacaatcacatgtagtactatctaatttcttttataagataataatcaacatattcatcccagtctctacattcatgtatgcatggttaacttaacacacatgagagtaattggtaatcaccggtaactggcggtgccactagtacatataagatcaaatcacagctggttcaaaatccgacatcctaaaacataacaacttagtatataatatggtatatcctactactgtaaatctaagcatacctcaaatcccgaatcgtagaactaggatgtgtgtctcattttgtactacgacttagttaatttcgccgcggtccacaacaacacagcaagcttgccagcaacccggaggagcgatccttactagtgtcgtttggtagtccacgacttgtgaagttctcattgttattcttctccccagctcgattaacaggagtcctctcctttttttgtttgtcgttttgatcctcatctccgtcgttgtcgtcgaacaagaaatttgctcgtctggacttctccatcagatcctgcaaaatatttactagtttatttacatgtgcatgcaggttaattattaagtgatatatatatttattcttcctaatcaattaatttgcaaactaaaaaaattgtagtagagcacacaccaatggacaaaaaaaagtgagtaaaagtatagtattgaagatatattaccatggctgcaggctttagtttggagctctcagatgatataagatcaacctagagaagaagaagagcaccctgcagctttcaaaagaaaaatggaaggaactctgtatatatatgtgtgtgtggtgtgtgggttggcttcagtttgcacacttgcactagggcatcagattcatgagaggtttcgtaggccgcatggcatatgcacgcgcacacacatatatatagtgaagatgcttcttgtgttcttgaattttcatgatttctttaaatgttgtgtttagataaatttatgtatatgctgagtgtgcacgtgtgtatgtgagggtatgcgtttgtactgtgtttgccaaaaaaacaaccatgtgattttgaatcagtaatatatacatttatgatttatatataaaatcgatattggtagattttgtatggcaagtactcctacttaattagctagttatatcttccataattctcataattaaatgattcaaaaaatataatatatgtgcactggaaataactatgtcaatgtccagaacgcaactgccgaattaaggatatactagccacgtagtcgtgctctgcgcgacttttgatcccgtataagaacttttgtatccgtatattagtttatagaaggttttagcatgagttgattgatttacaaagtatcaattggtctagctaactatagatttaactaagctgtactatatgagaaatcactagaagcctcctggtttttttatttctttatttattatctttgcccctctctcgacactagaaacctccagaaattaccatacatttatcccatttgttgttttttatattgtatatgtacccttttgatccaatggtccttatttatctatccgacggttaatatatttttgatgatgtagcgcatcatcgtgtatgaaagtttgttgcttttactatatataagatgccttgggttaggatgaaagctttagctagctagctagctggagtggggcagcatgataataattaagcgtaaaagtcacagaagctatgaatatagctagctagtacatacactcctttcgttaacaaataaatataagtcgtttaaactcgtgcatttaaacctcaaaatattaaatcactaatacaaaaatattaagatttgataagtaaaagacaatattattagctagatttatcctaaaagatcgatacttcaatgtagtgatattttcaatagttttgatacaaatatatggctagctatagaaaaaaggtgatgataaatcatgtgcatcgaaaattatatagatgtcctaaccgactagtgaaaaaggaaccaagaattaaaggagatgacgatgctgatgctgatgctgatctagctatgagaaagcaaagaaaatgatatcgtcaaaggagaggaatacgattcctttgaatgagaaaagaatttgagtggcttaattggttggcacacgaatatgattccttgccgtggaatgcactcatcacaatatgtacgtccaatgcaacgcatatatgtagattacttttggaaattatgagctatatatagcttttaagtccctatcacatcggatttttggatactaattataaatattaaacatagactattaataaaacccatccataatcttggactaattcgcgagacgaatctattgaacctaattaatccatgattagcatatgtgatgctacagtaaacatgcgctatttatggattaattaggcttaaaaaatttatcacgcgaattaactcttatttatgtaactagttttataagtagtctatgtttaatactctaaattcatccgatatgctagaagttcctggatccaaacaccaccttagtatatatggcatcatgaacagtccagtacgtatgcaatgcagaccgtcgatatgcggacttgaacggccaggattgacccggaagaggagcgagcgaggcaccgtgttgatatcacagtagcacatattcttgcatatataacgggctatcactggcggttccaagtataccgttcggataacattcaaattgatggtgctttttttttaatataatggaataaaatattattgccggcatttgtttaattaagagttacagccaattattacaaggtttacacaaaagcaaactcacgcaaatcgatggtgctcttttaatggtgataactattgaacagtacaagaagagatagctaagaatatacgatgattagctagctgggaatcgctcccttgtgaattgtatgaaaagaatagtatgataacaatggaacaaagctgaactttttcttattcagtttacatctgaatcatccccttgcattgcgaattgtgatgactgaaagcaaaatatgcacttaggatatgttttgcattatggttaggatagaaacggtcggaaaaatgcttcaacgagcaccatcgtctgccttttggtttattagccgagcgtaaaatttgaattgtaaaacttaaatgtttgagctaatttgaagtatttatctagtttattttccagtgttgacttttatttaaatcattaaggacaaatatataaaagtttttatcaatatttttttaataagccattttacaacttatcaattgtaggctagatgatattaaactacatttttgttaccaatttttctctcagaaacataatcggagtggtagtatcggaaacaataacgatattggtacataccggagcattggaatatatcaaaaacggaattatcgggatagagagcttcaaaattaaggcatcaaaggaataagcaagttatggtgcctatggactccaatttatggggtctatgagatcggctttcagccaatccatttggaaagcatgggcccctccaaaatgcaattttttctcctggctcgccacccaaaatagactctggacaactgatagactcgagaaaagaggttggcaaaatcagaagatatgcccgctatgctgcataatcaaccgctatgctgcataatcaacgaatcagcgatccatctgctggcgcactgcagagtcaccaagagggtatgggcggaattacaaaggtggacccaaactgacctccaaatgagcaaatagagtgactgcgactcggtggagcaatggtggaacctagtggtagacactcctaacaccccccgctttcctttgcgagcactggtgatcttggtttcatgggaagtttggtgcgaatgaaacgcaagaatcttccgaaacaccgcctcaacaccggcttccatcatcgccaagatcaaggaggaggctcgagcctaggtcaaggctggagcctcaaggcttcaagagtttggaattttgggagatatcacttagtctctttgtcaattcttgcgggtgtagctcttttggcttgccctgtaaatatttccctttctgattttgttttgttttttctccatctctattaatatacgagacaaagcttttgccctcctttcaaaaaaaaataagcaagttatggtcatgtttacatgataaattaatgtagacatatattagtgaagattccgatttaaattttcataacgatattataacatcaacaataacaacacgtaagttttatggttaagtttttatattttgatgggttgttggtattatatagtaattcattcggaacttctgcatagaaacagcataccactaaaacacggttgtcaaaacatataccatttccatctcattttagacaaaacagaaacggaataaaacaattggtataacagaaatgatagctcacacggtcgggaatttccataccattttcatatataattatagagtaaatttcacaaaacaactgatattttaactaaattatcatagaactacatatttaaggtaatatatcataaaactatagatttaacaataaatttatctcaaaactacaagtttaaggctaaaatacatgtagtattgtgataatttggttaaattttaaaaatcaaactgaatttgatatataactcttagcttatgtttatataggtataaattacacattgtataaaaactaatgattaatccatatcgctataa

SEQ ID NO: 90233 - DNA, 3586 bp, Oryza sativa
atataaattaatcatttcagttatacctactaatttatcttttaaatgatatatgatcatattcgtttcgggttgaagggagtaatatagatatgctatggaatctcatccaaataacgctaagcatgtatacctaacggtaccaaatatgataccctgtaggtatcgatgataccccgtcagtactagctccgggtacctattagtaccgggccgatatcctatttagagatggcaacggggctgcccccaccaggtaatgctaacccacctgtcccaaatacctgaaaatcgaactttagaatcagagaacacaacaagcaattaatgaagcgatacacaacaccatactaaacatgaagggatgatgagtaaccaattaatcatcaccaacaaaaactacgtagaaaaagcattgatgcacataattctttagcgggaagactagacgaagcaatgcaacgcagtttggagttgacatagtgctagcattgcttggagacaggcgaagccatcgagtacaggaggaagcaccggtggcctggaggatgtgaggatgcatggtgtggtgcccgcgtgtgtcctacaggactccttgaggtggcgcggatgtgccccaatcccttgacccggaagcatcgcttacttgtcatgttagcctggacttctagtggcagctctgtagtgcctggatttggaccggagtggaggagagcattctctccccaatttatttgtgtgagaactagggttgtagtgtttgtatctatatgtgttgtacacgggggacatagcgattcggggacaagggtctagggaacgtccccggaaccgatccatcaaatgggggagttttttcatgtttagagcctcatggatcgggatagtggcccatttgcagcccctaatagatgttttacccaccagggattagggttcaggccccattaacatccctaatcccatcggtaataggctaataccccatcattatcaagcctaatacatgtgataccaaacctggtacatgcagatctggtgagtagtactaggcctagctaattattaaggagataactagttgaaactattcctgatacgtttaatgtttttttggttatttataagttcattagttttgatatcttaaaatgttatattttcgtgcttcatatagctatatccatgttcacaatttcgtaaaacttactaattcctaacctttgatcaattcaatttctttcacagcttcttatatgcacagttcacaagcccaaattatgggggcgtttgttttgtttggttaaccttgccatgccatattttagtcatgcatgttacaatttgttagataggtgtttgcttcaatttaagcttgtcagactttaattttcttttacttggccttatatgtcacatgaacatttttgttggctaataatgtcacagaactatttaatatataagtatatgtattactcaggaagtatatacctcataactaacaaaattggtatgtgtaccttatatacttcccgagatttagaaaagctttgtcattgtcaatcataaatttatcttataatatgtttaatcaatttatttttttagggaggtatatacctctccaaggatatataagaacctctataagggtctttacttccgtgcggttaatacgtgcgtagcgctcagtatatcatagtttaaataatcataaaattataatatttagagcatcattaaaaataacttgtgcaacacacgggttgacgactagtattacataatcacattatttaaaatatcaatcaaggcccaaattgtaggtgccccacttatttgatgtattaaattattacaacattttggtaacaccgacaaaatatatcactaatgctgaggatctgaactccacgagcgcgcacacaaattaatccacacacatatatatgtatagctaagatgacataagataattaccaatagggtagggtttatttttgaagctgaattaagcttttaatgaagccttaaatcttcgaaatgaacttaaaagttaggtagtactagcattattccaagtaaataaattttatccaaatttgaaagttaattaggagcgaaaaataactgatcataattagttgggcatggaatgaagggcgaggtgtatcatttgggatagaaggcgacggtagtctgcaagacagtggagatggcgagaagagtggagacgatgagcgcgaggattttgacagggctgtccatgtacttcttggcctccgcccagtaacgatacgctttgttctggctgcaatccctgagcccctgcagcaccttgccgatgtgtgtcttctcctccgtgccgctccgctgattacctcggcataggttcttgaagtactcgatgatctgcatatatatatatatatatgcgcgcggtaattaactgataacgaattgagaattcagatacatgtatgtattcgtgacgagattgatcgaatgataagtatatatatactgaccgtttcatggcttccgaagttgttgaggaggacgccctgctcctggagcacggcgatgtcgtccgtggagctgacgaggttgtacatgaggaaggcgtaggtggtgaagtagtcccgggggtgctcgtcgtcgttgctcggtggtggcgtgccctgctgctcgtacgcgacgaggttctgcagcagctgcaccgtgccctggtcgacggtaagcgccggcacctccagaaccggcgacaagaggccattcctgagccgcacgtccagtattccgccgcgtttcgtcggcgccttgctgatcttgacgccgaggccacgcagctgcgccgccgacacgatgttcgccttcgccttggcgtcgtcgtcgtccttgtcgtggccctgctgctgctggttggtggcgctgccgtcgcgccggcggaggccgaggacggcgcctttgtcgtcgtcgacattgacgaggtgggcgtgggcgaggtgcagcaggtgcagcaggtggtggacctccttgtcggcgatgagcttgtacagctcgtcgctctcgtcctcggggaggacgaaccaccccttgagcatgtaccacatcgccatgaccagcagcttgtgcctcttcctctgccgcatcatcgtcttgcgctggaaggtctgcggcgtgatcatcatgccgtcgtcgcctacgtcgcgcgtgatcttccgctggagcttccgcggcgtgaggtggtagaagatctcctccagcacgaagaaggggatctggttctccagcatgccgaggtcgatgcgcagctgcgccggcgaccaccgcgtcgcgtacagctcctcctcgttgtacccctgcacgaagttgtagaggtgcttgatgatgaagcacccgtcgtgtagcagcatcctcaccatctcctcatccttcatctcgcgcacgtactcctcctccgcgtaaaacctaggacctccacgaccaaatttcagtttcgctattcttgtcggggatttggattgtttttgtttttttagcaaaatttggtctaacgagcaaatctacggttcttgaggag

SEQ ID NO: 90234 - DNA, 642 bp, Oryza sativa
tgtccctcacccagcgcgaccacctcccggctggtggcagattccggcatgaatcggcgcggcagcccagcctgcctctcgctcacgatgcgagaaggcggcagcacgctaccgtcgagcggtgcggagccccgtgccatgacgccggcggaggaggggcttgagagcgagtgagtatggcaagggtagggcgccggaaacggagagtcagagcacaagtggcaaaggcaaggggaagagtggcgagaggaaggaaacgaatctcttcctcggcgtctttatacccttgccaacgctatgcccggctcctcgcttcccgcgcccactatctcgccccctcgtttctcgcgcccactcctccactaatcccgctcgcccgtttgcggcgcatgaggcggatgtgcggccgtggcagtcgagatgggacatatcgtgcgcgcgttaaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgcgcgatttgcgaccactggattcctgcccccctgtagagaccgggcccacctgt

SEQ ID NO: 90235 - DNA, 659 bp, Oryza sativa
gtactcccgtactcacccttgctctgtataaataatcccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgagatctgtccgcagcccaacatgactgtacctctactctataataaagagacctctgttgctgtgataatctgtcttcctgtgataccagcactgtttcctgggactggtatcgaattacaggttaatttggagcgtcacgggctagttccggtcggtactagttcggggcgtgacataccgcctcgccccggagcacccgctcccggccgcgtatgaggactccgccacgacactcgcctgggtgctctccaccgccgacccatggctcgccgcgcacggtgacctctcccacgtcttcctcgcggaagacagcgccggcggcaacatctgccatcacctcgccatgcaccatggcctgaccagccaacacctcccgcaccgcctaaagggcatcgtgctgatccacccatggttctggggcaaggagcccatcggcagggctgcaggaat

SEQ ID NO: 90236 - DNA, 4945 bp, Oryza sativa
ggcgcgacgacgacgacgacgacgatggagtgggggtggttggtgaagctgtccgtgcacagctgcatgtcggtgtgcttggagtggtggtggtacgagatcatggtgctgctctgcggcgtgctcgccgacccgaaggcggcggtggcggcgatggggatactgatccagaccacgtcgctgctgtacatcttcccgcactccctcagctgcgccgtgtcgacgcgcgtcgggcacgagctcggcgcggggcggccggagcgcgcgcgcctcgccgcccgcgtcgggctcgcctgcggcgccgcgctcggcgtcgtggcgtgcgcgttcgcggcgtccctgagaggggtgtgggcgcggatgttcaccgccgacgccaccatcctgcggctggcgtcgtcggcgctgcccatcctcggcgccgccgagctggggaactgcccgcagacggtcggctgcggtgtgctgcgcggcagcgcgcggccggggagggcggcgaggatcaacgtctcggcgttctacggcgtcggcatgcccgccgccctggcgctggcgttctggccggcgcgcctcgacttccgcggcatgtgggccggcatgctcgccgcgcagctggtgtgcgcggcgctgatgctgctcgccgtgcggcgcaccgactgggacgagcaggccgcccgcgcgcgcgagatcaccggcgccgtcgccggcgtcgtcgttggcgatggcgacgtcgtcgtcaaaggcgatcatgcagacgccgccaaagtaaaggcagacagtggcttgctcgtggtcacagtgctaagttgattgccatataatggagtattcttgactccttaaaattcgtttttttttttacctttttgatctttttttgaagcatccattggaaatttttaggtattgaaacgatggatatttggatgatacatgcatcctactaattttttcctcttcgaaaaaattaactatgtacatgatcgaagagacgagaaatcttctggcaaggtaatcgtgtgtgtgcactattatgcagcagtgaagatcgagttgcaaatagcggcacggtgatgtgattgtacacgtggcgccctcacagcgctttggcctaatctagtatatacttttgggccctaattaactactgttaaaccccatatatatgcattggatctcattattgtgaagttacttttgaaaggatgcatgattatttgatagtggttataatcatctttttaatgtgcatgcatgcacaacctccatggctaatcactttctgatcgatttggaattatgcatgtgtcttttggatctatgcatatggccagggtaatctatggggttaaattaagatgattgagctgaagtgcacttcagtctgatcatttacatcattgtcaattattttgctgatgaataattatgccaaatccgacagacaaatcccttttttgtcggtgtagaaatgacctctctgatcagcacaccatgcaaaactattttcgtcctctttcgtcagatgcattatgcaccaaagtacagtcgttaatataattaggctgatcgagctccccactgccatgtcaaaagattaaaaagaaaaaaggtgattaattaaatgtactactaggactagctactaaccagttagccagctatccctctcaaaagaacaggaaagaggttgctgattggagccctgtttggcccgggaccggaagccatttgggattcctcatcaggagacagctcaaatccttgctgattgcagtatgttaacatcaatcacacgaacacaacacacatggtaaagcccttttttgcgttattgcgcttttctactgttgttgttctgtactactactactttgtactttctcttcttgtcctgaaatgatatagaaaaatggactgaattggagcaaaagtagtatgtagtgctaggtcagaaacattaattagtaataatatatatgtgctaattcagttcagttccgttttgcttagctgtagctcacttggtttagttaatggcttaatgtcacaacaaacacacctaggctgtttcactcaaagcagcacacataacaaaaggagagattcctctctccaagttccaacaaaggtgagcttcattacacactgatctacatctgctttaaacctagtcagggcacaatgcattacattaacttttgtcagatattgtatttttctgtcagatattgttaaaaacgtactcatgcttggaaaagtgtctgcatgggtgtcaactactccctcaattccatattataattcgtttgtcttttttcctaattaaacttcttttagtttgattaactttatagaaaaatatagcagcatttttaacacaaaataaacatatcatcaaaatatatttaatgctagatttaatgaaactaatttgatattttagatgttgctaaatttttctataaatttgttcagacttaataaaatttgactagaaaaaaagataaacgacttactataatataaaacgaagggaataattaacttgatccaattaaagtttctaactagattggccgtagatgcagatatgatatgtgccccaggggcctaggtgtgtgtcaaaaaaaactgtgcattgtttgcgatccacgtaagcaacatgacacaagatgtactgtgtatattaatctattagtaacattttaaaacacatgattacacataaggttctgaacctacagtactagacaggtagctgatgttccctttgctaacgagataattaaagaaactactaattaattagtagtggtcctctgatgatatccaagagctaagccgtgcccaataatgtaacataaaattgtccgaagactatataatacctgtgtggaattgtacgtcgacctttctcctttgtggatggacaatttagaaaccagattgcttatgtgtaactgtaaagacggccaaaaggccatgaataaaaaaaatgttcagattcatcgatcgggcctgaatgtatctgaaattctctctgaacatacgtacgcacgagcagggcagctcagagcactttgatcatcagggactgaactggcggctgccatagttaatttagctcgatcctaattaaatgcctgaacagtacttgagcttaatttgttaactaactgatcagtaactggctgcgtgcagctgctagctaatgatcaattggcagatatagaactttatgaaaaggaggccacatctttttgtgcatgcatgcatgcataaaatgcaggccatatgatggtgatgaaggaacgagcaagctagagagatcaatcgatcgattgagctgggtggcctcatgtcagccaggctcgtagagttagacacttagatagatagatactccctccgtctaaaaaaccaacctagaagtgggtgtgatcccttctacttccttcgttttataatgtaagtcattctaacattatccatatttatatagatgttaatgaatctagagattcattaacatctatgtgaatctgaatgaatctggataatgaattatctagattcgttgtaagaggggtcaaatgctgattttttttgggacggagggggtagataggtgcaagtgggcagacatgtgggataatttggaggaacgtaacgtgtagggtacagtagtgtttgttaaggcgtaggcaagcagcacggcgatggcgatggatcgatcagtgtagtacgtggatcgatctactgcaatgtccaatggcagcatgcatgcagttgcagccgtatgtatgtgcgtcacccagctatctgcatgcctgcaattcctgtagagaaccatgtgtaacctgcactgcatatatatactgacatgaacgaacgcatggcatataagagagactgacatgatgatatatataccgcgcgcatgtgagaaattaattgaaactgatctttcgatggatgggccacttttgtgtagagatgcaagcgggctaacccgtgaccgtgaacagcttatagacaaaattagtgagtaatccgccggttacttactaatttaaataattattatgggttgatccacttgcatctctacgacgcgacaagccaaactatgatgtgaaaactcacggattaccctttacttaacatatataagtagttttgtagatcggtccgcttgcatatccctacttttgttgtcggtcatagtgcagtcgcgatggatcgatgaagacgacgcttggtggtgtggtctctgatactgaattgaaggcaacttttaatttaggccatccaataaaaccgatggacgccttgcagttagttgcaggccagcaaataaagctagagatcgagcctgcatgcatatatatcagcatatggatggctgtattttagcctgtgcatgtgcatgtacattgcacgttagctagatcctagaggtagcaacgtacagccaacgcatactttggtgactttggggaccgataggaattacgtacggtacgtagctatagcagtgtgcagtgtgtggtgtgcatgcatgccaggagtagtaattaaaatgagtagtaggagaactgttttaaacattcgggtggacgtccacccgtttcttgtatgtcatctaaatggttatgaaaaattttcaaaaaaaaattgacatgataggttaatatgtaatatatcatctcacaaacatgcaaattcaaattcgacttctacaagttggaacaagaacaacaaatttgactgtgaatatacgtatactagttagagtttaatttgttatttttgttacaacttgtagaaatcgaatttgaacttacatgtttgtgaaatgatatattacatattgaagtatcttataattttttttaggattttttcataatcatttaggtgacatgtaagaaacgggtgg

SEQ ID NO: 90237 - DNA, 5154 bp, Oryza sativa
ccatccagtattacaaaagaccatctacagtcaaagctacctcaatgtagcgacaagcctgcgactcttacaacggagcagaagcaagctaaggtgaaccggcagagatcacgacatcaatcactaacaaaagaacaaagattagatatgaacgcccgacgtagggtagcaaggcaaaatatgccagatgtggaaatacatgatatgaatgcccgccttaggtcaagacgacaaagtgttactccaggggaaaggtctgctcttttggcacgacgtaatgcactctatgcagctaggcgtgacaaaccatgtgctgaatcaattgcattggagtgccctgagggtagcagcccgtcgttgctagatccaacgccttgcttggaaacaaccggtgatgtgccagctacatcgaacctgcaagctgagcatgctgcagatcatcttgcacgatcgagcaccttcgaggatggtatcatatatatatgttatcgttcatacttgcaatttgtaaccttccgcatactaacttttcattccactatagatgatatggattccttcatggatgatgacaccgacgatgaatactacttgtttgctaggctaggtaccatcgtcgttatacctgaaactctctttcacttcagtagatatttgaaactaaactacttcccactaaacaatcccaggcgatgatgaggatgacgatatggtacaatccgatgacgacgacacgcaagcaccgacctcttcgattcctgatccatttgactgtgtgtatagcaacatcccacaaagcacaaatgttctgaagcctgagcctgactgtaaacattgtggcgccaagaggttccagtacgaaccgtcgggcttctgttgtcgggatggcaagataaagcttgtagaaaacgagacaccccctgaactgatgaggctctagacaagctcggatccagatgccaagcatttccgggataacattagatatttcaacggtcacttctcgttcactacccttggtgtaagccttgacaaggcctttgcaaacatgagctcgggtgtgtacacatttcgggcccatgttcagatctatcataacatacattctttcggtcctagagagtctagtccagagcatctcgagttgtatttctacgatgacgatccaaccttgagtcacagattccgtcgttctccgagccttgaccaggatgtgatcaggactgtttcagacgtcctttggaacaacccgtactcggagacatttagaagtctggggcaggctgatgacctcgcgaactaccgcgtgacactaaatctagatcataggttggaccaaaggcgttacaatgtgccggtgacaactgaggtcgctgctgtctgggttgaaggaaacgagagaaggaagtttgagcctagcgtgacaatatacggtaacgaccgtacccgtaaatgcatccaacctttctacggatgttacgatccactctcgtatcctttgttcttccctagaggagagagtggttggcatcaaggtcttccaaaggacaaaataaccatggaggctgcaaacacgcgtcatggcgatgatcctagtaagtttatcttcgtactgtgttgactaaaacaattgataattgtccgttacatgactgcactaacccagacgtttctcacgtgcagattgtaacagcgggatacgagtttctgtaagggactactactgctacaaattccagatgcgtcgtgggattttcaatcctatacttcacgggggacgcctgttccagcagttcgctgttgacatgtacatcaaggttgagagctcccgtctggactatgtgaggaacaaccagaaggagataagggccgacctatatcaagggttaatggacagcatccaggctggggagagtcgagcaagcgcggtcggcaaacggactgtgttgccagcgtcgttcgtaggtggtggccgaaatatgaagcgccgctacatggatgccatggccttagtacagaagtatgggaagccagatgtattccttacaatgacaagcaacccaaagtgggatgaaattactcgtgagcttgagcctggccagacaccacaagatcgtcctgatcttgtggtctgtgtctttcgagccaagttagaggacctaaagaagcagttgttcgagaaacacattcttggcaaggttattgcacatgtttatgttgagttccagaagaggggtctgccgcatgcacacttcttgttgatcatgagtagtcgatacaagctaacatctgcggaccaatatgactgcatcatctcggctgagcttcccgataagaaaaagtatagagagctgtacgatatggttgttaagcatatgatgcatggcccttgtggtccactcaatggtaaatgccaatgcatgcgagatggaaagtgtaggaacaactacccacgagagttcaaccctacaacctcgcaaggcaaggattcatacccgttgtataggagacgtaatgacggcaagagtaggatggttagaggccaccctctcgataataggtgggttgtcccgtacaatccatatcttctaaggatgtacaactgttacatgaatgtcgaggtttgttcaagtatcaaggcaataaagtacctctttaaatacctatacaagggacacgagagggcctcgatatccataaacgaggcagataacaacggcgaaatcgatgagattcagcgctacagggatgcgaggtgggtgacccctccagaagccttgtggcgtatatatgggtttgacatatgccacatctcgccgtctgtgaggcagttgcaacttcatctgccaaacatgcacatgttggcttccgatgcagacaaggatctccgtgatgttcttgataaggaagacgcaggcaggtcgatgcttacagcgtatttcgaggcaaacaggcagcatgtctgggctcgagatatcctttatagggatttcccaatgtggtttacttggcagacgccaggtaaatactggaaaaaaagagagaaaggaggccaggtcgggagaattgtgtgtgcccacccggcagagggggagcgttactattttcgggtgctgctaaaccatgtggcaggctccacctcattcgaagacctacgtattgttgatggcgtggtcatgccttcgttccgtgctgcagctgaaagaaggggtcttatagaggcagacaacaccctcgacgagtgccttacggaggccggggtcttccagatgccactgtcgctacgcaggttattcgctaccatattggtgtattgcgaacctagcgatgtccgtggtctttgggacaaacatctagatgccatgtctgatgactacaagcgtaacaacacatgccctcatgttgtccaacagatggtgctgatagatatccgaggcatgctacaatcaatgggaaaggaaatcacatcgtttccgctccctgaaattgacgaatcacatgatagtaccagaggagatcccagagagattattgaggagtcatccattggtgtggagacggacgatatgaacctctcagaccagctcaatgatgagcaaaggtctgcattcaacaaaatcatgaatgcagttggcagtgctcaggggggtgttttcttcgtagatggcccaggaggcacgaggaagactttcctgtatagggcgctgctagctacggttcgcggcaaaggagatatagcggtggcaaccgcgacgtcgggtgttgcagcttctataatgcctggaggccggaccgcacattcgcggttcaagatccccctcaacattgaggaagggtcttattgcagcttcaccaaacaaagtgggacggcgaagcttctccagatggcgtcgcttataatatgggatgagacctccatgacaaagaggcaagcggttgaggccctcaatatgagcatgagagatataatgggttgcccgcattctccgtttggagggaagacgattgtgtttggaggggatttcaggcaggtgctcccggtcattaggaagggcactaggtctcagataacagatgccactctacgcaggtcctatctttgggattgtatggttcaattgaagcttgttcgcaatatgagggcgtagagcgacacgtggtttgcggactacctccttcgagttgggaatggaaccaaggaggtgaacaaggaaggactcataggccttccttcggatatttgcgtgtcgtgcaaagggaatgaaacagacctcaaaaggctcatcgataccgtgttccccaacctaaacgataacctgacggacccaaactacatcacatgtagggccatattgtccactcggaatgagttcgtcgatcgaataaacatgaagatgattgagcggtttagaggggatgtgatgacatatcatagttttgattgagtagaggatgaccctcataactattacccgccagaattcttgaactctctaactccaaatgggctacctccgcatgtgcccttaagctgaagataaactgccccatcatgcttttgaggaacattgacccagccaacgggctttgcaatgggacaaggctggtggttcgtcagttcggaaaaaatgctattgacgcggagattgttgtagggcagcatgctggaaagagagttttccttcctcggatacctctatgtccttctgatgatgagatgtttccgtttcgcttcaagaggaagcaatttccggttagattgagctttgcattgaccatcaataaggcgcagggtcaaaccattccaaatgcaggcgtctacttaccacagcctgtcttctctcatggtcaactatacgtcgcgctgtctagagcaacctctagaacaaacataaaaatactatcgatgccggtagaagacaagaaacaaaataaaaagtctaagcgtactggcgtgaaggacaatgagaagaaaggaaaggaattgtctaaacaggctgcaacatacacaaaaaaatattgtgtttagagaggtcctcacggattagaaaaggtatattatgtgactaattaaccgtccacaatatgcttgcttaaattccattcttactgctgagtgtttcttcacagtttagttcacgtatggctttgtat

SEQ ID NO: 90238 - DNA, 2273 bp, Oryza sativa
atagagcatctcctccacacagtgtagtccatcagaattctcatgcgcatgtgaaccgtgctggtcatgaagcctccattaagcaatcttcagaaaatgctaatggttctgcatcagatgtttcaaggttatctcttgcaggttctgaaacaagagagtctagtctggaagaaagaaatgctggttctatcggtcaaacttcagaacagtcaattgaggaagcatttcaagcatctaatttggacagggattcacatgaccatgtgggtagttcttcggtgaatggtagccttccaaatagcggtcaacttgatgcagaatgtgacaatgggccaagcgaaaggacaaattacagtagtgatgcatctggagaagttacagatgggccttcagcatcttctgctcctcagagggagcatctaatcccttctagattggctgatgttcgtagtagaggccaatttgttcggcgaccatctgaaaggggtttccccagaataatatcttcctcatccatggatacacggagtgatctttccgccatcgagaatcaggtccgcaagttagttgatgatttaagaagtgattctgtagatgttcaaagatcagcgacatcagatatccgccttttagctaagcacaacatggagaacaggatcatcattgcaaactgtggagctataaacttgctggttggtcttcttcattcgccagattccaaaacccaagagcatgccgtgacagcccttctgaatttgtcaatcaatgataataataagattgccattgcaaatgctgatgctgttgaccccctcatccatgtccttgagactgggaaccctgaagccaaggagaattcagcggctacattattcagtctctcggttattgaagaaaacaaagtgaggattggaagatccggtgccatcaaacctctcgtcgacctactaggaaatgggacccctcgaggaaagaaagatgcagctactgcattgtttaatttatccatattacatgagaacaaggcgcgtattgtgcaggctgacgctgtgaagtacctagttgaacttatggaccctgctgctggaatggttgacaaagctgtggctgttttggcaaaccttgctaccataccagaagggaggacagcaattggtcaagcgcgtggtattccagcccttgttgaagttgttgaactcggttcagcaagggggaaggaaaatgcggctgcagcattgcttcagctatgtacaaacagcagcagattttgcagtatagttcttcaagagggtgctgtgcctcctctagttgcattgtcacagtcaggcacgccacgggcaagagagaaggttagccatttctcatcatttcctctttcaattagaaatgcagctaagcacatcctgaacatttatgcgaaagccagacattttagtcacaatgttttgaacatgctgcttggtcttacaggcacaggctcttctcagctactttcgcagccaaaggcacgggaattcagcaaggagatgaccttctcagaattttttgtaggtatacattaagcatctcctctgattccttcaggcatcggcttggctcctcatattgttgttgttggctcttgggtggccctatgtattgtttatagtcaaattgagattgtgctcatgtcatacaaatgttgtgagcgatgggttgggtgtttgttgttgagatggtgtaacttttggttctcttttcttttttgaaggatatctttgttcttgtataggttgtccattggtagcaacttacctattcaatgggattttgctttgtatatgctattaaccctgacattatgattgttttgaatggttgtaaaattcgatattgccctgcatgttgtaccagataacaaagcttcatctgctccgatgcttttcgtcatggcgacccttgaaatcgggatatgagaatttcatggcagtcctgagataattataattacagtctaacgcaataaggccgtgtttagttcccccaaatttctaactttccatcacatcgaaaactttcctacacacaaactatcaactttttcttcaaactaccaactttctccaacttttcaactttttcatcatctaaacacaagcttaacatcattttgcaacgtgctcctagtatgtggtatccccataaaaccagattgatcaactacacaggaaagtttgtattcctgttccaaccaaaatatctactactcttctgaacaactactacttatctag

SEQ ID NO: 90239 - DNA, 4010 bp, Oryza sativa
tttcagccattttactgggcagtttttatgcctcctgaacagagcacagatgatcttgtactaacatttaaatctgcatctcaataatttctaaaagccttgtattagtcgtaaaaggaacagggtatgagcactaagaaatattatgtagactagagaaggactataaaatggtatctgagtttgtgtaaatgtaaaccaaagctgagtttttatgcctcctgaacagagcacagatgatcttgtactaacatttaaatctgcatctcaataatttctaaaagccttgtattagtcgtaaaaggaacagggtatgagcactaagaaatattatgtagactagagaaggactataaaatggtatctgagtttgtgtaaatgtaaaccaaagcagacatcacaaaaggttggttgctagtccagaaaaaactgcatataagcagaactattgtcaaagttaacataccaataccaatgcgaacattccgcagggacaagaaaactcctaagggggatccaacagcatagaatgtgtcaacctgaatagccaaaaatggtgtaagcagcataatgatgtacaagtaaatagattattggatattgatttaggacagactaccttaaaatttagtttagtgtatctgatgtgtggtgtgtaggactcactcgtgcttccttgccctatgcggtttttgcctgatgataggttcactgcatgagtggcacttttacctgatataaacatgcaaataaaccttaaggaagtgcaggtgtattgaatattcgaatataacagaccaaacacaaacaatcaccttgatgagactcagcactgctttcagtcaccaaatcattatgttgttcaagttgtgctaatctagctttaaggcgttccacctacagtaagggcagaagtgcagggatcaatttgatatgcaagtttatctctcgctgttactttgcttcaagataacactatcagttagggtgttgcaatgagttcttgcattctattttatacattactgttgaccatttctcccaaggcaaccaacatttagcttgcttatcaagatagatgaatagaagatggcaggtacattataagttagataaatttgataatgccacacctcttctttcaatgatgatatcaatgtatctttgtcagggacatccgcatggactccctcagcagatcttgaaatgatacaactgtcaatgtcttttgctcttacagatgaattgtccccttcttcactgcatgcaattttatgattgtcgacctgtttttcgacttcaatttgttctccatctactgctgtaggtagtgcatctgtggtaagtttcggtgaattttcaagtgcacatgttgggagggtggtgtcctctgtacatgaagtgccagttctggtgctcccttcatcaactacatcatttacattatcagcacaagaatgcccagaaatggaagatgtatcttgctccttcatgactgattcatgtgcagtaactgtgtcaggcgattttgctatgtgaccttcatcagaagaaacttccatattcatataatctactggaaatggtgcagaagaagattcttggtggcaaagtatgtcataagatagaacacttcctaacgagtgcccatatattgaaacctgcaaaaacaagaaaggaacacataagtttttttgtttaaccattagcagaaatgcaagtgcactcctaaagatatttccgaagggtgatgtgtgcaaacctttccactataaccaggatttctcttgataaactttgtgtacaactggttcaactggtttgagacctgttgcagacttaaatcctcaattttatataacgagtaaaaaatatgcttccagtcattacgatcaaaatttttgaacagtacaggaaatggcacataattatttagcgtatttttcggaaagggtgaatctgaaccatccaagtcattagactttacttttttcttcaaatttaaattaaaccataaaaatgcatagagaaatcccactattacatacaggcccacaaggctcctaacatagtaatatgcacttaagggaaaagaaggaaattggaacaggcagatgggatgactgagtagaactggatgttggcaatgttcacttcagatcatatggataaacagcaatgtcaacagcaggggcatcaaacattcaatttaacattcacatatttatcaattaataaaggatatgtgtcaaaagcagtaaatatttcagtaagctgatttgtttccaattaaggaacgaacgatgattgctaacctaactgagttttccatcaagccaaatgcccatgccatgcaacataatacgatatgttttactatagtgtattaatgtgtacagaatcattggactacatatattgggagggtatatgcagagaagttcaccagaaaatgcttaattggtgggaggtaggtgacaggggtagttattcatttcatttttttctgagaagtggggtttggaatgtggatattatttaggcagagaagtagctggacaacctccctctttgtaatattagatagaaaagtaacaactttccatatgagaaaaggaacacagtgtttgattcatttctgaaatcttactagaaaaattcatcagcaatctattagttccacaactccatgacagtgtactctagttcacctattatgttcccacccaacatgtgggctttaatgcatgtttttatgcagcatttatttgaagccggatgctagaacagcaaatatactcataatgcttgaaaaaggactactaagaaaacctaaaacaccgaaatactatcaacgaaactacagaaatggctaaaagcagtgttacaataaagcaacataccgagtcaattatgtgctgacagtatataggactcatgtaatacagaacatcatgaactgtggcacctaatgctacacgaagacctttaactccatccaaagtgattttctcaaccgattgttcaccactgagctttaggctctttctccactgcaataaaacatcagggttaaaaactcaagttgccggtaattatggagatgcagctagatgccaggtgccatatgatggtattttaatctgaaaaacatgcttttattataactagatacataaaagaaatttctggctaacttaacaactgagttcagatgcaataaagatcatgacatgtgtgcacaagtgtacaaataaattgtggtgcccgtgagcatttgatagtaaaatatatctcacttttctgatcaatgaccaaaattcaaaactacaatttgcatctctcgcttttgttcaatggccaccattcaaaataaagactgtcaagttattgtggttatagcgtatggtaaagtagttcaaaacgagaccaagcatatgtcaactcacttttctgatagtaataaatatatctcactttcctgatcaatggccaaaattcaaaactaccatttgcatctctcgcttttgctcaatggtcaccattcaaaagtaaagactgtcaagttaatgtggttgtaacgtatggtaaagtagttcaaaacaagaccaagcatatgtcaactcagcatgcctgaatatggagttaaaggcttgctttatcatgctaaagcaagaacaagtatttttcttatctgaaatgaggcacaagaatgacatacatttcaaccaaaatgagtctatggcatgagtaactttgagttcttacctgacaaggaataaacagaaccctctgggtacttctttgataaggagttaagtatctttcagctaaattagcagttacacggcggaaatcaacaacatcatcaacaagattagctttctccaacctctggccaatgccatgaaccataaatactagatgaccaactggaacctaccaagagacaaccacaacaaataatcaatttgccaaccttgtagattatggatgagaacttttatgta

SEQ ID NO: 90240 - DNA, 2704 bp, Oryza sativa
aagctgatcccacagttttgtacatggctccgccactctatattgcacttcaaaattagaagcaaaaactattgagtaccaagcaagttcaactcctaactaattcaattatttaccaaatgtttctcacaaaaaaaacagcacgagggtaccatttgattttttttttaaatgcaaaaaaataatgcaataacgtgctagaatagtttgtcacattgttggccttcagctggttgtaaaaaatgatgttacatattgactttgtacagtttacctcaggagtagcaagatagcactatcagattaaattctcaataggatatggctgcaattagttttcaatcatgcctctatagctctattgcagtccacacagaagttcccatttagtgtttgtaaaagaatcaagatccaacctcaatttgtacattctctcagtcattcatgcacaacagatgaaaatagtaggtacaaaaaataaaatactgaaacatggcaaaagcatcaacattcaacagggcagctgacctgtgtaggcttcgctgatccagaagatgaaaacccacgccttaatttgattgtgttgccacctagcttaggaccagtatcaaagaccagccaagcttcccaggtatcatcctctccagtaaaaagagcatgcaagtcctgcacagattattcagccttgtcctaagttgccattctctcttttctgagcaagtcatgctgttacaacagtatatcacataccggggtgcttccttggagatcaacacgtgctgcaaataagcctgaaggttgaaatttacggcgatgccatacctatttttttttacaacaaaacaggatgttcaactgctttatgggcatggaaatcaaagaggggagtatgataggaaccaaaactaactcaagaacatgataaaagcaaaagatggtatatccacaccgcagatcataccatggcatacatagctaaattcaagtgatgattatcttcatctcattgaatgcatttacagtattcgactggagaagaaagtgtggtatctttttctagaacaagtgtatttgtagtgatagcaaattggcattccatgaaatggctttctaatagtacaagaaagatgatagcgaataatattctcatggcatctttttacctgacaattatatgctagctcaagttgttcagaaacatcttcacgcaaggggatccaatcaagccctcctttgcgagcaaaccagtggcccctcaagacacgcctgttctccccattccagtacacagggaagcaatgacgtctcattaaatcgacctgcaacagtgtatgttcttataacaaagacatattcaatatctagcatgctagtagtaaaaaagaacagaaaagttatacagtattacaggtgtgtgacagagctaaaaaaattcacttagtccacaatcttacttctactagatcaacaataacaagtacagtgtccactaaaaaataacaagaagaatgtaaatatgtataaatagctttgcttcggcgaataactaacaaaactcatgcgtcgtgaatccagttgtgaacaaactacaagacaaaaaatacaaacctcataaagtccgcctttcacaggaaccccaacccgttcttcctccaccttatacagacttttagaatccgaagcatcagctgcaactaaggaaccttttggcccttcgctgcactcggcgtactctctccaccagtatgcaagcagagcttcctccctctacaaaccagtaaaccagtattgtgatcctgaagttaagtggtttaaaaagagtgagagaggatataatcccccttatattgtagagggactagtacagctctcttggaactagattgtctagtaatatcgcttttcaagcggattgtttctattactgttactacagtccagtcttaccatataaatgactaaaatgagtaaacactaagcaattgacaatggtgttaaagagagaacctccaagaaggacgcctccaatgcaagagagtctctcatgctgaaccggaagtagtccccttttcccactatctctgtccgtggaactgaagcagagagcgctgcatcaacagcgaattgcacaaaacataagatcagtaagacatttatcacacgcttcataagtttaaagtccaaaccgatgatcaatttaattgagcacagcagttctgaagtatgaagacatgccacggtcaaatatgaatctaatgtaaatgagcattgcttcgaatggcgagttcaatcagcgaattcaatagcgcatgcatgtgaacacttgtctaaaccacactaccctatcaattagtagattcaaatcagcaacagtctcacacatcaaacctacattctagctaccgctgattaaccacgagtgactgaatcggacggttaaattggtggcactgggtgtagcattccgaagcagacgagtctgagaggtgagcggatgcacgcacctttgtcggcgaggggcagcttgcagaagtaccagcggacatcctcgccggccgaggggctcttggtgcgggcgaggtacttgcggcgagcggcgcagtgctcgatggcgtcctccagcctcgcgatgttggagggcgtgttcctctacgagtccggcgacgcgccggcatccacggtcccgggggccgcctggctcgtg

SEQ ID NO: 90241 - DNA, 9051 bp, Oryza sativa
gagctcgcgcagcgccctgtgtggcaggtcggcgtggcgcgacagcaggacgtggtgcaggctcccgacgagcggcagctgccacggccccggcggcagccgcagcttcttcttctccttctccggcggaggccaccaggagcggcatgagttcttgatgttgacgaggacgaagagcaggaggaaggcgaggacgacgccgatcagcaatggcagtgatacctccatcttgcaatttctcactatggctgtcgctgtcgctgctgctcctccgtctcaagaaggactccttcgccgtgttgtgaaattttcagcagaggtgacgaattacgaagtggactcgctcttggcttctttgaagcgattgctacccaatcttagtttttgggtgtcgtcttcctccaggagaacgggagaagtgtgggggtttcttgttcgcagaatcgcagcgtggaaatttactcgtatttgtgggcgcgtgctctgctctagcgaacgtgacggtgactagtatttgtttgttcatgttttcgctttcactgcttcaaacaattatgagggttccaaggtaacgtgtggtttgtagcatcccgaattccattcccttattgtttagctctagctagcatggtgcactatcgtatatatatattttttctcacgtagcattatgtatttttttatgttttattataattaaaatatattaaaatcctaacataattttaaattctatactaacctgacaaaactaatcaatgcgtaatattcatattgtattatggtagaaaaaaatgctcgtgcattgcaacaggtgaagacgtttttttagtggtacaatagctattaagagctgaacaataaattgaaacattgaaacattaggattgttacatatacattataattgaaaaaaattaatggccattcattcttggttttgggccgaaagcccattccttcctttttagcccgaggctagtccactatctccctccgcttggccatcctctctctttgtccgagcaaccgagcctatagtggagccgcctgtccagcttgcacagcaactgtcgtcttcaacctccgaaagacagtcctgagcctctatgccagagtcgatcatctccatcaaatccagccgaatccttctcaatctcccaaaattggtttagggcttttgatccactcaatctcgtcttccccctttttccccccaaaaacgaagcgaaactcgggataaaaacagctatgaaagctcgttggccagccatcatcggcaactaaaattaaatccggcaaattaaagacgagttgaaatgggaaatcatgaggaaaatgatgatgatgattggggaatcgatttttgcaatcaattggaagaaaaaaaaacaatccacaaaattgtttttgtgggcgagaacgcaccacaaccatcgttcttgtgggatggtgacaccgccacaactcattcttgtagttttgacactcaagtaacttgagatgcaagaggaagaaggaaatgctcaaatttgagacaagatcatgaaagaaactataggaggaggagaaacactcaagagcaaactactgcaacttggttcggggcaatgagagctagcaatggtcatggggtagcttttataggggagagccacccctggttcggccgagccagggggttggccgaccccaagtgggcacctatgctgccctctattcaaggtaagaataatgacacccttgttgaaggaaaacatggcgccctgggaaatatgcttcactctagtgcaggtccaaggcttgtgttgagtgtcaagagcgtaccagctggtttgatcctgcaaccagcaagaaagataataaaccgtaattagatgaatgatagccgatcgaccgatagagccgatgacgtatagtcgggaccagccgatacgggcaaaccaaatcggttgtggctttatgatagacaaataaagcaaaaccctaaatatgccatatcggctgtaatactatctcttttgtttttgtcgattgccttaagacaatattataaaaatagccaatagatcaatatttagaacaaagatagataatgtactagctaataatccaatacaaacttatataataaatcaatctatataaacatgtcaaatagcaatcgatcaccaaatatagagtttactcgagatcaatctaacttgatatatttatatagagcaatctatctatataaatggcaaacatacataaaacagatcatgaaacatgcattatcatgcatattaggtaaaatcggctgaaaccccgatactatccttagttatgattaattctaggttagtttttagggctctagacaatactagggttgatgcaactcaaagtaaataaagaaaccacaagtctaaacaatcaagaaattaaccacttttcacgatggtagataccttagctaatctaatctagtaaagcgatttagccgataccggcataaaccctaaagcgagaatcaactgatatgactaaattgagatactaaaactaaattaattaagataatgtgataacaatggtcacgataaaaggactaatacatataaagcaacataatagccctgatagtgcaagccatcgagacaagttacctcttgtcgagagatcgtagtcgatgccctgacttgaagcaaagaactcatcgaaaagcaaaaagaaaagggtggtgatgcaccaaaagttgtattgattggattgttgtctcctattacaacgatatgggctttatatttataccctcagtgcaaaacttgtccattctggacatgattcaaactttcctaaagataaaatacaaacaagtccacatggcggactcttaccatatctctaattcaatccgacattaatatcctagtgatgtccatcattcgaattcccatagatgatggtaaagattttcctcgtcgagacaagaaaaaggattttcctgaaccatgcttattaattcgggacgaatctcaaagccagttgtaaaaattggctccgatgaaggaggtgctcgtaagattcaccccgcggagcagataattgaaaattgatgatggctccattggtcgagaaggttttacaggaattcttctctcggatagcaggggttaaggtagaagaaaaaaaataaaaaaggatatgaggatgaacaaggctcagagataaatagcaaccgttccccggcaacggcgccagaattgcttgttggtatttcttaaccttacagataaaattcgcaagcgcacggagacccttggctaccgattccaagagtgtagcatcattgcgccgagtatcatgctcctcctgtggttgcatcgtagaacaaaagtggagccaataggaagacatgaagataatctacatagggtcagataattgtttaccattaaaaatattatcattacgacaacgccaaattaaccaacacatacaatactagttccaaatagaatcatctttttaatggacgtagatacccctctaagctaattaccaaaaatatttttggtgttacggggtggaggaatgttaaaagcaaaaaaacacacatctccaaacaaattgagcaacatgacactcaaagaaaagatgttggattgtcttttatgcatagcagaaagaatagtgcttgtccccctccctaaacaaattttcttttagtcaggttatctttcgatagaattattttcttgtgaaaaaaccacataaagaccttgatctttagtggaaccttgaagtcccatagaattctcttttggatccgaacattagagttcatgatcgtggtatacatagagttgactgaaaattggccattcttatgtagcgaccatacaaaacagtccttttcatttgacagagttatattagaaagcctggggatcaaatcgtttcactcgattagattttaaccaacaatggctctcctaaaagaaatatcctgcgacattgtgcccataacctctgccacggtagactgcttctttcgagctacattatataaagtagggtattgaacttcgagagcacgcgattccaaccacgtgtcttcccaaagtcttatatctgtcccattgcattatctaaaagacccaaatctaagaaattggtctttaactttcattaaaccggcccagaactaagaaatacctatcttgctggacataccagagaatgatttaccatttaagtctttattttgcaaaaggtcttgccatacgccttcaccattaagcaactagaaaatccaattgcttaataagtagctaattttgatatcaatgttatggacacatagtccaccttgatgttttggtcgacatatgttttcccacttagttagtctatatttttcttttccggtcatcattactccaaaagaaagtgacataaagaaatataatctttaaaacacacctagtggaatttcaaagaaagataacataaacagagaaaggctcgaaataactgagtttagaaggaccaatctcccaccgtatgatatgtttttgccctttcatgtgctgagttttctctcaaatctatctttaactcctttccaatcaacattccggagttttcgataatgaataggaaaaccaagatatttaaaggggaaagatctagaattacaacaaaatagttgtctatattgatcctccacttccttggcctccccaaagcaaaaaatctcacttttatgaaagtttattttcagctctaagagttgttcgaacacatacgggatgaccttcatgttttttggcctgttcaaggtcatgatctagaaaaaatattgtatcattggcatattgtagaatggacaaaccatcctccactaaatgtggaatgagtcctcgaatttgaccgtcgactttagctctctcaatgagaaccgctaacatatcaaccacaatatttaaaagtataggtgacattggatcccttgtcgcagggctatgtgcgtttcaaatttattacccaaatcatcattgacttttatacggacacttccctcttcaaccattctagaaatccagtgacaccactgctgagaaaatcccttcatgcgtagtgttattttcagaaaatttgaattgtagtgaagtcattttggaccattttagcatgaagctgcctaaccatctttgaaacacgcaacacaagtttcttgctcctgttctggttttgggccacatgatcagggtttccattggctaataacaacaggggaaaaaacaaatccattcagtcaggcatatacatgacaaagcacaagtcacacatcgataaaaaaaatccaatcaagaaaatcgaaaatcccaaggaaaggagaaaaaggaacagaaaacgtgaaggagatacatccatctatgtgtctctcttctcatcccgttctcgagatcaaaggcatggaaaaaagagacagtcaactcgtctagatcaaaggcattgaaaaagaaacaatcaactcgcctagatcaaaggcatggaaaaaagacagacaacttgctatatggagccatcctcatccaagaggggcacacagaatcacggtgatgctatataactggcttcattgcctcttgggttggacctgttgatggaggctgcaaattaaactcccgatgagtggtgcatagtcttgggcatgattactagcgtgagagtaggagaaggcgtgagcgatggccggcgtgggaggacacggcactgatgcactgtcgagggaaagagacagagaggcgcgttggattaattctcgatgtaaggtgagggggtttgtagatgagaccaacttgtatatgcctaaatttgaggacatgggattaagtcagtcgagctgagctaggctctccggttctctaaagttaaagttcaagcgcaactcaattatactaggcattttacactttttttttctgaaacagtagggcgaccaccctttccatttcttgtttttttaaggaaaacaacggcagaaggactgccggaatatattaggagaaataaaatttatgttcaggcaaacataaaaagggcaaacaaaattatttacaagagaaacatcaagggggttcgaaggccgtatggcacagatcgagatcctgttgaattagggaagtcactttgtcggtcgtcgtgcatatattttgaaaaatatgttgattccactccaaccaaatgttcaaccagaaggtgattaggcaccctagagttcttttttgctggggttttggtcgaatggctgagagcaaattccaccaactttttaaatctaaggtgttaggcaaagtattttgacctaaacccttccaaacacaaatcttgttccacacgtcgatgaagattttgcgcggtttagagttttttggtatagaatgagccagccaagaaagcgatgttttggcttagtaggagctgaccagattttcgtaaaatcggtggtggcgaatatgccctgaaattgcatgctttttgaggtgtaaattccgttagatgagaacttccaaaggatatcatctggcaaacttgaaaagaggtgcatgttctgaatgagggctcctagagaaataaatgcatggatctcctcaattgtagtaatctaccgaaaggagaagatccaattattgttagtcagctcgtgatgcactgtatttctttttcgttttactaagctgaaaagccttggagtaaggtgttttgggcattggtttgagagccagttgtcatcccaaaacaacgcttttttttccatctcctagcacgatctctgtagcaacttggaaaagactcttgtcaacattgtcacaaggcaactctgagcccaaccaaggcttgttttcctccttccaactgaaccaagaaaagcgaagacgaatggctctagagaacttgttgaggtctacacttccgaggcctcctaaatttttcggcatgcaaactgtgctccaattaactaggctgtttcctgcgctgatattctcggggtcgtctcttttccaaaggaatgctctacaaaaacgatcaatgtgtttaataaccaacttaggtgtttgggttcctatcatatgatatattggaaggacggtgagaactgatttaacaagagtttcacggttttctgaagtgaaaaactttcctttccaacctggtaagcgtgcaccaaatttgtcaatcaagggaatgaagtccactttcctcagtttgcacgtatgcagcgtcaaacctaaataggggcaggggaaagtttttattgaccccaggagaacttgcgttatatcttgaacatccaccccctcacaagctattgggaatatttcagtctttttaatgttggtgtgcagaccgtatgctctggcaaatgaaattaaaatctggcacaacatgtcgagatcttgttttgttggcttgacaaaaatagcaacatcatcatcataaagagaacagcgaaaacggctcattttgtttgacaccggtatgagaatagacaattcttcagctttacgaatcattctttgcagcggttccatgacaagaataaataggagaggtgaaaggtaatcaccttgtcttaaacctctgcaatgctttatttcctctcctggtgaaccattgaggagaatctttgaagaggaggcaagcaaatttgagacccaattgtgccatcttgtttcgaagccaaaacgttgtaggacttccagcaggaaagaccagcttaccaggttcatttctattaacagaaatggcagactaccaggttcattattacagctgaaattgaaagacaatgcaagaaaactataatgacatctatgtgataccatctcatcacacaaagatatatagccgctgaaattaacgtaagttcaggaattcatcccgctagaactactaagatctagcaacctagcactctcatcaagcagttcaggattatcacagtccagaacacaatagaaatgcgccatcctgcctcaaaaaaccatctcagcaaccatatttctcttgctttcctagaaatctcctctttcactgcaactttctgatgccccatctccagctgtattttcctatttggtgatgtagatttcattgctactcgcttagcagcggttctccccttgtctgcgacttcttcagaagtgaccaggacgaaatccatggcaaatagcgaacgtaattcaactggtaggttctttgtggtggaatcagcccacctgcgttcaaattctagatttaatatgggttctcatatttacggctatttattctttcagtggtggacgacgtactccttgacagcgaggcgcccgtggtgacttcatcatataataaacaggggcaaaagagtagttttaactttaattaaataaaattggcaatttatatatattagctttctcttatgtgacatttctggatgacgtactcctcgaccgcgagatgtccatggtaacttcatcatataataaacaggggcaaaagagtaattttaactttaattaaaaaaattggcaatttatatatagtagctttcccttttgtgacatttctggacgacgtactcctcgaccgcgaggcgctcgtggtgacttcatcatataaaaataggggcaaaagagtaattttaactttaattagataaaattgccaatttatatatattagctttctctcatgtggcatttctgtaatgaaatttggaagagtggtatctcaagagtgccactatgtaagagtggtagttaataacccccctcccacccaagaatagctgcaagacgcataacaccagttattttctctctttgctaaactatttatttcggcgataggcaaaagcttttcacataaatattttcgaagaatagcatacaaccgtgacataccgaggcggtcattggcaggttaggaggagcgcatagcccattgaacataagctactctaaaccaagcgaagctcctaatataagctaagacagagagaaagaagcg

SEQ ID NO: 90242 - DNA, 4360 bp, Oryza sativa
caataaatgttctcattatctattattatttcttctattgaaatgctccgaaagaacgcttcaaaaagtaaagttagatgaacacaaagatataggtgcaatatgttttctgtatttctgtattgtactattcagaatttctgatccatccctgcttgtactgaactcttagctagttattcttgatcagctaaattcaatgagtgacatttgtaacaggatatgatcgagaatgtactagagataaaagatacacacgtcagggaggtaatgacgcctctggtggatgtagttgcaattgatgctaccgcaacactgattgatttcaaaaacttatgggaaactcatcagtactctaggtatctcagctgtgaacttttagtatgcatcttcaattcttgttgttgacatgtgcagctcttacttccagagttccagtgtttgaggaacgcatagataatattgttggaattgcttacgccatggatatgcttgagtatgttgaagaggtctgtctcttgtttaccatttgaatttttaaagtagaaaaggatgagtaggtgactcttatttgttcggattaaggattttctgaagaaagatgcattttgatttgaaggttgagaagttgaaggagattactgtgaaggaaattgcacatatgcccacatactttgttccaggtaaactttcacgaatgatactcattacaaaaatgtccattgataaatctaaaggcagatacagaacattacaagtatttgagtactgtcctttttcagcatccatctaacctatttattttctatttcaatggattttttcaaatccagatttgtgtagggcattgcattctttatgtcttaatgtttcctctggtccacatgtcattatgtaaaaatgtgatattttgtcttgacagattcaatgtctgtttggaacttgctaagagagtttcgcatcaggcaggttcatatggcagtggtcctcaacgaatatggtgggactattggtgtaagattttattaaccaatcctttgttccttgtactttctcaaaatagaattgactttctacttatagttcttattattgattccatttatcattggttatttgaaggggatcttttaattcatatttggtcaaataactggaaattcaatatttttagctcaacttagacacctttgctctttcatggtttgttgttcgataggaaaatcattttgttctctccaatctgcacagttcagtttcacctggtttctctgaaatataaaaataaagattgttttctcttttgttttgaacaaaacaccccagaggagtcctctgctgttatatgaagatcttttttttgttttgcttcacgaatttgttatattataactaatgattagatgttccaaactagagtagtatccaaaccaagaaagcaagaataaaatggactgtagtattcacaatctagctgacaaggcaagaataaacaaaatgagggtgtaacagggatgaaccaacctgattgcagaaagagggcaggttctggtttacgtgacagtaactgcctgactgtagttggttttatgaaccttgcttgccagcattttgatgggacagtgagtggtctgtatattcggaaccgcagatgtgtggcaatatttggagggaggattgacaattttccacactcatctttggcaattgaggattttccactacatatatccttgtcccacatgtcatatcagtggcaaattctcaattgccaactatcaggagtggcagagccttgtatcccaatattattgacattatttttaggttgtgttatatatccatagtttattgtcaatttttatatgcaaatacctcttgcaagttgtagggtcaaacgtgtttactctttacaacgatctgaaatcaaaatcattaaacatctttacagcacaaatacattcagcaactattactctatattgtacttgttgggaattaaacatgccttctggatgaaactcagttttattgtaaggtttcctatttcattaaataattattcacactcttgcaccagctttgtcctatgttctgtgaataatcagaaacagcttctgttcattacttatcccatgcatctcttactttcggaagtctctctgactagtgactactgctaaaaaattgcagattgtaacattagaagatgttgtggaagaaatagttggagaaatcttcgatgagaatgattcaaaggttggctatttcagtggtccttttgatttaaattttacaattcagagtctaatgccatttaccacacgctgtatggaagtgatatttgatttctgcttttcttttctctgatcacactaatccctccatctgtgtagcaaatcaaatgctaatcatcttgtataaggatttcatgagagaaagaaaacttaagcacacgtgctattatgactttgtgaacattcttataatcactgcagtagtacaactttcaagctcttagtatttatgtgtttgcattgtcttaagagttagtgtgttccataattagccttattaattagatcctggtcagttacatcccggtttgatggaaatcatccagcaactatctagtgccaattcttataattaatactacctccatcccaaaatgtttctatttctagcacagtacattgtcccaaaatgaatctatttctccacctacctcctcaaccaatcacaaccattctccttcacctactttctcttttcaaccaatcacaacctttcttcaatcattcccacctactttcctaatgcttgtgccaatctaaacaatgcttacattttgggatggaggaagtactatgtaatggtgggaatcaactggcatcatgaagaatcattctgaattaacataactcaagagtatcataaaaacttggcattgaagttgtcaaactggcagggatgaagtgctctgcctctgctactgtttgagctataactgcctgattcttgccagttctcttagttttaagtcataacaacatattgcatttagtagaccatgatccattttgctactcttttgcttaagtagacagttgtacccatttccttatgctactatgtttttacctttgcaggaggaaatccagaagaaaacaggttatatagtgatgctggatgacggaacatttgacgttgatgcaaatacatcaatagaccacctatctgaagaacttggtgttaaaataccagaggtgttatttcttgtttggtctttgctttttctacagttgctgtttacttctacagtcactataagtgttattttggacattgccatggcaatcaaattggaatcttggtcaccaacatatcttgaaaatctagcaaaaaatattatattttattttccaaggcaaaatcatttatatgatcgttataaataatattcaaataatttaactaaatgttcccatggtgacacatttctcactggagttaactatatgtgctccaagggtaaataaatgcattttccacatatcatatgcaacttgatatattcgaatcagttcatcccatatttccatatgtaaggcctatctcctgtggctgttccttcttattcttgaatatgaaatcctgttaatcattataatatcaatttcaagagttatcttgaacacatcaagtttgtctcgagctaattcctgaggattgagtgcttcttcatttacttaacagagctgattgagtgctttgagatttcttctgaattgtcaataacacatcttgctaggtgttagctttagaatgatatatgccacttggcttatattaagcatagttttcttaagtggaatgtgctactgcaatcaccatatgctggatatgaggttcacttggaatttggaaatgcatttgtttgcagggtcatcagtatgagacggtgtctggttttgtctgtgaatcctttggttatataccagaagaaggtgggaaaatgctagttatactcgaaaaggataacagagaagaaaatgatgaatataaagaagaaggatctgataaccaagatgataaagaaagaactcaggcttatgaacttgaggtaagtggtacaatcctctgtttacaatttgtttgcagcagggtcagacactaggtctctagtagagatgtatattagctagtgtttctaagatcattctagattttttttttttgccaacaccatcctggattatgtttgccaagtcctccgactagaaacaatgatgaataatcgctatatacacccctagggtctttacttcctacatgatttaaaatgattgttggtata

SEQ ID NO: 90243 - DNA, 1028 bp, Oryza sativa
gaatgtatgttcaagaatttggtgcagaatgctcctacccgaaccagcgtcgtgtttatttgtcatacctggattctgttaaatacttcaggcctgagattagaacggtgtctggagaggcgttacgtacatttgtttatcatgaaattctggtaatgttctatgtttgctgagtttttctaaatttaaatgcgttgttttgccaggctggtcatactatttttgtatgcaactctttgggggggattctgccttcctccttaggctagcgtttttctgcactatctaatgctaggtctctatgtgttcagataggatatcttgaatattgcaagcagcgtggattcacaagctgttacatatgggcgtgcccacctttaaaaggtgaagattacattttgtactgccatcctgagattcagaagactccaaaatccgacaaattgagggagtggtaagacctttgttgacacttctgttactctgctcacttttagctcttctagtttacatgatttctgatgtactttacactcaggtacttatctatgcttcgaaaagctaccaaggaggagattgttgttgagctgacaaatctatatgaccatttcttcattactatgggggagtgcaaggctaaagtgactgcttctcgtttgccttactttgatggagattattggccaggagctgcagaagatatgatcaatcaacttcgtcaagaagaagatgaccggaagcagcagaagaagggcaagacaaagaagattattacaaaaagagctcttaaagctgctggccacaccgatctcagtgggaatgcttccaaggatgctatgctgatgcacaaggtaggattgtacagtggtttgcgtgctccttattttgatagatcacatggctgctagcactctacccctctttccctttctatcatccttgctcagtatttgtttttttcactttactggatggcatctttaccatgaacttgatttgttatgtgcagcttggggaaaccatttatc

SEQ ID NO: 90244 - DNA, 661 bp, Oryza sativa
cagaattgtggacaactaagttcaatggcatttaggcaagagcaactatggttcaatgcaaatgaaagaataccttggcatgagaagcttgatggtgaagaggctttgcaaaagcgtgtccatgagtaagaaccaatcatgccaccttttattttatgaaattttaacacatctggcctatttgtttgtgccacatgtttttcacaatctttgtactcaggcttgtctctcttggaaacttggaaactgcggtgtccttgttactgtcaacacctcctgaaggctcaaatttttacccaaatgcattaagagcagttgtattgtcatctgcggtatcacgatctttacatgaacttgcagtcaaggtgaacagccttagacatcgatatgatgttcttcactttggtacacagcatgtttagaaatgacacagtattaagtcatgaaatcttgtaggttgtcgcagccaatatggttagaacggacaaatcactatctggcacgcatcttctctgtgctgtgggaagatatcaggaagcatgttctcaggttttacttaacatctcagctgctacagcataaactcttattctcttttgcttaacttaattttacataagcctggtctataacctacaagctggttatgtttcagcttcaa

SEQ ID NO: 90245 - DNA, 1222 bp, Oryza sativa
gttcttggggatgttcttgccgacgatcttggcaggagcgatgcggaggaggttcccgggcttccctggaacggcgcccttgatcatgacaactttcaggtcgttgtcgatcttgacgatcttgagcttcctgatcttggtcttggttcctcccatcctcccgggcatcttcttccccttgtacacccgacccggcgtcgtcccggcaccgatcgatcccagagctctgtggctcttggagccgtgggtcatcagccctcgcttgaagttgtgcctcttgatgccacctgtgtcgatgtccaagaaccgtcagtcgcaaattgagagcatagttgcacaattatgccatattgccattagatgatcaggaactaaaagagatattggtgctcttgacttcatgagaatgctataaacgattatgttgtttggggagaaacacccaggggtcttccaactagctccacaaggtggtaggctagatgacctgggttcgaagcctcacccattctgattatttgatattaggtccttctctaatatttgtgtcttttttattatgttgtttgggaagaatatacatgaaatggataatgtttgcggtattggcaaatcgttggtcgcagcaaatcaagagcgcaattgcaacgggtttacgatgttatattcacttcatgaaaattatacaagtgatgctgatggttgcaataaattgtgaactataacgaatgtgttgacatggtacaggtctgcaactccaagaacagcattgacattgccatattggcaatgccattgtgcaagtctaggacgctaatcaagagaagaggctaaatgattcttcccaagaacaattctgtacactaacattggtgagcatatggtaaatttgatacagcaaaatttcaagcttgttctcaagtcttcctcacaatgtaaagcattgttcaaattcagacagggcgaaatggtagtcacattgtgaaaagggagtaaaaaaaaataatcaagtttactgaccttggaaccccttgccgatggacttgccggagatgtcgacgaggtcgccctccttgaacatgtcggcgaagtcgagcggctggccggggtcgtacccgtcgacggactggaggcggaactcctgcaggtggcggagcggcggcgcccctgccttgccgaggtggccgagctccgggcgggtgagcttctcctcgcggacgcc

SEQ ID NO: 90246 - DNA, 1980 bp, Oryza sativa
tgatattgatctaaccataggctacagacatgtttttggtgtctacactgggtgagaaggaaattttaaattttattagttactcacatttactggttcagattgaaatatgtggtttgagagcaagtaataggagacaaattacccagcatattttctagatcatgttttcatcatccatctccttttttctttgtttcatcttaaagttttttgtggatatatgaaatttagatatttttgcctgtcctatgaatagtactccaaaataacaataataatgggttttacagttagattgtcccttccaaaataacaacaataatgggttttacctacttctggttgaaacatctctaatttatgaattctctgacagttatgttgcagtttcatatttttaaatatagtatagtatacatataatattcaccatatttcatataccttttttgtttgacaaatttctaacatttctttgtggtgccatctcctgcagtcatttcattattgcaagtacagaagggatgaaaaccaactgtacatcttcgctgatgatagtgttcccaggtggctcacagcagcaaatcacatagattttgatactatggcaggggcagataagtttgggaacatatattttgctcgccttcctcaggatctctcagatgagattgaagaagacccaactggggggaagattaaatgggagcaagggaagttgaatggggccccaaacaaagtagaggagattgttcagtttcatgttggtgatgttgtcacatgtttgcagaaagcctctttaataccgggaggcggcgaatgtcttatttatgggactgtgatgggcagtgttggggcactgcttgcattcacctccagggaagatgttgacttcttttctcacttggagatgcatctccgccaggagcatccaccattatgtggaagagatcacatggcctacagatctgcttattttccagtgaaggtgatatattattttttttgtttagattagctagtatgtcaaccaacacagatattatcacaaatgcatatatttataacttttttaccactttgtcggatagaatatccaggtgtaaaggcagttggcagtatctgttttatgtttgatgatggagtttcgttttggtttgtttcaggatgtgattgatggtgacctctgtgagcagtttccatccctcccagctgatatgcaaaggaagattgccgatgaactcgacagaactcctggtgaaatcctgaagaagctggaggacattaggaacaaaattatctgaaagatcattgcgcatagcgaaagaactagacaaactgttgggctctcaatggctgtaaaaacagaatctcctttcctgtccgagacctagcagcttcagatccgtggcacattcaagaaataagaaaacactagggccaatcgagtggagaggtggtaaagtccttaatggtctgatttgtagaattcttggtgctaatgacctggtgtctggaattcgttgttaatggtctgatttgtatatttcttagttaacaatggctaagttgacctttcagatcgaagcgagaataggtcacataactgcatcagcatcagagtgttcttctgtaactcttagagcatgctttagcctttgtgttagtatttgctgtgatgtagttggacaagttctttgttttgatggttgactcatctgtaggctgctgctactttcatgatgtacgatagaaccttttcattttttcaggtgatactgaagcagatgtattggtgctatccaatttgattttcctgtgataatattacacttttgatgatgaaatattctactgctagtagttcaatggcatataaacaatttcatccatagattttattggctggtaaaccatatataagtgcgtctatgtacgaaaagcttaaccccccctattttcaccaatgggaacggg

SEQ ID NO: 90247 - DNA, 3124 bp, Oryza sativa
ttgtatgtcctttttatatgtgtaaataaagggacccataattataggtggttagaaaagggaacaaaatattatacttcctccgttttatattataagactttctagcattgcccatattcatatatatgttaataaatctagacatatatttgtgcctagattcattaacacctatataaatatgggcaatggtaaaaaatcttataacttgaagcggagggagaaggcctttagtgcgtgagaaacatatgttcgtactaaagaaagatactccgtatgaatgcgtttttgatacgtgtgaaagtgcatggatccatgattctactcaagatacgtgtgatacattctataatcgtaacgtcaccaatgcgtggagctggatgtgaataatctctcaagctggataaacattctataactaattacgtttaaatatcattaacataccacaggcaagcggaatctttaaccataatatcactaattagtggtaaacacatgaaaccaaagacatcctacaacatatctaaccaatacgtgcgacaaatgaaatattcaccaaaaatattctcccccctttccatcctgaattcctgatttcacgtaagtttgccactgctttataaggccatttacactacactaatgtggcattcagcccaagccgaccagttcaaagattctatgtcacatatacttctcttgtaaccaaaataggttacccattcctcgtcagagattgtcagggaggggagaggaaatcctcgctcggctaccttctcgagctagttcgttgcctccaacacggagttgggagagacgacgaccatagttgggagggacataccgggaggtcatcgtcaccgcccaatatgcatcgtcgagctccgccgccaccgctcagacccccaccaaccatcgccctcgctgccggcagatccattgagaagagggaggggagcggctcctgccaaatctactccgccggtgggagaagaagagcaaggggggttcgccgccatcccctccccgcaaaattcggtgccaccccgctaatgtcctgatcagttactactattaaactttaaagtctgcccattatttcccaaaatggaattgctgccgaaccccctggccggcaggcatgacgttttaaagtactacactctctccgtagtagcagcatatagcatctcttcttcacttcacagacatgcgaccctgcgggtgttacgctcctcgctcgcacaccacgaccaccgttcacaccacacgtgcgaaaaaaaaaggaacccgaccccgagtccctctccccaaatcctagccgttggatccccatcgcacgcgcgaaactccccccgcggctgatttttcaccgtcttccacagcggcggggcccgcggccgccacgccccccgggcccacacgtcagcgacacgcggcctcgcgttccacacacacccccggatccgcgccgatccgcgattggtcgacgacgtcttcccctcccctcctctccttccttcctccctctctctctctctctctctctctcttcaccgcgtcgctaatccccacctcgtttccacccccaaatcacaccgccgccgctgcagccgccgtcgccgcagcagctgctgtctctcccccgtgctagtgggggggcgcctcaccccgcgggtgtacggacgtgcccggagtgggggggaacgggagggggggtggggaggcttggtggtatcgggtggggcccgctcggtttctagggtttcggccgcgctgacacctcggggcctccaattcggcggcggggctccgcggtggggtggcttgctgctcccgattgccgcccgccggttctgatcgctgtgggtgttgctcttgctgctgctggtggtgctggtgctggtgctggtgttgtgctgtttatgctgaattgggttgggttcgcggtcggattcgtggaggggtagtttgcctctactgttgctgcgctctggggttggggttggagagagaggctgcttcttttggaggtgctgtaaggcgagtggcggtgcgctcgcttgctgtcgctgcgtcatccagccgtgctgcacggcgatgatttttatgctctgaggctcggctggcggcaaatatgaatgtgggacaagcggcgcacctgtccgggcagatgtcggggcaggcgccgcagactaatcaggttggtggcagtggcgtcggtggcgctgacggactgccacagcagatgcaggacgtggtgggacttgggggccttgatacccagtttttgttaatgcgcaacactatgcgcgataggatgtaagcattctattactgcggcttctttgtcgggggactatttattagtcagggtgttaattgtacggagttaatgtcgccactcttactggctgatccactgcatatctacaaaattaatgcaaggatgacgacttgctaaaattgcgctggacctatattacctgtactgccttttacgctgctgtagttatttgcttctcaaactgtaaagtggaggataattataggactactgttatcgcttttgcgtcgcggatacatgggggctctgggtttagtttgatccccatccatattaccacaatttaggccttctgctgatggtttgagtgcaataggaggtgaagatagattttttgatctgatacttgtttgtaaactggcagattcgaatatataggaaggaagcaatcatcgactgattggcggcgacggctgccagaacttgctaaacggctcgaggagatcttgtatagaaaattcttaaacaaggtattgctctctgtccccataatacttttgtgcctttggtttaaattctgtttcggggcaaaagtagatctaactgttatgttattctatctgtttgattctttttgttgttgttggagcaggccgattacctcaatatgatgaggggaccagttgagccacaattgcagtttgctattaagactttgagtgctcagaaccaacaaaatcaacaaaaccaacaaatgccaaggcaaatggcatcttcctctggctatggcacgatgattccaacaccgggcatcacacaaagtgcaactgg

SEQ ID NO: 90248 - DNA, 605 bp, Oryza sativa
tgcttcattcttaacttcaggggcagtctcacttgtctctttgtcaattggcatgatttcttgcttgacatgagtcttgatctcatttgagcctccaggtgccacattatgtctcgctgtgggcacatttccatcagtaccataaccaatctttgcaggcttctgcagtggtcgtgggtcaatcttcacatccattttcagttgtcccaccttgttattctggtcaggcagttcagaatgtgtttcctgcaatataagccctgcattggagggcatagaaacttcacgctctgcagtactgggtgatacaggctgcatctttaagcgttttggaacagaaggctgactatcaaagatttcatctgacactaggtcgatgtccattatgtcaccctctaccccattcatgattctttgagccgtattctgttgagcaatttttctaggctcagggggcttttgcttgcttgctagttcagctgaacgctgcagaagtttctttgcattactgcatacaggacactgcaaatcgacacaagccttataatgttcagtaaccattcttgacctcctgcaatccctgtatgaacaatctttccttttac

SEQ ID NO: 90249 - DNA, 744 bp, Oryza sativa
gaaaagttatctcaatcgggcaaacggccatcacggatgaacctctctcaatcgggccttaattaaagcccgtcaccgatagctttgactcagacaaccagtcaaactatagcccatcacggatgacctatctcgatcaggccacaactagcgcccgtcacatatgactactcatctcaatcgggcattaactatagcccgtcatagatgaccttcatctcaatcgggcattaactataacccgtcatagatgaccctcatctcaatcgggcactaagttaatgcccgtcacagatgagtataataaaaaaaactaaattttattttttggctagccttatgtaacgtaccacctctccccgtcacagatgagtataatccaaaaaaaaattattttttggctagcctcatgtaatgtcccacctctcccttcactcgtgtgcacccaggaagaatttcccgatcggtcacccatcccaaaattgcttcaggtcaagcacatttaacctcatagttctttggagatcggtttccggagaagttgtaacttgttgatatctaatagtggcgggactttgaaaaattttcgatcggatctgagaaaccttactcatattatagtcaaacatacatctcaatcgggtataagtatagagcccgtcactgatgactcatccgtgacgggcattaagtcatctcaatcgggcattagtatagtgcccgtcacagatgagtcattggtga

SEQ ID NO: 90250 - DNA, 2353 bp, Oryza sativa
ggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggtagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagttgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctgatatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagaggggaaacacacgcgcgcgctcgctcgcctcgcctcgcctggcctggcagggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgt

SEQ ID NO: 90251 - DNA, 2560 bp, Oryza sativa
gctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacatacactaaggaaaattgttcaaaggaaacaacaaaaataatgtttcagtgtgtgtattcgtcccattttagacgttggctatgaaaaacaattttatagttcactccaaaaaaagtaaattttaaggatacaattaaatagacttaatattcaccgatctgaatgtcgacgtcttccgtttaattttggttgttgatatactcccccgtcttaaaatataagagattttgaacagatgagacactttttattactacgaatctagatagagtagtactatgaagcgtcccatccatgtaaaatccattttattttgggacagatggaatactatgaatctgaacagagagtctgtccagatttgtaatttgtagtacttgaaagcatgtcatccatttaaaattttttatattttagccggagggagtatgttttttgctttcacaaaaatgtacggcaccaaccccttgccgacacgaggtacgtaccccatggtactagatactagctagctatttatagtctctatagaccccaacaaacacttcatgactttgtctaaaataaatctaacacgccatattccatctagaaatatgtttggcatctgttcttctcaactccaccttgaaatatgttaggagtttgttttcaatacatagaagagtacgtgtgtacaatttaaataaaggttttcttgtggttactccagatgaacagactaaacacgagagagatatgatgtcgcagcgaagacaggtcaattttcagagtgggataagttgtgtaatgtgcagccatacagtgccagaagattttattttctcgtgcccattttgctcaacaatgttggcacttttttggaatccagtggaacatcaattttgaattcatgcacatgattctcacaacacgactgtacaaccgattttttgtggaggtcattggattagtatatgctagctggaatttttggacgagaagaaattatctcatattcaaccacattaaagtatccttcctttcttggaagaatggattcaaggaggattttattctacaggtatgtttggggagcttaagattctaataagcaattgattggtagccagcttctgagaatctgaaaaagctgatttttcagcttctagcttctagttcattttctggattctataactatagcttcttagaatctagatcaaaagctggattgtttgggggagcttctgattctaggagaagctgcagcagttagaagctcccccaatcaggccctacgtatacatggagtaaagtgtgggaataaccactttggcgatcatggatggattctcttacataatttctttcttaaaaaccttttttccttgtacatacaaccagtgtactgtaaattatcctaatattaatatagtacaataggagcatgtcctactgttttacataaaaaaagtaaccatgaaataaaagtcacaaggatatacagctatacgtacgtctgtcgattttatttgtaaagcacacttcaaatatagacgctaatatgtacatgtgcatacttgtcctgtaatcatcctcgtctccctcatataacacggaataacttgatattgatgaaagtaattcgccacaaacatctccctcatatagctatagctaggttcgtgtacctagctctatatatatgcccatgcttgtgtggtgcatgtacgactgtacgtgctatacatacgcttgctaggtgcagatatgcatgcatgcagccgtccaacgatcgccgtctaatgaatgggacgagattctacgatctccggatcataacatagcaaccgaatattattatatagtacaacgaatttggatatgagctataaaatatcccattttaaccctatgcatgacagatagaagaaagtgttaacactttatttttttcacaattgttttttcaccagataacactagagttgatgtactacttataggacccaccccctccattttataaattcaaattcaagcatttttttgtcaaactattccgacgtcgtttaccctaccggaccctacaataactgcagttacggcgcgaaggaagtttcatcggctatgtgcctgcccaaactaattaaacagaaaaatgtgatttcgatcaatgaaattacacccatgtgtgt

SEQ ID NO: 90252 - DNA, 1450 bp, Oryza sativa
tcccactttcgacacattcgattgccaacttcacgagttccgtgtcgagggagacaaacttatagcgaacttgacatggagaattcgcacccccgactctggcttcttcaccagaacagccatacagcggtttgtgcaggacccagcacaacccgcgatcctctataaccatgacaacgagttcctgcactatcaagatgactggtatgtcccttagatagcaccttctgacgctgtacttcagatttattactaagattttctgaaatgtaggtacattatctcatccaaagtagagaacaaggaagatgactacattttcgtgtactaccgcggcagaaatgatgcgtgggatggatatggaggtgctgttctgtacaccagaagcaaagttgtgcctgaatcaatagtacctgagctagaaagggcggcaaaaagcgtaggtcgtgacttctccacattcatcagaaccgacaacacctgcggtcctgagccacctcttgtggagagaatagagaagaccgtcgagcaaggagagaagaccatcatcagggaagtgcaggagatcgagggcgagatcgagggagaggtgaaggagctggaggaggaggaggtcacattgttcaagaggttgacagatggcctcatggaggtgaaacaggacttgatgaacttctttcaggggctaagcaaggaggagatggagcttttggatcagatgaacatggaagcaactgaggttgagaaggtcttcagccgcgccctgccaataaggaaactaaggtagcttctagttgccactccagcaagtacaaggcaacaagtaatgctcaaaatatattctattcaccaaggcaataccaatagtaacagattattctacagagaacaaagaatttttgaatctgctaatgcatccccattattacaatacatttccagcttagagatatgtaaagtatcagtaactatgtaacttccattaaaaaaaggtatatagtgaactttgtacaactgttccaaatatgatatggattatgtccttttgatgacgatagtttgaatgctgttaattttcttcggtactttatggcaatttaggttatgtcaaatgcaaataatattgaattgtagtttcataatttcatgaacctttcttttactaagaggctctctagaaactttcctattcatcgttaacaatcactgttcagtgggagcttaaaaggagcttgtattttattagtatgaacttctcaagcagcagcctgaaatggttagatggagggtgagagcatatgagatttaactggttgttttcataatcttagcttactctttatgttcttgattcaaacaaggaatcatatggtagctgcaaaatacccctataatcatccaggaagacacagaagcaattctggaaacattttattatcagcaaggaaaa

SEQ ID NO: 90253 - DNA, 2998 bp, Oryza sativa
atagttgaacacaacgacgatgtagtgatgggacaaggaagcatgacagtagaaatttcaatatgccaagttgtccgataatagctaacccctacgtgaggatccctttcctctctcaaaccgcgctttagtaaccctgtattgctctggtagttcaagctgtacaacacggctaggtggagttagaacctttctggtgtctatccattctctgtattgacatctccttggtggttcctgggaggaaagaatagatgtaaagcaagcaaagttagtaaatgttgtgagaaaataaggattcatgtaatcaaaatattcttaacatatatgtagagttcaataatataacataacattacgtgtcgaagtccgacatacatcagcatacctaaagacgttaggcgccttagtccgacgttacatcacgagacctaaagacacgacatgccgaagtctgacattacacgacgaaacataaacacatcgataagttcgaaacgaattacaagcaaatccacatgccgacatagaacataagaactacaccacatagccagacgtggcacgacgacgcctaggacgtggtcgagtggaggtagtgccttcacccgtagggcgagctccatctgctgctgatcctgatagtcctgcctccgccgcacttggtttctccttgtctttaggataatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactgtgacacatatactgcatctggtatgccacactccgctgcggcagcaatgacatggctgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttacactagagctcgatgtttcatggcctttttacgcaactcctctagctttttctgcatgaaagctccaaacaaaatgctttgttcggcatagagggaagaactgcctggaaccgatccctaaaatacctgcatgtcccatgtaaaatgaactccactatgccaactagtggcagtccacggacaccgcgcatcacctagttgtaaacttatgccaaatttgttgtcattattccatatctagcaccacctgtgtcatacgccttggcccatttctcttttggttcatgcagaatccactgagaaaatttccgaatctccaatacagttcttctaaccaatgttggactatccgttgggagaggtccaagagcttgaggagggtcagcaacggcggtcgatggagccgctgcacgctgatcactacatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatacctgattgttcccatctacccctattgctgttagtatctgccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgtttggccctccaagccttggcatagctaatagtatacttgtatgtctcttcgatgtgtcggattattgaccttggttcatatgtgagattgtcgatgacatgcgcatacatctcagatgcaacaaatgcacaagtaatgttcctgtggtatttctgaacaccagatagaaaacatgtatgcttggtaacgactgacactgtccaataatccttccatttccccttatacgcgtgcactctccagggacaaccatctttttccttaatacactgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcattgtcagaatcctccctctccatttcatccacaatggcaccgacagtctccccctcgtcggccactccacctggttgaatgcccactggagctactacgcccccgtcctcttgtgcgttgacctcctccacagaagtctcgtttacttcagcacttggtccctcgccatcatccatattcatctgcacacctggatccttcgggtgaacaaacggaaccaaagctagaggccacccgcgttacaatgcattttccaaatacca

SEQ ID NO: 90254 - DNA, 653 bp, Oryza sativa
tcctctcccgcggccgcaccgtacgtctactccggcacgccgtcggggctcaagaccttcttctccgtcttcgccgcgcccgtcccggacaacgagaacccagccgagagttcgccctcgacaccatcggtgagctcgagcaccacagcacgacggcgccgccatgctcgtcgaattcaactccaagtggcaatcatcgctcggcgctttcctcatcgatgccgacgtacgcgaacccgccgtacgtggaggtgtgggtgctgatcaagagggcgttcaccaacacgaggcgaatgccggagctgttggtgatgcggctccgcacgatcacggtgacggggttcatcctggcaaccatcttctggcgcctcgatcgacgacacgcccaagggagtccaggagcggctgggcttcttaattcgccatggcgatgtcgaccacgttctacgtctgcgccgacgcgctgccggtgttcgtccaggagcgccacatccacatccgggatcgagacagcccacaacgcctaccgccgcctctcttacgtgatcgccaacaccgccgtcgcgttcccgccgctggtgtccctgtcgctggcgttcgcggcgaccacgttcttcgccgtcggtctctccggtggcggtgctgcttctccc

SEQ ID NO: 90255 - DNA, 1552 bp, Oryza sativa
aagacggacgaaaaagatcgagaattgacggaagtgctaaaaatgggaacatggtgaactttgggtgttattaaagtgaaccggtatctttcggtgctataaaaccaaaaacgtgaacttttgatgctatataaccaatttttccaattttatattatgtgaatagccaatacagccctgaagtttcgcttcgggctcagtttagtcctcgatgtttcaagtcgtccaaacaagtcctccaaattaaccatttgggttaatatagtccttggaccaaaaaaatgccacctgagtataccaagtcatcctcgcatgcagcggtatgaatgaaatgatcatattctaccccatatataccatatagaaaagaaaaaaaagacaaacagaaaaaataacaggccagcccaagcccagcattgttgcggatggatggccaacaaaggaatttatacgatcagtgcttggctacagcaatcgtaagtgacaattctaaaacgatcatacacgtgtgaaccattcatcttctttttttatttcttttctatatagtatataagggtagaatgatcatttcattcataccactgcatgcgatgatgacttaggctatattcgtaacgtagggttgggaacccatctcctccgcacggaaaacagagcaatccattagcgcgtgattaattaagtattagttttttttcaaaaatgaattaatttgattttttaaacaactttcgtaagaaactttttacaaaaaaatgcatcgtttagtagtttgaaaagcatgcgtgcggaaaacgggggagattggttgggagcaaggagtgccgaacacagccttagcatactcacgtggcactttttgtgagtccaaggaccatattaacccaaatgattaatttggatgacttgtttggacgatttgaaacctcgaggactaaactgagctcgaagcgaaacttcagagactgtattagctatttacccaatatattatatacaagcgttaaatttgtcgtagatgtaagacctggagctgtgccaaacaaaacctacgttgctaagaacaaatatgtatatataaaaatacttatagagtttttttttggttgctagtaagcgttacggcttatttatgtacatgtatgaagccagacaagaatttactaattaagcagggatcgttgacactgattctaccatttgatggaacaacatttgatggtagctagcttactcagcaggcggcgacgatggagcggtgtacttctggatggcggcgatgatcctctccttgtcccgcgtcgcgaacgcctccagcagcaccccgttcttgtagaaatggaacagcggcaccacctgcgtacatgctcaacggatcaactcacaaaccatttgcgcaatgatcagatcgatccaccacagcaagaactcactcgatcgatcgatcgattgttccagtcagatatgattatttgatcggttaccttgatgcgaagccggtctgccacctctgactgctcgtcgtactcgtcgatgacctgcatgcatt

SEQ ID NO: 90256 - DNA, 954 bp, Oryza sativa
agcatcattcttaatttggttgagatattggagaacacagcaaattaaagggagattagtagtatatggtatggtttgtttgttacctagctcttctgttttggaaccagacctccacttggcgcggtcgaaggttgagccgattagctaaatcactcttttgtttctgtatacgaaatgaaaggtaacttttgatttcatttcggctgtatcgatcttatgcaaacaaagaactttagctttattgactttaatcgcgatatgctggaacttttttctaaaggaagcttaaactgtaaattaacatcccaatcacactcgagtgtgaaatcaaacatgtgatatgtaagttaaccactgaagtgagatgtaacatttattgccaagatttcaaaatttttattttgttacaaggatccgttgccatcagaagaccaatgtcctctggaactaatttggactatttcataatctaaggcaccgtgttagtagaaaacagagatgtgtgatgattatatagggtttcctgaagaacatatggaatccatcaaactgttataactctcaacgctttgtagcatcgaaactatatgtaactgatctcttcgaacaaagtcaagaagaggaggtaaattaagttgattgaacaatatccttctaatttatatgaactagacagcatctgcaaattaagagacctgatatacttgataggacatgcggtctgatgcttgataggtttgtaaaagttggaaagattgagcaagatacgacacataccggagtcagggtgctgtgttctttgaaactatcctccagaaacgaggactgttccttggatagcctcaacttcttcctcgcgccaccaccgccgttatcctcatcgtctgcagcttcctgatcagctacctgctgtctcgtggatgcctcctgcatagaagatggtgacgaagg

SEQ ID NO: 90257 - DNA, 1039 bp, Oryza sativa
tcatctggccaccaccgtgaccagaattctaggacatcttcgtcacggatttcctcaaatgggccccgtaaacatgaccgggaccgggatggtatgggaaagtcgaggggttatgcaagttttggtagaaacagggaaagggagcgagagaaagaatttgactcccgtgacagagagagtaggtccattacagcagacggttttgggtcgtttagtacatgtagaccggaaagggatagattgaatcgttcccgctcgaggacagattcatggaataaaggtgtagttagtccaaataattgtaatacctctagaaacaatactggtactggtggctcctttgaacgagaatttccacagctgccttttgatgacaagaggcaagatatcaacagagtaccatctcctgcctctccaattcagagaactgttgcaccggatcgttggaattcactgctagcggatgtccctggctcaagtgagccaaagaaaaacctgggtgtatcttctgtattacgaccggctcctagtaaacagcctgaggcagcgccgaacagcgggatctcattgagcatggcggagactgtgatgcaagttcctttgtcagttgggcctcaggtattgcacataatgagttttttgatacattttgcgattatctcttggctttctggattcatgtgcatattcttctcctaacagttatcgatggaagcccaaaagatggaagaaatcagtttaagacagaacactctaaggcctatgacatctccagcaatcaaatcttcagtaagttatatttttccttgacatcaaaataatgattcacatttagtaggtgtctattgtctgccatcatttgtgattaacttttggtctttggcgagagtctaattgatttccattaaatgttggcacttctatttgccaaatactttagtgatcccataaatgaacttataaagagtttttattgttgggatggatatttcctatcaccattgttgcacagaaaacatttttcattgttcatggtgta

SEQ ID NO: 90258 - DNA, 1336 bp, Oryza sativa
ggagcactcaagtagtcaagtgatgccacaacagatctagtatattcggattatggacaataacatacattttctctgtgaacctcgtctctattgtgttaaggaggtgttgcattggactagcaggtcaacaacttcttatcgtgcatactgatcaagaatagagcgtaccttgttcaggtaaactaactggacagctatgcatgtaattgaaatcactgcaaacagccacgtctgaaagtagccagcctggtttatgccctcaattgtaagcttaatggcaatgcccacagccttaatgctcattacctgacaaaacaacatagcgtgcaaaagtcatattagtgacaaaacgacaagataacataagcacaaactcatataaaacatttaccgtcaatgatccaatcactgagcaaattccaacatacaccattatgttcatctgcccataccgtggagcacaatatatcatcaggaacagagatactgctactgcagcggtagcatagcaaaggaagtctgcaccaatattacaggacatttgtgaaacataagtcaattccaatgccatgtagctaacggagaaagtatggaaacttaccaggttgtatcgccaagtgccaaatctcatccactgagcttggggtcctctcttggggagcatggaggatgatcaccgtcgacccaacaatacaaagaacacatcccagcacgcccacccgctgtaacttctcattcagtgtaaaatgtgccagaacagcactactccccaacaaatcaccagaagcatacacatgcacataccagtaattcagtacaaatccacacaaagaaacaatgaattacaaatgatgtggacaccaactaaaacaatttcaattctagtattctacctcacaattatgctgagtgctcctagcggcgtgacgaggacagcaggtgcaaacatgtaagcaatgaagttggcaatctccccaacaagcactgataagatttcaattttaccaaaatattcaaacctattcccacatgaatatcaagaaacaagtccaagataaccatgaaatttcacttactagtgaccatcccgacccaccagagcggctccaagaggtacccatatcctccaacacctgaaatttccaacaagacaaacgaaggtcacgacgcgtgcgacatgaaatcgacccggattttggacacaaaagtagcttagcttcctttcatgcaacccacagcatgtaggttcgaattagcatccagcaaccagaaaaagacctagcaatagcacctgctcgggagcccgcggcgccggcgcggaggagccccttct

SEQ ID NO: 90259 - DNA, 2281 bp, Oryza sativa
ggcgcgccgcgcgcttcctcatcggtaacgtcgtcgctgacctctcgctgtactcgcgcgcgtccctgcgccgcgcgcaggtcgatcgattctttgcctcgcctgagcgtttctcggattcatggatgccgcagccgtcgggttcctggagcgcatcgggttcaacggcgtgcagggcaatctggtgatgtacctgaccgggccgatgggcatgtcgacggcggcggcggccgccggcgccaacgcctggggcgggaccgtgctggtgctgacgctcgtcggcgcgctcgccgccgactcgcgcctcgggcggtaccgcgccatcgtggccgccggcgtgctccatctcctggtcagttcgatcttccgcttctctcgatctgtacctgtcgaacaactctgtcatcggatgatcgagttcatcgatgttccaacaaagagtcgcaattttacagagtttgggaatgctgacgatctcatcagtgatgcaaccaaatcatcctcacccggcgagctgccatgacgcagccgccgcctgctcgccgtcgccgccgccgccgccatctctcgcccgcctcgtcttcttccacgccgcgctctacctgctagcgctggcgcagggcttccacaacccgtgctccgaagccttcggcgccgaccagttcgcggcgagcgaccccggcgcgcgcgcgtcccggagctcctacttcaactggtaccagttcttcaattccttcggctatggcatctccaacaccgcgctcagctacgtcgaggacagcgtcagctgcaccgtcgggttcgccgtgtgcttggccacgacggcggtgtacctccccatcttcttgctcggcacgcgggcgtaccgcgccgagcaacccgtcgacggcgccctgctcgcgcgcctcgccaagacgtcctcctcggcggcgcgtgcgtggacggcgagggtgtttcgccggaaggatacctcttgcacagaacggtgagctcgccgcgccagcgaaagcaaaacgtgcgttcttgatgagttgatctgataaccttcctaatggcgaatgttttacactaatcgtgcaggcttctggcgagggaagaggtaggcgagaaggggttccttgccaagttgcttccgatctgggtgaccagcatagtgttcgccatcgtcagcgcgcaagaggtcaccctgttcatcaagcagggcagcacaatggaccggcgcatcggcgcgcgcgggggcctcgtcgtgccgcccgctgctctgcagtccattgtcagcgtcatcttcctcaccttcgtgccggtctacgaccgcgccctcgtgccgctcgcgaggcgcttcacggggcaccccgcgggcatcaccacgctccagcgcgtcggcgtcggcatggccatgtcctgcctcgccatggccgtggcggcgctcgtcgaggccaaacggctccgcgccgcgagcgacgccggcctgatcgaccggccggacgcgacggtgccgatgggcgtgtggtggctggtgccgcagtacgccctcgtcggcctatcgaaggtgttcggcatcatcgggctcgacgagttcttctacgaccaggtgcccgacgacctgcgcagcgtcgggctcgccatgtccctgagcgtgcgcggcgtcgggagctacgctagcggcgtgctcgtgtcggcgatcgactgcgcgacgaggagcgggggagagagctggttctccgacaacctcaaccgcgcgcacctcgactacttctactggatcctcgccgcgctcgccgctttggaggtcgccgtgttcgtctacatcgcgaagcgatacgtctacaagaacaaaggcgagccatgattcttccgagttcggattagagtgtgtaataagtctgaaaaatggtccacatgctcaaagatgtgtactctttcccgtttcataattcttacattttacataaggttaaggttaaacttttataactttaattatcaataactttaaagtatttagtttaaagaaactataacaatgtatatagaattatctttcaaagtactatgagaaaagtaaacaatatttatttatttatgtatatattataatagaaaaatcaagttaaacatgtattttgaacaccgtgtcattatctaaatgttaagaattatggaacgagagggactatagtatttatagtgagagaatgcaacataaagattatggtacctctctagcagcaagatggagtacaagtacttggtggctggggcatgcttggattgtatccat

SEQ ID NO: 90260 - DNA, 800 bp, Oryza sativa
catgtagtttcctgtgtaaatgtttcaagtgcaaacgttttcaatcatcctgaattcctgatgctatctgctgcaccaaattacaaaacaaacgagcaaaattgtttgctataagagaatttagcagggccggaaaagaaaacaaaaaaatgtaggaacatccatcgatgtgccaactgttgagacttcgttgcaatcgggcacagatgcaggagaccaggaacaatagtctcccccatgttcctccaggcgaaaaggatggctatggtgtatacacaatgcttaatatcaccattttgacgtcttgagttggtcatggtcagttcttctggcagcgttgtaggtcttcgatcgccttcttccattgccaggcgcgctgttttgcatcctcaaacgatgacaccttctttggctgtaaacgaactgcgttagtcatcatcataggagcaaggataataccaagggatggtaacaacaaagaagaataccgtgcatatcctgaaatgcgaagagtttgatacttgcacattgagttcacttgggtcatcagaccacatgatgttccctttagtcaccatttttccaggatctacacagatcagctgtggtttgtcggtgaggatcaactgaaccttcttgttcgttagcttgtttatcttcttcagttttgatattagaacgacagattcgccaggctccaggaagtcctgcctgtcacattgttaaaagcaatatgcaccaacatgaatcacctcttgtggaaaaatttgagcatgatgccggtcatttcccctctttta

SEQ ID NO: 90261 - DNA, 671 bp, Oryza sativa
  unsure (1)..(671): unsure at all n locations
attcctgcagccctactcccggagggtccatatattcaagaactgcaatgtcacacaaggagcaattaaaataaaacaaggtcctcagcaaattcataaagtgtacttattagaccacaaattgcaacaaaggaaagagacaatattacctggtaaggtttctttggaacaatagcttcacctttttcatcaaactccccagcttttctcttaacctttccttcacagtttgctgctagatgtccaacctgaccacacaagaagcatttgtcctgctgtccaggtgtataaactacctgcaagaaaccaaaatatagtcagaagagagagaaaacaaataacataaacaagaaagcataaggaactaatccgctcttttagttagcataacatggtaaaatgtatttacacaaaaaggcattgattctaggtcctgaggagagctaacctctctcagtatagagaaatgtanccttcgtgtgtgttgcaagaaaagcttaaaccattggaatacaggtctgcatcctgcattcaagagtatatataaaaaaatgcattagcaggaccaacagaagaaacattgcccaattaaaatatataaaaaataggtttatagaacataccaggccatacaaacaatggcgagtatttgggttaaatccagggagatt

SEQ ID NO: 90262 - DNA, 772 bp, Oryza sativa
gctgctacttctcgtgtctcttctgtaccaatggttcagtctccagtctcctcaaaatctggggagatatcaagcagttcaatgagtgcccagtttggcgctgctgtgacatctgctgtaatgggatcacagaaagacaagttccctgcaaattccaatcctgcagtagtgggctatccccctgttgcttctagccctagtgattcaatgcaccggatgcagcagccttcagttgctccttcaaagagaaaatcaaattctgttcccaaaactcaaccgcctgtgagtggtgtagggtctccagccagtgtttcaaacatgcatgctgtactgaatgctagcagcccatcaattgggactgcacctatgggtgatcaagcaatccttgagagatttgtcaaaattgatgccatatctcaaaggtataaaataaagatttacagcatctgttaacacaagttattggttattgttgaccttttcttttgttttcggtgttttatgtagaagtgtgcagtctatttactattgcatagagcagttcatagctgaaacagaaactcgattaatgattatacaagatctaaaatccttttatgtccttgccgttgaattgttataatttcttttggttatagcatcattttacattgcagctaaagttcatgattgtcatgtttttctcaggtgcaagctgcacagcaagaagaacaaagttgacaatatacctcagagaaaaccgattatcaatgcaagccaagagaaagttgct

SEQ ID NO: 90263 - DNA, 1570 bp, Oryza sativa
attcatgatttcatacaatttataatgcaacatcttaacaagcacataggttgaagaataaacactaaacacatatacctattgcatttatcactctttctcaaataacctttagcacagaataaccaagagaatttgttttaactttttcttttcttgagcctttttgctcatatttttctcttttattccgggtacgtccctgtcgtcaagactgtttccagggattcggtacccattattttgctcacatcgaatatgtccttgtcgtcaagactgtttccaaagattcggtattcatttttttatatttttattctctttttcacaatgagcaattaaagctatttgagaaataacaagtcaataaagcatataaagcatatatatatatagagcatttatagatcaaaccatatgctagcatcaacattgcatattttcttaattcaagtattgaggcaaaagatttgccgaatatattagaaaagggccgagaagcttacattacaaattcaatagaccttacagaacagaattaagacaactaaatacatcttacaaggacacattgtcctacaaaacccattaaaaaggtcttctcgagaggcttatttggtttatattttcctgagtcaaagaagccacctgattttcagtcttctaaatctgttgaaaaatccttcgattacgctcaatccatatattccaccatataataatcaagtctccaagaatcttctttcttctagatgatggtgagatttggcataacatattccaccactccgcatgggaattcgttgtctattgttgtggaatgttactatgtccctgccattggtagattttgccccacactgctattgagaaggggcattccttagctaaacggcaattatcttcaaaagtgcttgtgcaataaaggcaacatatccaatcacaaggccatcgtcttttaagaagattctctgcagttagagccttttgatgaagtaaaatccatccaaaaaatctctgcttcggtttagcttgtattgtccatattggatcgaaagaagcatgggtgatagaaccctgaaattgcgctaagtatgcactctttgctgaatattgtccattttccgttcatttccacaagatatcattggggcagtcttataagagtgctacctcttgtagtcgagattacaagtgctacctcttgtagtcgagagcctaactgaatcaattcctcaatctcttccagcgaagtaatttgattcagcaaacttaaccaatggttattctccaagtccatctttaattaggcaatttgactttccctttgccagtcaaaaaatagagcactccttaggcgatcttccttccagccagttatccatccaaaacttgatcttcttgccatttccaattgaaatagaagtgcctgctctaaagagcgttgtatcagtttcatcacacggcgtttgcatgttaatccaaggttttgagtcttctttccattcaaaccatagccatcgagttgactaccaattaactgcttcttagaatcttaagctcccacaag

SEQ ID NO: 90264 - DNA, 583 bp, Oryza sativa
tccgtcggtttggcacgcaaaccgaggccaagcaagttaagtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaattt

SEQ ID NO: 90265 - DNA, 660 bp, Oryza sativa
  unsure (1)..(660): unsure at all n locations
ccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggtaagtccccggcggaagaatcagatccgagggaaaaggaatcccctgaatttctatagggacggcagggctataatactttgctgtcataaccccgccaggggtggtgatgagcagagggtttctaagcctttctacccccaactgatttctccccacgaatggcacagatataaacgagtgggaagctccagagtcgaacaaaatggtagcagggatggaatgaacgaggaacgtaccaacgatgacgtctggagttgtcagcacgtcctcggccgtcacatgattcacacggccccgaatgacatccttcccgccgttgttggagcggggaggcgcttggccttgctgacgccttggcttcnggcatttatccgcaaagtgccccggctcgaagcaggtgaagcacaaacgctgctgaccttgagcgtttctgcgggcctgaccagctgcacagctgggcgtagaggaccgggcgcacgaagtcccttgctgattctgttgctgctg

SEQ ID NO: 90266 - DNA, 723 bp, Oryza sativa
tttaacatattgatagctactatgcccataaccaaccctgttggaacacacaggcagtttatttctgtagcggagacttgaccttttctgagtattaccattatggccttgctgcttctctttacacacatttcacctcccctattcgcagatatgcaggttagttcctatcgcccttagatgaacttatgcttaaagattttatttgaattgcgcatatagtcgttgggtgtttaaaccaatggatgtggtttgctatattaagttatttctttgtcttgcttctgagcagtgaatttatatttttctgcatgaaccttttacacaaagtgaatgttactcaatgtggctatgtgcatttaaatgtgtgaaatagcatcatgtccacaaatatggcattttctttagattgcctattactccagcacatgaagcctctgagcagtgaagttccaagatggcacgttcatgaattatgcagttccaagttgtaagaaagcattttgaaggactaacaatatccttttcttccagatgttattgttcataggttgttagctgctgccctagaaattgccaaacttccacccctctttcaggatggtccacaacttacaggcgtagctgacagtaagaaaatgaatgcactctgaagtacatctttctatgtttcacttcttggtactgaactactgataccttttgatgtcagacttgaattat

SEQ ID NO: 90267 - DNA, 613 bp, Oryza sativa
gtgtcttattttcctcttctctttatgcctatatgcagatgaaacaagagttaaagagttcaaactcaagtcaatgtggaggagcccaaatggcaccatcaggaatattctaaatggttaatttttcaactcttgagatgtctttgatcttttatttacttggtgaaatgattctcgaactgaattgacatgcactctgtgaattttgttagtgggataaatttaaatttctagttaatgcttataataaaattttatggggtcaaaattgagattctggttgccttaatgttggaaattttacacacacatattttcatatgtactatacttcatcctaatgtggagtgtttaaatatacctgtagattctgacaagtagcaataacatgaaatttacttgaaatatacttattttagcacagatactgataatcctgagtagcaataatatgtcaggaactgcaacaatataaaaaatattctgtaccatgatcactaatgttcaccatgacatacaggaactgttttccgggagcccatcttgtgtaaaaatgtaccacggatactttctggtaaggaattattgaaatattgtcatgggaacaagtgac

SEQ ID NO: 90268 - DNA, 3867 bp, Oryza sativa
ccatcaaataatgatggtgagaggttctcatcctcttatcctagccggagtcggtcctcccgctctggtcaaagcaaggctcccgtttcccggtataataggagcccagaagtcctcacctattaaatggtgactgacgggggcaccccccgtgtcaggcggcaatatttgacaggcctcatcatcaagatgacgtgcgcttgcttcccaggtcaaagagacaagacatgcatttaatgcaaagattgtaatccttctccactaagttatgtttttgggcccatgtgataaccccttaagatataaaaggaggtccagacctagtaggagaggggagggttggagcccctgatgatcaacaccttctaccccaacaaggagatcttgtaatttctcacaagatcagctaagcacaggagtagggtattacgcttctcagcttgatttctttcttgtagtgtgagttttcaataatactttagtttatagtgttactctcggtctcacaaaataaacctagtgaacatatattagtacaaaaaaatctgaataaaaggctgtctagatttgtcacacataaaaaagacaaaccatatccaggttcatagcgtcacgaacctggacacgcatatgtccatatgtcttggacacgcatatgtccatatgtccagtttcgggtttttttagtcatatgtccaagttcatagctaggattggggttttcttttgagtcatatgtccaggttcgtagctaggattggggtttttttggagtgtcctggttcgtagttaggattgggggtttttcttttttattacggtggggtagtattataagcatcctcccaagaatgtgggaaatgctagaatgacttacattgtgaaatggtgggagtatggttgaaaatgtcatcaacctgaacagccccataaactttttttaatctagttaccactcatgatactaattatattcatagtttttgtctaatccgtttttaagtatggagtagctatattttagaatgagtgagtatataagtctaagagcaacttagttaaaatgtaatgattgtttggttttctttgaaagatgacttgttttggtatggaaagaatattacttattgcatcggagcatttgtttatttaatcagtcttcaatgtgtttggtgtgcacaaggttgtgtgcggtaagattttctactacaatatttcttttagaaaaaagacagaaagaaaagattgttagaataggtgtcgaatatactagttctatttggttacagttggacttaaagatgcaataggtgttagggggtggggttagagtcgaactctataacccggcatctctcttaaataaagaggttgcaccacaatgtaatcatggcgattacaatgtaacgtagatacgcagggagatgatggcggcgaggccatagactcgtagcggctaggagctattttggttggggaggagtgcccataatcaaagcctatgggatgtaggctttgactaaacctcgttaacaaatatagtgtgttcatgtgtcgtcatctagcatgtattgggtgatcaatgattgaatcgatcgagaaggttagtcatcgttccgttatatggactaaggccctgtttaggtggtgtttgggtggtttagtccctctcaccaaaagacttatattttgatgagaggggctagaggtgtgtttagttcgcgccaaaattaaaagtttagttgaaattggaatgatatgatagaaaagttggaggtttttgtgtgtaggaaagttttgatgtgatggaaaagttgaaagtttgaaaaaaaaatttgcaactaaacacggactaaactttagtccctctcccacccaaacaccaccttagatcccaacttttttctttaaactttcaacttttccatcacattgaactttcctacacacacaaatggtgtgtttagttcacaccaaaattaaaagtttggttaaaattaaaacaatgtgatggaaaagttgaaagtttgtgtgtgtagaaaagttttgatgtgttagaaaagttgaaattttgaagaaaaaaattggaactaaactctactcccactagaaggagtagaagccgtagcagcaacaactaggctagtgctttaggcatggcaaggcccacagaagctatggtgagtgagctgacccctcgtgtcattccttgtccctcttccgcctattactactagctcttcgtcctcatcaatgcgtgcttgcatggccatgtccatggaacacgagacgccagaaagaaagatggagtcgaatgctctcatctcatctctctcgcaaagtcgtctactcgatccttttcacatgctcttattataccctaaaattgatgtcgatatcgatgtggtgagatgatggatggatggagaagacgggcgagtacgtgatggatgggcgatgcgccatggaatcgccgatttcggggcgccgaacattttccgtccggccaccgatccatccatcgattgatttgaatccgcggtttggttttgctgctgctccgcctgtctttgctttgctttcgcttggacaggagctggaagcctggaactgctgttgctgttgcttggttttgttggttgcttgccgtctccatgcattactccgttttgatgccggggtagatgaggaggagtagatatattgatggggtcaactgtgactttttacaatggtggtcagcaactgcaattgaggtcttgaatgctgccatattgggaggagtactgagagatttggcctgagaccaaagggcctgttttagttcccagaacaaaaatgtttgcacacatacattgagtattagatatatgaaaaaaactaattatacagaatacgtgtaaattgcaagacaaatcttttaagactaattgcgccgtgatttggtaatgtgttcatacagtaaatatttgctaatgacgaattaattaggcttaataaattcgtctcgcaatttcctggcagaacctgtaatttgttttgttattagagtacgtttaatacttcaaatgtgtgtacgtatatccgatgtgacaaccaaacctaaaaattttccccaactaaacaaggccttagtttgcgagacgaaaagttttaacgtgtcacatcggatatgaattaacctaattttctcctactggggcatccatcgaagcggcagcgtcggtcctggatggggcggaggtgatgggtagcgccttgtgaggatggtgctccgagaagactgtgcggttggtgccaacgccgacgcggaacggggtggtgagtgcgaagccagcagcggaacggggtggtgggtgcgaagccgtcagcgtccaacaggagcgaggtggagccgaggagtgtgaggttgctcgtccacgagatgtgctggtaggaggcgccggtcccttatttcctctgccatcagcacaaccccctacggcgccggcttggagatcgggcggaggcttcccaagacgatgacgcctcttgctccttccttccatggcttcggttgggacgatacgagacggtaacggacgaggacgtaggcagtggaggcggtgacccggcgggcgggaggcctctccgtccactggcggaagaggcgacgacacagcgggcagattccggtggatcagagagtattcagggaaagagagataggggaagaaggcatgggccccactgatggtaagccggctttggctggccatgtttggttagtgaaggaggtttggctagggagatggcttggccatctagattgtaagtctgttggaatccattttttatttaaaattgttaaattttgatttggagagt

SEQ ID NO: 90269 - DNA, 2349 bp, Oryza sativa
atgcatccactcgtgaagagacaatgaaaaaccacagccccagccggcccagggccagtgccacagccacagccaccttcaattgcaagcattgcagctgcagctgcaacaacagcagcagcagcagcagcagctataccactgtgcttttcagaagcagcagtagtagtctactgctacggccacagccatgcacatcactagctacatcactcactcaactcaaacacaggctgatactgtaccagctgctagagttgcattgccaacggatcgaccggatgatggatgcgtggacagattggagcactggcatatggatggatggatcggtctaccggtcgctgggtggttggaggcatcgatctcgatcgcccgcggtcgccgtgcgtgtgtcaggccatatatgggaacgcatgcaaccgttgggcagtagaggccaaggggagacgacgacgacgacgacgaagactgagggagctgctgatcgatcgccggtagctccagctgagctgcatagtagtcgcctgtgagctcggtctggctagctgctgctgcgtactagcttggctgaagtagctatggctgatcagcagcagcagctagctgggtgtggctacactctggtcatctggtgccatgttatctattctcgtgatccactgatccccctgtgtatgtgtatattctagtgcttgttaacttgtagcttctcctgcttgttggcttcttgtgatcgatcttgtgctagcgctctgacctttctccagtttgagcttgtactgcttgctgcatcttcatcagcacgactttttttttcttcatcaattatatgcatgcatggaaccatcaaatttatataccccaccatggttaggttttgttataactaaactctactacggacctgtttaaatcccaccctaaaattttacatactattacatcaaacatttaaatacatgcataaagtattaaatgtacatttaaaaaaataactaattgcacagattgcgactaatttgcgagacggatcttttaagcctaattgctacatgatttgacaatgtggtgctgtagtaaacatttgctaatgacggattaattaggcttaataaattcgtctcgcggtttactgacggattctgtaattagttttttattagtgctcaaacaccccatgcgacactctataatatctgatgtgatacgccaaaactttacacccctagggccatgtttagattccaacttttttcttcaaacttctaacttttccgtcacatcgaactttcctacacacacaaacttccaacttttccgtcatatcgttccaatttcttcaaattttcaattttggcgtggaactaaatacaaccgatgtactccctctgtttcaggttataatttgttttgactttggttaaagtcaaactgcttcaagttttattaagtttatagacaaatatagtaataattacaataccaaattagtttcatcaaatcaataattgaatatattttcataataaatttgtcttgagctaaaaatgttactacttttttctacaaacttgatcaaacttaaagcagtttaactttgaccaaagttaaaataacttataatctaaaacagattgagtaatattcagaggtgaatgctactcctgacataataggagtacttactccgtctcaaaatgtagctatgttatataggatgtgttattacctagtactacaaatctggataagaggtagtatatatctctcctgacataataggagtactccattcatcccaaaaaaactcaacctagtattagatggacattttctaatacaacaaatttagacagaagtctagaaaatatcacattcaatattaggaaggtttttttggaaggagtgagtataggtgaagcttcacccctgttcgttctaaaacgtgcccacgttaagatatcgcgaagcaaagacgacattacgacttgtcacttttcatgcgccgctagctagctggagtatagcctaatcccaagttccaagccgtgcgagagagattgacaaacaatttgacatgactcggattattggcttgcgtgcgctagctggttgcatgaaattgaccagggcggtatatatgacacgtgtgtgtcacgtaagttagctggcttgatgatcggccacaggtagagcaattccagctgtatatgcagaagtagatgcatatatgcatggttggttggtgccacgaaaagatgtcgttgttggttagtaattcggcagatggttcgcacgcgtgtactgaattcgtctgagaaaagaatgaatgctgcaaaaattgct

SEQ ID NO: 90270 - DNA, 2798 bp, Oryza sativa
agatacaaccgtcgttcacatcaaaatcaagccgtccaagttctgcaatccagttcggccacctgctacagtgttgacttcaaacggccaccaaatatgcatgcgagctccattttgggtccatgagtacttgatggaaagctctcggagccatctttccaatggatccagcttcatcgccaaattccatcccagttggccgaaatcacaaaaagaaggtgttgtgtcacctataatgagcctataggctcgtaacttcgtctgggaccctaacccaagtggagcccatgtggggtgcgccccaagctggtggagcatgaccctaggcacccctaggtcgtcctcccacccctatatatagctagttacccctttagggtttctcgggttttgattaattgtaagtttagccattgctacttcgcttgcagcgcgcgtgtcggctagaccgtccgtctgcttgttcggaaccccactttattgtgtatcaatttatctttgtgcgtcttgtctatctagcaattcagttgctttatatcttgttcttgcttgttctcgattgcttgcaggaataaggttgatatgcaccggcaagatcaacaacccacagagaggtgtatcgatcgctaaggcgcaacgcaacgtcttgtacagttgtagtcggatcgtcaacgtttctcccaaatcgtagttatcatcaactcaccgaaagatcgggctaaacaactgccttgagtgtcgagtggaactcagggtccatcaataccccatccatctcaagctctctctctctctacatacaagttctatgcaatcaacttcctataatccgaataccctcaactttcttgtttctttgtttatcattcctatttcgatacactttctatcctatgtttttcccatccagtaatccgaacaagccctgaaaatggttgggatgaatagccccatttttttggcttatacttgagcttatgtcaaattttgtattttaaaacttaattttaaagttgattttgtgctttttttcatcgaaatttatttggtagcatttgcttttgtatttttttaaatagtgataagcgtttgagcaaagatagtgtcagaagtgatgtcggccgggctgttggtaatggtctcagcgcattctctcccacaaccttttttttccctagttaatgcattgggtatttgtatgctacatgcatacgtaatatctcatacgtttcacctagtgtgttcttgtgccatcacatagcctgctgaaccatgacgttatacccatggacctaaatcatctagttgcttcattgatagaaacttttggatgcccgttgcatgaacgcacacgagcgttttaggatcactgcccgcgcgctagcaagatcgagcctttgttccacgaaactggtgctgccacgtggcacaattttccttgggatttttttgcatcgaattcgtattataagataagataagataagatagcaagcttgtccagatgggtatataactcaagttggtaaacaaccaaacgtggcctaatagtttttaccttattcaactgccgttttatttaaaaacctgcaaataaaaaatatttttgcaagatgctggcagtcctcaaaatataaagttttgcatataagattttagaatttgtaagatttaataaatttatattatcacattacagaagaaggattttctaaaagcctctataatctactacatactggtgtttgtatatatttattcttttttttttcgatcgacggttttactatttagctccgaagttttttttttacctaagcaaaattcctagatttatctggaagttacacgggatattacacaaccaacgctctaactgaatcagaacaaaatcagcgattgcacaggggacacgtggctaattttcacgggagctaaccctaaattctcaggaggccacgtggcccaatcacatgcctgattttcatccctgaaatcggtttataagatttgatcggttcctattcttatataggagacgataatgctactactatctgaagtgcaaatgcacgtgttataattttattaaaccatccaccatattataacttacgagcagtaggtagtactagtacgtagctacatgtacaaggccacgccaaaaatatgcgagacaaaatttgtgctcatgatgcaaatattcttattctatgaatagtactcctaccaattgttgcatgcagcttcagccatgcaagcatgatggaacatggatggagctttaggttttccatggtggagacggagatggagtagtaccttgctccgtgaattgtcaaatcgcatgcaatggacaaaattggacccggccatgtctctcgagcgcttgcatgcatgacaacctcccatctacaactccaagtcaccaacgtacagataagcacaggaattgaactcctgataaactctcaagttccctaagaaaaataatcatccaccatgggtgtgtttagttcctgaaaaaagttgtaagtttaaagaaagttgggagtttagaaaaaaaagttaaaaatttagtgtaggaaagtttttgatgtgatagaaagttgggaataagggggaaactaaacacggcccatattaatccatcgttcataaaataagtttatttttagcccttccatttgtaaaaaataaggtacttttaagtaatcattgcatcggagtttgtgaaagttagagaataaataaattggggtagagataaagaaagaaataattgtgctggaatttga

SEQ ID NO: 90271 - DNA, 6954 bp, Oryza sativa
ccagctacaacacatttctatcagtcattttagggtagtacttagatttccatgtgtgtactgtagggtcatatttaacacattatttgggctaagtacaaagtattggatggcacttactacaaggtttgttctaggtgctctaaatggtttacttgcgccaataaaggtaactaaaagtctttcaagtgacaatttcagcatgaagttgtatgaaattattcatgtgcctaggagggagctttcctaacatagtatttatcaagcattacaggcttattctattgaagtttgccaaactgaacatcaagctcttggactctccattgtaatgccaagcaattctcttgtttgcccccattgtgttccacaatcctttcaatatgcactgctataaagctgttatgatttactttgatcataggttaacacagcatggggtttgggtctcgttgttggtccagctcttggaggctaccttgcacaggtactaatttcaaaatggaaaaagaagaaaagaagctaatattcggtttcttacatcgttctgcttccttctcagcctgttgaaaaatatccacatgtattttctaaggagtcagtttttgggaggtatgtcatacactgatacaagagcaagatataagcccagattgcttgcagtcagtgttgtaactactaaatacccatatctaatttcattacattttgcagattcccgtatctcttaccttgccttggtgtatcattgtttgctgctattgttctgataagttgtatttggcttccggtacgtaaagtttcacttagatgccatttccccaataattcttaagcgaattctagcactaaatgctcgttacttagcccttttctatggtctagttaatttcacaaaacaaaaaaaatattggattaatttttttagaactgtttttctagtgttactattaatgtggttttgtttgaaaaatgtatctggcaggagactatacataaacataaatctcctgataaggacatcaaaagaatcaaagaattgccattacagcaggcttattgggattcacctcgtaagaagagcttgttccagaatcggccatggatgtctactatgatttcatattgtttttttggtcttcatgacacagcatacagtgaggtaaagaaccatgttttctacgcctttgcttgttaccagtcagaaggtcacgttaatctatctagatgccactcagtttatttctcatgcttcaaaaattattatctacatacttgctaaactattcacacacagctttgatattcacataacttaaggggttctaaaaagattaataccattagcatatttatgctagatattatccttgtgggctgtgagtgatagaaaatatggtggccttagcttttcatctgaggatattggtcaggttcttgctgttgcaggtatattgccatctttcccccaacatacataatttatatatatattctgaactattcatcagactttaaagattcatgttctcacatagctgcataaatttgttgttaaataattgtacttcatgtctcttcgtttcaggtgctagtcttctagcatatcagcttattatttaccactgggttcataagtttcttggaccaatcatttcattacgaattgcttctgtgagtagtctcctatcacgacttcaaaagaaatataaataatcatttcatggtcatcactcatatttaactgaaattgcaggctctatctatacttattctttctacttatccttttatgacatacctatctggcgcggaactttccttagctttttattcagcggcaatgatgaaaagtgctcttgcagtaagcaatttcaaagctcttccttcaaattttaagtatctacacgtgtatccaaccacaccatttgttagctaataggtacagcagtaatatttcaaaagtaataatgtacaaaaaagaagatgtgttgcactgcagaatgcagattatgaaaatctaactcagtctacaatatgacaaattcaactgtaactacttggggaagacaagcctgggttatttcatagagtactattttcagggatttaagagtaacaactaaaataggggctttattatacttccattaatatccaagtctttatctctaatgtttgttttgtacaacgtgtgcagattactataagcacaggaatttgccttttacagaacaatgctgtggtatgcataaaaatcaagtgaatgcatgtgttctgatactgtgttcacgtaaataagctaaattatttattgactttgaaattcaatatcagcttcaagaacatagaggcactgcaaatggtgtatcaacaacagctatgtcatttttcaaggcgattgctccagtaggggcaggtgttctgtgagtaccacctcttaacacttttctcataaatacaattaatgatcgagacataatgtttcttaaatgattgagataaatgatttagattttagtgatcaatactcaattttcaattcagattctcgtgggcgcaaaaacgtcaggatgccctcttctttccaggtgagctatttatctgaactgcactgcgctatacgcctatatcttgcctcgtcttttaattagccaggttggccgaaagaacaccccttccctcccttgtctttcaatttgtttggcctagtaaactaccatatctttcagtcgaccatacattacatacccttgtcctatcttatttcgttaacaaggggtttgcctggactaattgtactaaaagaacatgtaatcaggaaaaagaaaaaggaaaggctgatccagtttggctttcttgaaacctgtaggtgatcaagtggtgttcttgatgctgaactttgtggagctcattggactcatatttacttttgagccttttatggtgttacctgaggcatcagatgagtgtagttagccaagtgcagaggaattgtttcttatcaataataaatttgaaacagtaataatacttaacacttgctaatgggctgagtaatgaggcatagcttaaatatgtggcatgcttgtctgctcacagaaatggaagtccttgaatgatgaatctggctgcagtcagcatgacatgtccaattttgtcatcatggtgtattagttgcatcttgtcacaatgattactttttaaacagaacaacattttaaggtagttcatgttctcagatgtcaacatttcccctttttgaggtcactactcctacttgactaggctgacagcttagtagttgacagttaagtttagcctgaaggaactgaagacaagaagaaatcaggcgggtaatgatgagactgattgattagacaatgggaggttaactcatcataatgcttacgcacctctgtcaaaactcaaaagccagtcatcatcatcttcggattgcatcgccgctgccggggccatgacggtgttctgttcagcttcagcagcctggacccaggagccagcagcaaagcagctagctgccttggcgtcggagctcaccttcaaggaggagatacggcgggactaaccgcgcgtagacgtagcgcgcttgcttctcgccggaaacctcccgtccttccccccccccccccctctccggctgcagcggccagcggcgatgattgggttgggggcagctctcgcagtgatctaggagcctttctcttcccgcggagaagaggagcatggttgggcggggctcccacggcgatgccggcggcgggcgccgccggaggcgagagcgaaacgcgatgagccactcaaaacaggggctaaaatgcaaaaaatcaggatcgctactgttgatagctagcgatcctaaataaataaggggtaaattgaaaataacccctatcgcgatccaaagcaggggttcttttgcaaaaacatccgagactcactggattgggccgcatcgcgttgcttgttttgtgggcctagctcccgattcggcccacgctaaccttgggccgcagagaaagtttattaccagttcaggctttccttcccgccaccgcggggatgcgccggcgatgaaccgccgtgaacggcggcgagggagaggcgcgcggtcccatgccctcttgacgaactcgtccatgtcaggcggcacgccggcgcgtggcctgacctcctcgggcgtcagaatctgacatgaaatcctcgccgggagggagagggacgggacgcacgccgctgctcgtggctcgccgccggcgttgccaagctagtctgcagcatgcaatgcacgactctgcccagtgcacgcgtggctgatgcaagcctcaaatgcgctgcgttttcagcatcctgattaatataatcagagattcagggaggggggcttgttccagtttggtgttctagaaacctgcaggtgatgttcttgattgcttaatttggtgaagctcgttggactcatattgcccaattatttgtcatcgtggtgtactaattgcatctcgagacaatgatcaacatactgacaaaacagaaatctaaggtagtactactgtcatcagatatctgtactgtttttttctggattatgacttgatgaatgactaggctgacaggttagttgtccggactgaagcctgaaggaaccgaaggaaagctaaaccaattttcgggccaaaataaaaaagctaggcggctgggctgacgatgagaatgttgagcttgattggtcttcaggcttgtgcacctctgtaaaaggccagtcaccatcttcagattgctttgcattattgcatattcgtgtaaggtcaccatcttctgattgcatggttcgcataatcgcatggccctcaaaatcgataggaactttaagtttctctccttgatgtaaaggtgagaactggtgagtggtgaccagtgatcatgcacacactgtcgcagtcgcgtactatgtattcctcattcctgaatatggcccaaattagaagagaatgattggtttatgcagactgcaactactgcactctggctaacttaagagcaagtttaatagtggagctgactgtttgctccaaaagaatccacgtcaccaaaaaaaaaagtaagtgaagagtagatttgttattggtactcctgctatctttgcacaactatcaaaattatattttaattgaatgggcaacttttacactagcaggacggggtgtttagatcccacccaatcaaaatttacaccatatcacatcgaacgtttgaacatctgcataaagtattaaatataggctaaaaagaactaattacacatattgcgactaatttgcgagacgaatcttttaagcctaattgctccatgatttgacaatgtggtgctacaataaacatttgttaataagtgattaattaggtttaataaattcgtctcgtggtttaccgacggattatataattagtttttttattagtgcctgaacacccatgcgacaccccatataatacccgatgtgacacaccaaaaatttacaacccttaatctaaacacccccgaaggcttgctggtcactcataggctgagcattagtggaccccacagtatgcatgggagcatgtgttagagcaagtataataggaggctgtaagacgactaaatactgaggtggaggagaaaagagaggagagagaggagaagcaggctgtaaacttacagccgacttggcacaagaaccaagaaactctgtgagagagacaagtggaccctgtattaattgtaaagagctaactataatatgggtgggctgagagaaggctgcaaagaaccttacagccaataagtcagctgtattattacccttgctcttagagctagcgataaaataagtgcccatatttctctctcttccatctcaacacaaatataacttgtttattgctacagcctgtttacataggattattgtacctactctaacaagtaatcatttgtactacaccgtgaaacagtgagcaaactgatttttctgtctcctagctagactaacactggaagctagatagtactgacaaagaaggaaggaaagaaagaaaaggagaactctcctagctagctttctacctggtgagtgtttaaagtctccttgatattctatactggaaacattacatatggcagcattgtagactaacaaagtgtaaagtacaccaccgatccttgggacgtggtgtcactcagtggcagagctaccacccggcgacaatgggcagccgcccgggctcatcggcattaaatccattaaaatttcatgtaattagaaaatttgaaatagaatatatgtagtaaatactagctataatgaagtttactcgggctctaaaatattttctagatccgctactggtgtcacttagatccacgatattgtcaatctgacatgtgggtccatgatcctatttcaatgaaccatcatggtctaaaagcccatctgactaggttgaccaccgacatggctgtctagtgtggtcgcaactttgcagtttgctctctccccacccggtcaacccacttctcccccaaatatctttgttatgtattgttttgattcagggaacgttgtatcgtagcggcagcgacatagtgatagggctagcgcagtgacgaggagggatgtgggtagggtggtgtcagcacaggaggaggcaggggggcttcatgaagtgcgtcaataggggaggccatggctactcgaagcaatgcgtcatcttcaagtgctcagagtaagaagcatgatctcctgctgattctgtgcccttgctgccgcaagaagaacatcgtagaacttactgcagcgacacatgctaattacggtcgcgtctccagccaccatagagtactgacgatcgcgagtgccgccctcagagtcatcgcagggctgcaggaat

SEQ ID NO: 90272 - DNA, 769 bp, Oryza sativa
tttctatccactattgaaatacttaactagctagcatactgcaaccgggctttacaggcttatgccgttgaagtttgttgaccagagcatcaatccattgggttgtcattggtatactacaaagttctataatattttttactatagttatattgcactttagattatgacactctttttatatgattaggttagcacatcatgggcaataggtctcattgttgggccagctatcagtggatatcttgcacaggtatcctactaaattttaataccatatgagttgggtgcatgcttaaacaatgcattgacgctattatgatgcttttgtttcatttgacagccatcagaaaaatatccaattctatttttagcaaactcattatttggaaggtatcgttgttataggaaatataattgttctagatggtataactccttaaatgactgattcttgaaaatctttccttaggttcccatattttctaccttgtttatgtatatcgatcttctgcttcgttattcttataagttgcatttggctcccggtaagtgcacaactagccaattttattcttattgatattaatttgggcacacataattcttgtttttatgcttcccttagctaaaatttatcttacctactaaaatacaaaagttaattaatattttgctaatactttcaggaaaataatgtgttttcatttcaaaataatgtgtttcataaaatttcaggaaacactacataaatattcaatagaaagaa

SEQ ID NO: 90273 - DNA, 1094 bp, Oryza sativa
atatttggtggccataaagatgaaggctatgcaattgattggagtccgcttgttactggaagacttgtttctggtgtgtgatcttgtccatgctatatttgtttgtcacgtcctatgctgttttgcttagaaaaccgtggcctgtcctgtgttaatagaacatccatatgctttcatttcgtacatgggcattgagtatatcaatttaatgatttgcctatgcaggtgattgcaataaatgcatccacctctgggagccaacttcaaacagttggaatgtcgatacaaatccatttgtaggacacactgcaagtgttgaagatttgcaggcatgccactgaaagcatatatacttcttggtgctctctagagcactgaacgtttgattatctcaaacatcttgactatatttttgcagtggagtcccacagaagccgacatatttgcctcttgttcagccgacagaacaatatctatctgggatatacggacagggaagaaaccttgtatttctgttagggctcacaatgctgacgtgaatgtcatctcatggaaccggtatgatatgttcacttgaaaattcgattatcttcataaaaaattcttctaatatttcatgaatatacggactaccattaccaggctcgctagctgtatgatagcttcaggatgcgatgatggaagtttctcaattcgtgatcttagattaatcaaggtacttcatattgttaagccacactgttctgtgcttgtcagttgcaaatagcacactgaaatggcatattccctccattgctgtttttatggtttattttcagtttggatttctgtctatgcatttaatattttggaaggaaaatgtggggtattgggtcttttgatagtaatattgatacaagatgattgaaccatttcatggatgaatgatattttgcattttcttgctactagatttgtcaagccagagacgctatggtagataatttgttgcttctgatgtctatatttaatatgcagactcctgtagaatacacgctcttgtgcaaaaatcagtgcagctacgatagttaaacgataatgttaattctttgtta

SEQ ID NO: 90274 - DNA, 2280 bp, Oryza sativa
gctctaggattatcaatagtaaataaatttatactcatctcatcacaagtacaaaattcagataattgtatctctaatgcacttcaatacttatatataggtaagcactggttggggcatagggcttgttgtgggtccagccattggaggctactttgcacaggtagttgttttgttataaattgtaaccatttttttcacagaatattacaacagtattataacttactttgtctctcatttctctcagcctgctaagcaatatccaaatgtattttctgagaagtcaatatttgggaggtatacacaaatggtttgtctcaagatatatttcataaatagttttatcatttattaaaaaagtatatgtgtattttttataggttcccatacttcttgccatgcatttgtatctcactcattgctcttgttgttcttataagctgcatatggctaccggtgagtgatactccatgtatatactacttttatgtgttttacaagactctacttaaaatcactatcaagtttctcacctcttaggctagctcccatatagctctgttaactctttcaatgctatgcataactttacccaaccatgaataggaatgatatatgtcaattggtcacatagttatatttgaagcatgaacatatggagtgtaaattcaatagttgacaacttggaggttttaaataagcatatgatacaatttttaagaacatgaaacacttccactgatttaaaatttattttcttggtttccattatgtctaaaagagaatatgattagtgatgaacaaactaatttgtatttattcttgtactcaattgttgcatgactactgcccaaaaactgtgacttgtgtacttgaagcttttaagtgatattataattattaagacatgaccgcaaggaacaatattaatcaaattgacaatcttaattaccaggagacacttcataagcataaaaatactgaaggtgaaattgaaatgattgacaactcaagaagtacacttgaagaagattcacataaacagaagagcctctacaagaactggccattgatatcctctattattgcatactgtgttttcacccttcatgatacagcatatagtgaggtaatgattttaactgtatccctattcattagaatatgcagattggttaatatataaaagaaatatgtttttcatatatataaaggactaattgattttttatatgtatactagatattttccttatgggctgtaagtgacaaaagatatggtggattaagtttttcgtctaaagaagttggtcaagttcttgcagttgcaggtactccattaactgttgtggagcaacttattatgaccatcatttccacctctcataaatcgtatgtagcactttattcatttgggggtaactattcattcaaagtcggtatatacagatgttcgcacactagatatattgttatactacatgtatatatttcttcctcgacatctagtcaacactccacaatatcaagatgagattctctaaaattttcagaattctataatgttttctcttttggaattaatgtacgaagtaaatacgaaacaatttaccaataagggaatatggtactagaaggaatgtgtaatgctcatctcaactagtgtatatgattgttacggttgttgtattgaaaggcataagtcctaactcctgtatttcttattttaccaaaatttattgagtagtataattatgcaaaccccaaaaatattaatcctatatatgcgccattttaggtgctggtctacttgtgtatcagcttttcatctatagatcggtccataaatttcttggatccatcaattcatctcgtattgcatcagtgagtatttaaaccatatgctcaaaacacatatacatgtttcttagccaagccaaatatcttatacaaattttgtgtgtatattacaggctttatccataccaattcttgctgcttatccctttatgacacacttgtcagggcttagacttggaatagctctttaccttggaaccattttaaagggtgttttatcagtaagtttcaaatattgtttgtcacattccaaacaacatgattcaaggaaaaattagatatgatgtacttatcatataagacataatagcataatatacactatgaaaataattttcattttatattacaagacaaagaatatattttttcttctaaaattcgcaattgtttgatcactcatcttattgtgcatat

SEQ ID NO: 90275 - DNA, 657 bp, Oryza sativa
agtatatgaactccattttgcatcgataccaacagcagcaacatcaatatttttctataatatagtgaacaaatgaccgtgaaaactcgaatcatgagtagaatgcaccaatgctcaaatggtacaccataggcagcataagtaactgaaaatttgagtagcagcactagaaggagacctcaaaagcttgcttgagattctcaagctccttgtctaaatcattgattgcctgtgtgtacgcttgagtaggggtggactggtttgcagtatggacctgccaacatattaaaacaatgagactaaataaaccccaacctgacacaatatatagagtaagcaaaaccttaatcctaccctgacaaggatcttgtactgaaggggatgagggagcttataaccagcaaagaggacgtttgggtccctgtggagctgcctgcaaaatctcataggtacagaacattcaaaagtagcaaaaaataagcaggagcaaattagtcataaaactcttttgcacatacatgcggaggatgttgccaatggtgtggtcctcacgctcaattgtgaatgacccagcattcacaatctttgtatcccgctcatatgataccctgcacaatcataagtttcagagccatatctgcaggactgcaaatacta

SEQ ID NO: 90276 - DNA, 2396 bp, Oryza sativa
gtcctccctctccagtcactgcaaccgcaaaacatccacggaaacaaaattaaaaacaagcttcagagattgctcccttgatccctaaacctcatgtccgtacggtgaacaaagaaccctagactaacataacagatgagacgggaatcaatcaaatcgagagagcaaccaaaaacagcagcagagagaaggaatcaagaaacacagagagagccttgccgtgcgatgatgctccagctccctccccgccgctcgcggagtcgccggccgagctaccctggtcgtcgaggcgcggaggcggaagccggaaggggaagagagagagagagagcgagagaggaggaggaggaagaggagtgggccgggttagggtagtagtagggtttcggaggctaagtaggccgtattattgggcttccacggcctagtgggcctctcatatcttcctccatccttcccactcttctctcttcctcgtatctccccacccaattttgctatatatttgaacttgcaccaatcgtttcattgctcatggttaatagtatgccccaagtttactgcgagcataaatgtatgtgagcatttgcaaatttgccgctagtttttttattttacaaaaatgccatttgaatgactgttctagtggcaattttgtaatattctagcggaagttttacaagatttaaaacagtggcaattttacaattgcctcaaatgtataacttctgaaattcttgcatagttcacacgcggtgaattaatttacggtcgctacaagcatcgtacgacgcaggcccatgacgatgaggggaggggtagaggtggaggggcctctgatggtggatgatgagttgaagcacaagaagcaaaagcaggttaccagagtaatgacatcaagatcaaccgaacctcaattttcagagaatatttacactgctagaagaatgtgcagccaaaaacaatgctggctgagtatgaagtatgatgacagccacagttctctgaaggaaatcatagtgatgtacaaaaaaccttaatacaaggatatcatttcttctatactttctaaatcaatttactacagagagggtgtacaaagatgtcaaaattggtacccagtttctatcctctacaagagcatttccctccacagaaaatatgaaacccagccgagtccctgaccaagatctctttaccggtagctgcagaagtatactccaggaatgagtggcaatcaccacacatgcggacgttcttcacgacgcggatggtttcaccatgtcctgacattagaaggccatacatggcagctagcttcacgctatggtacatcaggaagtgcctcttctggtattcctcgacgtcgtgtagcacgaaggtggtgtccggttcatacccagccttcatgcactcaaggattagcacgtcgaggccagcgtagatgtccttggactggggatgtgacctatcccgtgcgaaaaatgagtgaatagagttgccatgaaatgtccagctccttgctggaatcttacgcatacccttttcacgcatcttcagccttgtgctctcagagcattgccatcttgctgattctgagtagagatttgatgccaggacatatgtggatggatcctgtggttccagtgcgagtagatgcctcattgctagcctccgcatggtcatgttgggctgcctgttacagctgtctagacaagatcgccaaaccaatgcactaggcttgaacggcattttaccgataagctgctctgcctcctcaaaatgaccccagcatccaaggacatgaacaaatgctgcgtagtgttccacagctggttcaatgccatatatgcttgacatagaaaggaatagctccctacatttatcagcagaatttgagcttgtgtagctgcaagatgatatgaccaggagaaaggtaacagaatcaggtttgatgggcaatctctccatctgagaccacaggtccagtatctcatctccctggcgatgaagaagatgagaagtgatcagagcattccatgaaaccaagtctctacaaagcattcgcttaaagacattgactgcagtttccaatgccccacacttgccatacatactaatgatcgcattaccaactccctgagcactcagaagcccagattttgcagcaaagcaatgcatttgctttccgaattcagcaaaacctaaggctccacatgctccaagaacagtagtcaagatgaattcatcaatgaactgaacatcattgcttctaaacatcttaaggaaagtggaaagtgctttctcatactccccatctctgaaacttgcagccagcaaagaattccaagcaatgtgaaaactctcctcgtggcgccatttctcaaacagaagat

SEQ ID NO: 90277 - DNA, 666 bp, Oryza sativa
attttggctggcgctgaggtcccagccagcaagccatccagaaggcttgctgggctgggccacggccgaaacggccaagtgccacctcagcgccaggttgactggcgctgagtttcccaaggtcagcgccattttggctggcgctgaggtcccagcccgcaagccatccagaaggcttgcttggctgggccaaggccgaaacggccaagtcccacctcagcgccaggttggctggcgctgagtttcccacagtcagcgccattttggctggcgctgaggtcccagcccgcaagccatccagaaggcttgctggtctgggccttggggttgcggccaagtcccacctcagcgccagtccggttggcgctgagatagctgccacgtcagctggggatcggccccggccgccacggtggcacaatgtcagcgccagtcccgttggcgctaacacggccaacgtcagcgccaatgtgtttggcgctgaggcgacgacctatttttggttgaagtttttggcaggggttagtttcgaaataagtttttgaaaagggtcaatttgtcaaaaaaacggcccgaaggacgtgtctacgacgacgcgcacgcgtacgtacggtctcgatatatatacacacacatgacacacagcacgcgcgcggtggatcgata

SEQ ID NO: 90278 - DNA, 687 bp, Oryza sativa
acagaccgatcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacaggcagattgttaaactgacacgtggtggacaagaatgaccgatttgtgaccggtctgataatggtcatgtcgtcagcagacagccatattcccacgtcgcgcctgcttccggtggaagtggaggtaggtatgggccgtcccatcagaaggtcattcggacggcagccatgcaaatctccgtccattaatgaagagaagtcaagttggagggaagagaggatgagtccccacacaaaagaaagagagggagagatggtgcatgtggtatccccttgagatataaaaggaggaccttgcccacttagagaaaaaggaaaaaaaacgatcccagaacgatcgggggctggctcgcactttgtagcttcttcatacacagatccaccaaaacacaggagtagggcattacgcttctcagcggcccgaacctgtatacatcgcccgtgtcttgtgtgtttccactctcgcgaacgggctgcagg

SEQ ID NO: 90279 - DNA, 675 bp, Oryza sativa
agatcactatgacaatattaaagttgttgcagggcctactataattatttattacccattagcataaactaagatgtgctaacattgtcttggatttttatatgttctcattgaaattctgtgatatactattgcaggtcagatttcaatcgtttaaattttagtaagttctatacatttattctggagcggggtgatgaagttatatctgcagcagctgtcaggtaaattttatattcatatgctctatgctccaacactttgaagctgttggcattggtcgcaggcatcgccacctcacgatctgttgtgctcatgattaatcaacctagcatttggctgcaacatatctatgcattgaaatttgtttaggataagcagttagtcatctcttttttttgttcaagtttggcttccaacagaactgttgtttcgaaaagagattatatttgcccctcactctttaaccaactgcaactccatccatgatgacatattgtgcagctggcatacttagccttcacttgttattttgcaaattccaatgataaaatgcttattttttctctgtgtgaatcaggattcatggaactgacttagcagaaatgccattcataggaacaaggggcatatataggcgccaagggatgtgccatcggctactcaatgcaattg

SEQ ID NO: 90280 - DNA, 1466 bp, Oryza sativa
tactatatagtactaaatgtgcttcaatgtgttttatttttgttgctgcaggtagtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtcctacgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacgacagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatagatgtatggactggatgtatggactcgactggatgtatagccgaggatcgatgggatgtttttatttcttatatgtatggacttcatatatggatgtattgatggattctatggatgtatggaatgatgttgggattgatggatggatgtatg

SEQ ID NO: 90281 - DNA, 2282 bp, Oryza sativa
caattgcccacaatcttgcatccttcactcttcatcaccgagtgctacattcctttcaacttcagctgcacatcactcagcccagtcttcatcgctatcatcgtccacattgttatcctgtcatatgctgttaggattagctgggaggaaggcacaacctcataacaacaacaacaacaacaagaacaatggccataatgtaccaatctactacactgtagctatcagaaaaacaatcacctgggaggaacttgagagcacttcaatttcgtcatcttctacctgtgacagaaaaatgagggcaaaggcaatcagcaaagtaaacaatgggcgacattcaaattaaaatccctgatcattgttgctaagtaaagtacctgtgtttttctctttttctgacttctgccagctacatccatgtaaatacaattgtcagcttcatatgaagaacactaacatgtactgatgtactcagttaaagaaaagctgatagatcgttgcacattgcactaagagccactaaaatgcatttgtttccccccatgcatcacagcttttacccagcaatatcaagtcttgtaaaattcaaatagcatatttagtatagagccaccacaatagatgttaattccatcatttattccgattcgacaggcttgagatggtcctaaagcttcatgaaatggattaatattttaaatgccccttacatagacaaaagctgaaagcttctcaagtaagcctcccaaagcctttggattattttagaacaagtcttctccattgaagaaggccttcagaggcttaaaacaaatgtaatcgcaccaaggtctattagatgcttctaacaacagacttgctactgcacttaccactcttcttccctgttggatgtttttcctctggacttgctcgctgcttcttagcagcaggtcctgtagaacaatgccaatcacaagtccaatcaaaaggaattttcgttgtgtaataaaggaaaacacaagaaacctagaattgcgtaaatatgaagaaccttttgttgctggagatcctttcgggcttctagtacatctctgaaatagaaatccttttgtcagatgcttaactaatttatttgtaccaggcatgaaaacagataatgttcaaaacacacatacgaaaaaagaggtatgttgtgaagttggttcaattaatgcatcaagcaaacattatatcgaagttaagggtataactgcccactatcacaaggagagaaactattataataacaggtatgaatttccacctttttttcttctgcttttttaaacatgctagacagagtagcctgaacgagtggctccttcttagctgagataggctgcgcagatgaatctgcaggtttaatgtcttcactttgggattcattcttaactgccggactcttcacctgcttcaaacgaagaaagcaaataaacacaataaaattatttacaaaagataaaagcttgatagacattgattcatatatttgaatcttataaaattgagtaaatttcagaaaactgcaactttagtgacaaaactatcagtttgctgcaacataagcgacatgtttcagtttcctgcaacaatagcgtgggaaattttcacaaaactgcaacttttacattatatgctgctacttttacgttatatgcaacaaaagcgtgggaaattaaattcggtatcactaccttctcatccatgtcctcagggacatcaatctcatcgtcattatcagatgaatcgtctccagaggatatctcagtatacctgcataaagagcgagggatctatcaagtatacctttttattctttgcctttttttgggtgggtgggagatgaatatatttgtttttagaaacattagccgttaagccaaataaatacaggtagtaggcaatctttcagctgctaagcaacaactagagtccgtgtgcttttctgtttatccgagagagcaacagaaaagggtgaaactgacttacttcaaggctttcccagcagttctagcagactgcctaactgaaggtgcttgactagtgctttgtgtgttatcctcgtccttaaggtctgaatcctcggaagaatcaatgtcagattcaatctttggggaaagggatcctgtggtggtttcctttggcggtttattgatggtaacagcttcatcacaggaagcacctgctccacctttaaaatcagaatctgcaacagccccatcctaccagtttgaaatgaagaagcacatgagatgagaggc

SEQ ID NO: 90282 - DNA, 2677 bp, Oryza sativa
tcgtcagtcagagttgaggacaacaatttatcatcccctgcacccatagcaaaagaaaaacatgcaattagtgtgatacacaagaagtactactcttgcaagtaaaaacagtaaaagtaattctaagttaaagatgttgaatttcacactaaactgagaagcaaacattaaaactgtatgccagcatcggctgaactgaaaatttactctacgtttctaaccaacacactaatcttttgtccaattcattgagcctgtaagaaattcagcacagaaaagatccgctaaatcatgggtcgccttcgtcggcgacaaaatgcacaacatttggataaatcctactgccaagaaacatatattatacccaaagtgcatacattttttttctggtgttgcctagcacgaaaattcgtcagttaagtgcatatatatttaacttctgatgtcctacaatattctttagagaattcctaactcaacatgcaaagacaggactggattttccacaaattcaaacaaacaaacaaaaaaggacttgtgttatttactgatctcacaatatacagtgctgaatactacacataactgaatactgcatcgtcgcaaaaaaaaaaaagcattactgaatactgcaaaatatacagtgctgaactagcaaaaaggactcgtgttctttactgatctcacaattggtttaggcctttagggtggtcactggaacaagtaaaaaacaccagtaactaacatagcatgtcacatctgcaaattggcagcttcataattcccaaatagaaagtcagaggcatgtcgtgaatgcttcagaatgttcagttactgtcaacactaatcagaattaggttgtcatagaccagtgttaacataccattcagctaccactggtcctgtctatctacaatattcagatgatcatctaaaaatttcgcgacaatcagataaaaatatcgtcaagaaacacaaaatatacccaaagtgaacacaaatttttggtgttgcctaacaataaatttgtcagataagttcagatacatttcacttttgattccctacaacattcttcaaacaagtcctaactcagcattaaacatatgacttgcatttttccacaaattcaacacggacaaaaaagataatacacattgctgaaaactatggtgctgaaaaacagaaacatgtgcattgcccactggattgttaataatctctagtcaatttctagtgatgcatgtcatatgttctttttgcagcaaaattcaagagtacataaacaatattcagcaacatgcatataattgcttaattgaacagtactgaacaatttatggtactgtaaactacaaaatctacattattgaaaggacaaaagggacccgaaaagcagaacattgctcacaggattgtcaatattctagcaaacatggccacaaaaaaatgtcaagcagtcttcatttagtgaactacccaagactcattgatgtagtttaaaatttcaagaactcacttgtgttctaactggtgtaacaattggtcatccgaacaagtaaaatacctctaactaactagattccacatctacaaactgggcagcgtcaaaattccccaataaaaagacagagacaccctaaatgcttcaggaaattcagtcactgtcatcccctatcagaaattcagaattcagaacatctacggcattatcaataatctcaagttacgcaggacatttagaaacaatattcagagtattcagcagcaacatgcatatcaaattagtctgattattacctgtggtgttggtcctaataaggacgatatgtagggtctcctgactgcgaggcaggttgatgagcagaggggtgagccgcccatggaggccggtgcggacgcacagcataaactcatcgtagcccacaatgcccgcaagcttctctctcaggagctgcactgacctcccggcgaactgacatgactcctagtgtacttggccagcgtcagcggctgcggcgtcttcggccgtcacgaaccggatctcccgatacagcgagcacgagctagtcaagttgcactgcacagtagcggaatgaatttgattagttcacatatgattagttctcgcaagaaatctaagattaatctccgacccaatcagcatttgcaacagagaacaaacacaaaaattacgaggggatgaggagacgaagctcacgtacatcggccatgatcggtagctccagcctgtcgacgggcaccacctcccaccgcaacacgttgtttccttgtcaacgttgtcgtcgacggatacgctgcggcggcgagccagaaagtttttgttgccgcgcagatagcgcccggacctgtccagcagaagaacgacgcccgcgggcaccgtgactcacgacgctagagcagccggtggcccgccacatgatggcgccgacctccagctggcaccgcgctcacggtcgccggggtcgagagtcccgaggtagcggccgtaggcaccgcggaggagaacgtaccgcgtgggcggctccccgacgacgagctcgtcaaacggcccacacagcgttgtgctgcaacgcgacgccgccgccgcagccgccgagccggcggtggtagacggaccgcccgtcctcgtcggcgtggaggtacgagtcgcact

SEQ ID NO: 90283 - DNA, 3084 bp, Oryza sativa
cagagagaattttgaaagatacaaaggtcaacatgttcttcctgtgttagcttcttttatggaaaagaaacatcgggagaacgtatgataaaaatgcagagatatcgatttcaacatgcaagaatgtgttagcttcttttatggaaaaaggcccacaaggccggcatccggtaatacaacatttctttacagttgcaaaataccgaaacttctaatgctccctagcccaatgatcatgcgaatcctcttccatctccagatctcctcatctctcgaatggcaatcgcttcaacttcaatggaaggcagccagccagccacaccgtcaacagacggttcgcccgaagcagatcgatgctatgtacagatttttcgcccatttatcctgcgaacagcacaccggctatgttactgaactccgaaacgcgagaaattatgtttgttttttacaagacacggccggatttcaatgagctgcgataatgtatataccttgacatgattactggggaaggcagaggtccggagagtttcttgtgtctcgtctactggcttccgtttcggtatgctcaagataaaagcagcctggtcatttgttgctgctattgaggttattctgtaaccagtctcccatcgccgatggatgccttcacttggatataggaaatccaattctacaacctaaaaagggcatgagaaaaaggttagcttcataagtagatatattctacagtaaataatggaatgctcacaggaatataaattgccaaatttgtggactgaatatgaactaggtcaagcaattattctaacctgttcagagtaacctgagttccttgacataactacaccccagcgatttccagcggtggccatagatgtcacatgaaaaccttctttccactttttattgatccacttgaaggggaatgactcactaaccttgtatgactgttgggagtaaggtgttcctgcaataatggacatatcaaactataggtgatcacaactaagccaggttaactcatggggagcaacaaaatgattaagtccatatgaaacatatggataattcatcgtcaaagaagaatggtcgggatataaaatgactaataagaaacacatcccagacctttggacatcacaactaaagaacttccgttagctgatccagctattgctgttatgtagaaattcttctcccactgatccattatccagtcctatgtataattgaaacagagttaggactctcagcaaacaaataatccaagtactaattatcacacctcaacagattgtactttaccttatgcagaaaaactggtgagagctcatgaacttgagaaaggaaaccagttcctgcatccattatgagggcccaaagatttgctgaagacgccacacaactaatgtatagaccatcttcattacccttctctatatgctgctgaagcctgttgtcagccacgttatagtggtacctaacaaagaagtagcataacttggtattaatttccttgtagcaacaatattgtcacaccataaaagagtgataatgattcatcaaccaaatttcaagacctgttcaagagaaaggcatgcacagagaatcacaacaagatgacattgtaaattttgaaagaaaaaagaaacaagcgcaaactaaaacccatgatcactagcacttacaagctgtattaatatcaggcacgtgctgtctagttagtgaagagttatttagctttttagatttacaactatatatgctgcactcaaatgattccaggactcaggtcacttttagaatgttctaatcagcgcaccagagttaaatgtatcatgctaggttttgggctatcaaaattcagatgtgacaattaataaatagttagtagcaatcaagatcatctgtattgggcctgaaacggtgcatgtttaaaaagtagtttgtctggactcatggagcaggagtaacatgacatgtgatccaaatttaacatgaacaatgtgcaatggattattatcttgaattaaaattaaatggtctgtcaggtacccaaaactgtctttttaagaaaatgtcgagtttgatttgacaattcaaaaaaaattaaatgaaatatttaatttatcacagacaaggcagtaacttgtgttttcaaattactattgtttgcatccaagaaaagcaagtacctagactaaacaaatgcaggtcgatcatgctttatatcatctagttctttgatgtaattacctttgcttcatggcccgcctggcgttataaacagaaatccattgagctgctgggctacctaatctaactttcttcttgggttgctcatcttcttcatggtttcttccacgtttctgcccaacctataatttaagagaagggttcatggacagatatggagcagacctaaacaaaatatggaagtgagtaaaatggtgggtggtacagaccttaagagcgccatcaattctgataggtcttgaggcaggtacccaatcaaactatcaaagagagaaatcagtttggcgtaatttggctcttcatcaaatttcatatttgtgacaacttcaagaaactgtttgaatggaggtggacagaaacagcttagcatctccggagaagtagccattttcttcttgcaaacaaggaaactcttggtatcaccctgcataattaagcaagcaacattagaattggctaatctgaactgaagttggtatcatgaagttaataggcatattaaaatatacctggtaaccttgccaaggcaatcttcctcttattagaaatataagggtgtacgccaatgactctaaatcatccctcctactaccagtacggcctaaatgggcatggacactggcatatctaattgtacccctgaaaaaaaacgaagataaaaataagtaaaaagcactatatgagagacagatagcaggtacagagagaatattgccaacctaaagatatcaggcctttggtcataatcaacatgttgccctgatgactccctccatttcgatgctgtacaatttggacaatgccatatcatacaaaaaatacttg

SEQ ID NO: 90284 - DNA, 680 bp, Oryza sativa
gtacagaatagacaagtattaaagttccatatgtttgggctaaatctagaacaaaatggaatactgagagtacaaatgcaaggagaaggctacaagcaatggatttgatttaattgaatgaacttcaaaacctatcaagagctaacaaatgtaaatggaactggcaattcgtgaagagattttaagaaatactggagagatgtcattactcataccctctcagggacaggtagtgatgattcatcgtcagccgcaacaagcttctctgcgctttccccatccattcgcaaacccttattggcgacaacctcaggtgccttaacgttctttgcttcaccaacaactgcctgtccaacaacaggtttaggggaatctccacgaccctggccagcctccaaatcaacaacctcaaccgcctttcttctaccccttggtgctgctccccctcttctcccagcagcaccctttctgcccctgatagcagggggaggaacacgctttcctgctctctgtggagcaggcaacgctggtttcgcagcctgttccgctggcttctggtcgtcaggcttcctagacctcagacgtgcttggcgagtactgcttcgcagctctggcatcctctccccatgcaactcaggtcacctctccagccctctgggatccttccaatctccacatgc

SEQ ID NO: 90285 - DNA, 4211 bp, Oryza sativa
  unsure (1)..(4211): unsure at all n locations
ccactaaagagcagttttggaacgacatctctcttcttcatctaaaaaacaagtataagcaacacatgcagcatcaagatattatcttttaatatgtatgatacttaaaacattatgttttaaggatacctcacatttttctaaacaaaactgtaccgcatttgtcacatataaaaataaaggaaaatgctacacacacgactacggcgtccgactgtcgtacgaccacagcgtatgcgacgtaagtgacgtgatctatttgggctccgttgtgattctccatctcattgggccttcgaaaagcccaagtcgaagctaagcagctaaataaacgttttctttgcatatcttgtgaaacagtgatcaaacttggttgtagtcttgtgatttcattcggtgaactaaacagaacatttgcatgttttatttttatttaagaattagaaactatgcctgtggtggacatcattgcatttatattttgtttaatgcaacttgttatagccataaaaatagaacttgaaactgtggtatatactctctccgtttcatattatagtcgtttgatattgatcaaagttaaactactttaaatttaactaagtttataggtaaatatagtaatatttacaatatcttgggttaaaaatgttactacttttttctataaacttaggttgaaaatgttactacttttttctacaaacttgatcagacttcaagctgtttaactttgatcaaagtcaaagatacttataagctgaaacggaggagtatattaagtgggtaaaaaaaacttgtctggaaaatgagcatttgtagctgtgaaaacattacaagagaatgttagagatcgaagttagcaggcagtgattcagatcgaccaaaactccagcagaactgtcatggagccatgtccgccatgttaatgctgtcttcctgagtttgggcttagagtctagacttgtatatggccttgcatggcattggaccgattcatgtatagagaacgccgtcacgttgttcgttgttgccgtttcagtcgtacggtagtcggatgatttgcgtcggacgtatagcagggttgaaaaataaaacaaatcacattataatttaaaaggtatactttactatctcaaactatttatttaggtattccactttgatcctaaataatttataggctcaattgaccatctaaactattaataatggtttacttaacccttaacccaatttcgctaggttgttttcgtcaacatggcaattttgatcaaacatgctgctagatcatgccaacgccaatgaactatttggcgatgaattctcttacttcttatgttacgcaagccatgattctatgagatcactacacacgtgtgcatggttatgacctgcattgatcttagcagcatgcttcattagcacagtcgctcatgacttatgagtagacgatttcgttataaatagccaacaagagagcgagcaggctangcacccgaaggcaaacatatgtttggcatggtcatcattgagaatagcggtgagattgctaatggatgggcactatattagagtgagaaggtaagggaccttgcataagcgatgaagcgttgaacatcacaccaagatagacgtggcgagtattgtctttcttggcctatatggctgaaattgggttgtgggtgacatgtgcaacccatgtgctatgacttggtagtgaacctcgccagctcattgatctgtttatctgtttgattaaaaccagtgccacacgggcaaatggcctagcaaaattaggtagagatccagtaaaccaatattaatagttttagggttggttgagcctttttttcttccataaagtggattacctcaaactaaggcactgtttaattcagcttaggatgattataatctggactattagaagtaagctgaaacaaacagatagcttattatgatagattattataatttataagctagattactataatatggtaatccactctaaagatgctctttttaagattactgggtggctaagagctaacaaacaattaataatctagggaaataaacggctaacaacttatactacgtccgcttattataatccagattatgattatagtaatctagctcaataatctagattccaataatcttaaactgaaataaacagggcctaaatgaggtaataaagtagacttcttttttcttataattaaggattagagactaacatatgtaagcaagggtgattcattatcttaagaaaaaaacaagggtgattgagtcaactgagcgtcatcctcctcactatcaatagataaaaatataaaatgtgttggagatatacaatattgataataatctaataatctataattttatactatagttattttagttagtgagggataattatgttgtcaatgttttttattctgaccgtggacatataagactaacctatcagcgttagggatgatcactcctcttttttaattggctattgttaattatatggtcaaatgtactaatttttgaattttccttttgtctctctatacataaatatctaatttatatacattgaccgtcatgaaaacgatagcacatcaacccgatcaacggacaccttccaataaaaaatatagtaaacagttgtgagagatactcacaattatttcaacgttagatagatcgacaatatactcattggcacgtggttagatcgttgcctcttgacatagagagtgatcacaagcgaaatatttattcggaattttggtatattctgaattgaaattgttccaaatacagtgctaaaggctaacattaaccacttccatattatcagggaagaattataaacggagatttccaaatgttgccaaaactaacactaaaaaccgtaatcaaattaggtaaaagggcaaatatctaatttcccattatttgtttgttctattcccagacggccgcaacccctcctctctctctccgccttctcgactccatcgattccaccccctactctcccatctcctctgcttccgatctgcgccgccgcggcgggagggtctccggcgaggtcaaggccccccccgtctccggcgagatcgtcgcccggaccctccacctctctcggtcggttcggggaggaggcgacgcggcccggccgacctcctagtcggatcggatcgaatcgaaggtatccggattggattggtggtcgtagattagattgggaatccgtccttgcctggattggtttccttctcgattattaataactcgtgtagtagtttttctttttttttcttcttttttggattgattgatgcgtggatgtggtgctaatagcggcggtttttgcgtttgcagtggagaagattgggggtttaggtgaaatcccatgccaccggttgcgtccggctccggccggaagaggcagctggtgctggagtccagcgattcggaggcggatgagttctttgtctcgacgcggcgcaaggaggatgatgatgatgatgccggaaatgccggcggcggaagcggaggaggtggtgatcagggtggggaaaaggtggtgactgttagtcctgagaaggtttctggtgccaagtctactgatgaaggaggtggttcagacaagagcaagggaagtgaggtgggtaagagtgttttgcaacctgatgtgaagaggatcagaactgaggctgcccatggtggcggcagcggaagcggtgggagtgtatcgaaggatggaaccggcgggaaaatgctgcgcccggggttccccaagtggcgatttgagaagccggaggtaagggcagggcgggttcttgatgagaaaggtggggtcgagacgaaggtaagcagttcccaaaaggttaaggaccatgcatcgagttcggtttatgagagaagacggccagagccactgaaacctgagaaatcgacgccatcgaagactaaccaagaggttataagggtacaagggaaaagcggtgtcttaaagatccgtccgaagaacaataaggtggctagtgaaactggtgatggcaagaacctgccgaagaatgctaaggtggatggggatactggtgatggcaaagttctgccaaagaagactacagtggaggaaaatggtgatggaaagattttgaccaagagtggtgttttaaagctcctcccaa

SEQ ID NO: 90286 - DNA, 667 bp, Oryza sativa
agcataagtagttaccaataacaccccagagaaaagggacgagcatagcagcaattctgcggatgcaagttccacttccaagatagatacagggcaggcagagcaaagatgtgaagtttgaagtaaccaggctctcgaagacgtcctcgcagacaacgcccttggtggacctgctcatctgcagtgtcagatacttgttcttggggtacacatgcgtccccaacagcttcatcctcccctgaaacattcattacccacccacaacatacatatcataccatctcacctacctgacggaatagatagatagatagatagatataggatacctgtgggaagtcgaggtagagcagaggatttttggtgccaagatcagcgagctcgccgacgcggccgcccgaggcagcagccgcgggcgcgaggaggccggggaatgagaagaggaagcggctcttgcgctgcccgccgcggcgcacgatgtcgcggccctgcagccgcgacacggcagtggagggcgcgagcgccgagcgcggcgccgccggctccccgcgctggagtaagccattagagaaggcgagggagcggaggcggcgccgctcgtcggcctccgcatcgccggcctccttcttcttcaccatccctcctccctcctccttcttgcccttct

SEQ ID NO: 90287 - DNA, 553 bp, Oryza sativa
gagcatataccagccatgtcttcttcaaggccgagggtgagcgcgaggcggggcatttgtcggcgccacgagaagctgaccacaatcctgcggtaaatcccccggtcctccctctccgccacggcgaacgtcgccacgtgctgcaggaaggcgtgcgcgtcgggcggcttggtccactccaccccgcccttgcgctccgccgcctccttccactccctcgccatcccccgcgcgcgctcgcgcgccgcacgcggcaccagtagccttgccgccccaatctccgggtcaggatcggccagcgccggcaccgccgcctccaggatgagcacgcacgcccaggccaggtcggtggggttcttcgcctcgcggcggtccacggggaacacgtcggcgaccgcgtccatgacgaatttggctggatccacgcagcacttgagcgcgggcggcatctcggcgcgcagcgcgtccacctccttccgccgcgcgaccacgaacccgaagaaccccgcggagtccatcctggcgcacatcgccctcaggctctcggccaccc

SEQ ID NO: 90288 - DNA, 866 bp, Oryza sativa
actagtggatcccccccttgggggatgaggaatgcctccacggagctgagattcaacacccgttggatcactatcttgaagtcctcagggtcccagtcccatttgcgcccatggtgggtcctcatgatgtcctcgggcccggtgtactcccaggcgccccgggcgcaccgctggggtggcgcgatccggtgacgaaggtaatcgccgtacaccatggcccccgtaagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgttgaaccagtcgctcttccagtcgtcccacttcttgtgaaggacgcagggaatgtagcggttcagcaccggcccccgcggctggaagtagcagccaccaactaccgacggtggcgacaccggctgtacggtgaagaaccaccggaactgccgaagagatgggcgcaccccgatgaacatctcgcacaggtgcgcgaagatggccaatgtcattaccacgttgggggtgaggtccgccatctggagatcataaagctccagaacatccatgaagaaagaagagaatggcgggaccagccctgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcacgatgcgagaaggcggcagcacgctaccatcgagcggtgcggagccccgtgccatgacgcc

SEQ ID NO: 90289 - DNA, 839 bp, Oryza sativa
  unsure (1)..(839): unsure at all n locations
ccagaccacacgaatcggtggtcttctgnacggcaaataggaagacgcggtcgtctccttcctgcgggcaaacgcngacgtcttcgcctggagaccggctgacatgcccggggtccccagagaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcctccatccggagtggctggcgaacccggtcgtcgttcctaaggcgaacggcaagcttcggatgtgcatcgactacaccgaccttaacaaggcatgtcctaaggacccttaccccctgccacgcatagatcagattgtcgactccatcgcggggtgcgaccatttgtgttttctagatgcatactctggttatcatcagattcgcatggctagggaggataaggaaaaaactgcattcattacccccataggaacttattgttatacgacaatgcctttcgggttaaagaatgcaggtcctacttttcagcgtactactcgaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaacctcgataagtgcgtgttcggcgtgcctgcgggcaagcttctcgggttcttggtctctgcccgaggcatcgaggccaaccccgagaagatacgagctatagagcggatgcgccccc

SEQ ID NO: 90290 - DNA, 801 bp, Oryza sativa
aaacaacaactactccgtagtagtgtactactccacaagcgattgaaagccaaaaaaaagatactactaattgattgattggttgattgattgattaaggggatatatgtgaatgaagaatcaggcccagactctcttcttggggataaggtcgaccgtcttgaccttgtctatgcgagccgcgacgatgaagtcattgacggtgaggccgccggcggagggcgtctgcagctcggccctgacctggttgggggcctcgaagacgacggtggccggggcgccgtcaaccgcggcgttgatcctggcgacgagctcgtggccgcaggcttcgtccctgaccttccagacgcactgcagacgcatgccgtcggcgtcgtcgaggaggcgccagccaaccaccttgtggaggaggcggcgggcgtcggcagcgtcgacgggcgcggggttaggctcgagggggaggcgcgcgatggagagcacggagagcgtggggatgaggatgttgtggagggtgtcgacgttgcccagcaccctctcgccgaagttgctctcgatctcctccgggaaggggtcgcgcgcgccaaagtcgcccagcaggtcggccatggccaccaccacgctcttttgcttcctccgcacggcgagctgatgaggcggcggcagaggaacccgccgtccgaagcagcagctgctgcggctgccggcgcgaggatgtggttggtgagcgccattggattggattggaatggcgatgaggaacagctgcagccaccagtccaccactccactccagcagcgagc

SEQ ID NO: 90291 - DNA, 652 bp, Oryza sativa
cgtgggtgatcataggtgcaagaatattatctgtctgccataataaatagagcaacataataatttaattatttgtttctattattgatcgacccgtgaagttcaatacacatgggacatgggatgaagaggttatacctggatccactcaaagccaaggtagaaagccaagattccttcaagaagaggggaatatatcttcctcatttgccgcctttcataccatgctgaaaaatccaaagctggagagttcagtaatatatctctgtagtgatgagcatatgactgctactagtacgattttgctactgcgactgcactagctagaacaagactatatatacacctgcaaatagtttcttgagattctctcgcccagtatttgaacgcattgctggtgtcaccacataagtaggatctgcaatcatacaaatatatcacaacatgtatatatatatgtcacacttggtttcaagaatcaatgccacttccttccaaacagaaaagcatgcaaattagagtcacctttcggggcagtagccacataatagagtgatcctgtgagagccgcagtgatggctgctgcaaacgtttgagcaaatggaacaaatggaggcaccatgccactctacacatatcaatcagcacagtt

SEQ ID NO: 90292 - DNA, 1068 bp, Oryza sativa
cgagcagcgcacactacacgggctgcagtctgctgcaagccgggagaaagctgcatcaacggagctcaaccaaatggctgaagaggccagacggcgtgctgagattacaaggtcagttaagtcgttatatatatatatatatgtgtgtgtgtgtatgtatgtatgggagtctttcttcaattgcatatgctcgatctgctgctcacgaaatgaccgacatctctttcaaaacaaaaataaaattgagtgacatttgtttccacaggttgagggaattgcacactctgaaaggaaaggtggaatctgtggctaaactgaaaggaatcgacttggaggatgtcaacaatcaacactacactgtttaacctacaacacgacaatgcattatgcattatgccatctctgaacatcgatctgactccctagacagtagtattgtttagtattttcctttcccatcccatttggtttattgcatgtggatcgaacatttactctcctcgtaataaagttggatttattgtacctcactcagatctttgcatgtactactatactactagtagtagtccatgagaccatgaggcaggtaacgttgacacctaatatagagtataatggtattcttaagtttttggaccatcagttcctccttttgtttttggatgatccatcagtcagtggtctttgctgtagctagcctagccataccatagtggggtacaagtacaccacattaataaacaaacctagctcctgttgtttctctctgtatgagtctgcaggttgcttaggttagtataatgcgggtacgcatactcttgtagtagtgatgcgtagtgcctgtccacgccatttttcaatgtcaacctgtactttgaggtagacctaacacacactttgatcaatttaatcatatacagtaagtagttgttgccatgctagtaaactttatctattgaaccagctaatataagtactactccctctatttcagaatataagaaaccagatattttttattactacgaatctgaatatgtattagcagtttaatgtgtccgctca

SEQ ID NO: 90293 - DNA, 741 bp, Oryza sativa
agaccagtgcgccaaccatggtgtcgccaagttcacccgccttctcgccgaatggtccgcctcccatggctactgcctgtactactacactacactacatctctctttctttctttttcagtttccttcccttctcaattagattaattaattaattaattaattacttgtgctactgcctgctaatgatggaaaacgcatagtgaaatcggaagtggaacatgggactcttggttaatgcctcttcagaaacaggtccactacttgacttcttcaatctagctagcctaggaatcttgtttacctactagtaccagtaataaaaacaactctttctatattctttccacatagtactaatttctccctcatgtctcaacaggctgatattgtttgcagtaaggtgattcaactttcccttttggataataccttcctacgctatgatgatgtatgtatcatcactggattgtacccttttcttttccaggtaaaagaaatgaaggaactctccaatggttacaatatagttggtctttcacaggtatactcttgcactgctgtctgtattgtttatggttcgcgccacttccttttaccaactgcaatgctatgcagctgttttttttccacctgctgtatattctctaagaacagagcactagttactcaaaacattacaggaagaaaaatgattccatatcaatcgttaatctaatttgctctctgtttttgtatgct

SEQ ID NO: 90294 - DNA, 2410 bp, Oryza sativa
  unsure (1)..(2410): unsure at all n locations
gggccgtttatctggacagaggaggctgagcgggccttcacttagttgaaggcgtacctcagttctcccccagtcctggtcaccccggagccagatgagccgctgctactttacctggcggcaaccccgcaggtggtcagcgcggcgttggttgtggagcgcgacgaggacaaccctcaccccgcgcatccccaccctgtgtcgactcgacccgggagagagcaggcaggagaggcccccgagtcgaacggcggcccgaggcccccgacggccggagttggccctccgcccgcttgtccgacggtgccaggcacccccgacccccaggatggccccggggccactgcgggaaggccgcgcctgtcaccctccgaccccgaggtcgtcggcacagaagccgagtgcgccccgcgcggcctctcggacgaagagcgccctagagatgcggcccctagcgaagaggatcggccccgccgaaaggtgcagcggcccgtctacttcgttagcgaggccctccgggacgctaagaccgataccctcaggcccagaagatgctttacgctattctgatggcttcgaggaagttgcaccattattttcaggcgcatcgagtcacggtggttacgtcttaccccctcggccaaatcttgcataatcgagagggtactggacgggtggtgaaatgggcaatcgaattctctgagttcgatttgcactttgaaccacgccacgcgatcaagagccaggccctcgccgactttgtggcagagtggaccccggcccctgagcccatctccgtccccgaggccagctcgggcccctcgcagctgcctcacaccgcctactgggtgatgcagttcgacggctccctatctcttcagggcgccggtgcgggggtcatgttgacctcgccaaacggagacgtcctcagatacctggtccgcctcgattttcgggcgaccaacaatatggcggagtacgagggactccttgcgggactcagagtggcagctggactggggatccgccgcctcctggtgttaggcgactcccagttggtcgtcaaccaggtctccaaggagtaccagtgctctgacccgcagatggacgcttacgtgcgccaggttcggcgtatggagcgccattttgacgggatagagcttcggcacgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacacgcctgaacggcccccgaggcccgtcggagtccaggcctcgggacccgaggggagcgttcccggctcccctagattgattgcttggatcgctgaggtccaggcatacctcacagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccagcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcactccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaatatggaggagttgccagcggtgctctgggcgaaccgaaccacgccaagccgagcaaccggggaaacgcctttcttcctcgtctacggcgcggaggcggttctcccatccgagctcaccctgaagtcccctcgggccaccatgtactgcgaggctgatcaagatcagcttcgcagagatgacctcgactacttagaagagcgaaggcgggcgcgcggnncctncgagccgcgcgctacagcagagcctgcggggctaccatcagcgccacgtncgggccc

SEQ ID NO: 90295 - DNA, 1855 bp, Oryza sativa
tctttttgtcgctcgcaggcctcccctttcgggtggcccgcgaagcgccctcgacggcgaggacgtgtccctcgtcgtcggaatgggccgacctcttcttcctcctcctgtcccgccgccctgaccgagcggcggatccgggggcggccgaagctgccacaccggaaccggtggagttccaggtccaggcctcttccttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttgtgaacttgacagaaccgctgaatgtacgagcgaagagactcatcgtcccttcgctgtaccgcatgcaagtccgcttcctcacctgggcgcggatatgtgccttggaagttcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatccctgtcgtgtagacctggagaaactcggcggggttgacgcttccgtcatatttttcggtaatggtgggccggaaccttgggggccaacggacgttctgaaggctcgccacaaaggctcgacagccgacaccaccaaccgggggcacggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggcagacgaacggcgggtaacggctgccgctcgccgcgccctccgcctcgacgacacggagccggcggtagcagcgccagaggccttggtggcggaggaccgcccaccggcgcctaggcgctgctgcgccgtcatgaccaagtcggccacgtcatccagccaacgtcgggctggagtctctggatcggggacaacgggcgggtgacgcaagagcgcgcccgcagcttggagcgcgccctggggcgtgctgccatcgccgtagacgaggaggcaacgctccccgtctcgccgtccttctccatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagtggttgtgcgccactgcccgttcggccattgggttgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagccctcgatctgtggaatgtttcgcgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctcttcctctttctctcctctaccagctcaggtgttctcccctttcttttttctcttaagtgggcaaggtcctccttttatatctcaaggggataccacatgcatcacttctacctactcttcttttgggtggggactca

SEQ ID NO: 90296 - DNA, 5425 bp, Oryza sativa
  unsure (1)..(5425): unsure at all n locations
ttgttagagaaattgaagtatacaaggcagaaaatccatcgatgaagttaaaagtttactttcttttttatgaagattctgccgaggtacaaaaatttgagtccagcattcgccgggaaaatgaagcatttgaatctttgatcagacagaagtcgctgatgatgatacctgttgatcaggtggtgtaccactctgctaaaattcgttaaatcatcaaggattaatttcagcttgatccttgcgtaatgttcactagtatatgaatgcagacatactatgcttgattaaattactattacactttttatctaatctacatgtgaacctcatattgtacttatcttagctgtcagtcaaccttatgtgagcaaaagtgccggtgtgcacatggagaaaattccatatatttccctgatacatgaaagcacatctgtcttcttttcagaatggccgttgcattggaccaactcttgcaaatgaaccagaagctcttttatctcaaaattcactaacaagaaaggcaggtggtagaaagccactagagaaggagatgcaggtgatgcttccgtccattattttgactaaggaacaatattatttgcttttactggctgaattgctgagatgtttattgttgcatatccttctaggttattgtggacatgagagaattcatgagcagtcttcctaatgtattgcaccagaaaggtattcgaataatacctgttaccttggaagtcggtgactatgttctttctcctttgatctgtgtcgaacgaaaaagtattgcggacttgttccaaagctttgcttctggtcgtctctacaatcagattgaaaccatggttcggtattacaagatcccagtgcttctgatagaattctcacaagacaagagcttttcctttcaggtaccccctcgccctcctctgccatgcattttcttttcatgctactatttgccaatttggtaggatattcgttcttagatggatggtatcttgctccctacaaacagccatcccatgttgtctttcgatcttgagcaaattttaatccatttccgactatgtgctattttatattggttttcgtgttcaaaggtgctgaatggtctgtttatttttcagtctgcaagtgaaattggggatgatgtatctccgacaaatataatctcaaaactttcattactagtcctgcattttcctcggcttcgcatagtctggtctcgcagcttgcatgccacggcagatatattcctatcactcaaaacaaaccaggatgaacctgatgagagcaaggcaatgagagttggtgtgccctctgaggacggagttgtggagaatgacgtgaggtaagttgtttttttttgtatttggtaacggcataacgcacgcggaagcatacttatatctgatctactctcctcggtaaaatatgttttcgtcagggctgaaaattacaatacgtccgcgattgaattcttgaggaggcttcctggtgtgacagattcaaactatagaagaataatggaggaatgcaatagcttagcagagctggccctgcttccggtagagcggctgtctgagttgatgggtactcagaaaggggcacgcatgctcaaggaatttctcgatgccaagtgtccaactatgctctagggctgtgtaatcttgtttgtaattgttgaaaatgatcaataatgaacttattattctacttagtaaaaccgattttaagatgtggatggtgaagagtgatgaatgtacaacccttactagaaagcttgggtcactcggtcgctaaaccatcttgcatatggtgctgttctcacaatttatttacgaggcggttgtcacaatttaactcttgcattcttttatgaaagatctgtagattttttttctttttacagagatggagttatccgaggagatgcggaggaaatgaacaatttaaattcgttgggagacagaatgggtaaatgggccgaaggaaagcccatctagagagcaggaaagcccaagtattaggccttgcctcctcctttgagggaggtggacggcgccgccagcagcggaaaggaaaccatggcgctcgccgcccttgagaggtgcttccaggctgtcccgacggacgccgtcgcgggcatcgtcgactgcgtcctcgcttcttcgtcctggtcctcgccctcgcagctcttccacgccctcctccactccgaccatgccgccgcgtcatctctccctcacgccgccgcgctctgccacctgctcgccctgctcggtaagacgaagaagaaaacccctatctactccgtcctactacagaggctacagaccgaagaagaacttatacatgatgattgattgatgaaatccagatcaggagcggccggcggaggattctgtgcgcgcgctgctatggagggtcttcctgccgctgcttaggcaagaagaccagctccagcacaccattgccttgatgtgcgatgccgtctccaccaaccaatccttctctgaccttctaggagctaccatcttgcccttgtgtattcgatcctccgccatcgccatggatatggatttggattccactctactgtttgtgtaccaaactggggaggacccgccgcctccagctccaggggggcttcttcttctaccaatctccaaggccaccgctgtcctggcgtcgttgctccaacacacattggagaggaacaggaagagcacaagcctcaatgcgctgctgcacaatttgacctgggacctctcctcgctggcgctcaacatgtttggccacagccaagagtatcgatcctgtgccacccgggtcctcctacaccccctgctcctttcgctcgcggatgtttcctgtgtcaccgtgcacctggagttggctgcagctcctcagcttaagctctcaaggtttccgtttcctcttctcttctcttctctcctcttctatatgcgcctgcctcaccctacctactattgattgtttgtctcgtgcaggtctggcttcttggagtctatatgggcctcctgcctttctctctttgcactggggcctgctgagcgcctggatgcttataatatactctctctctacttgtcaacactgaaacatgttatcttgggacctgatgagtatgatcttaggaattccaatgatttttgggatgaaattcgcaggggactggtgcgcgtttctgctctgactgtttctgctagtcttttagctctttatactcatcctgctgcttaacctcttcacaccaggttgacaaggattctttagtgaggaagcaggctttgtacatcttgagaatatcactagacatcttttcctcatctgaggataatggtgctcagcaatgctccaggaggaggtccgccgctctgcctgctcaagacaaatcaaatactgcaatgacaaaaagagaaaggtgggctcagaaagaggccaaatcccttggcattggagaaatgagccaatcagatgaaaactgctcaagtggtaaagaccggtggaaagttttcctgttactctacgagatgctccaggagtatggaacacatttagttgaggcggcctggacacaccaggtcagttggttcctacatgctctttctttaagacctgtatatctaagtgtcaacacaatatataccaggaacaacagtcatagcacagcaataaagtaaccacatgcacgttctattagatgggttgataaatttaaatattatttcccaggtaatgctgctgtttgagtccacaccacggagtgattactcaaatcacatgtcctatacagttttccatgctcagatggaatctttcgaaggatttttccactggatggtagttctttgggagcgtgggtttactcatgataatccccaaggtcagtactgacattgatatatacagagtgcatatgcttaaaacttacaatgttgtcttacaatctgctgttatcaatgatttttacagtgcgctacctggttatgcattcctttttggatattacatgggaacactacttggtttgccctcagatagttcccagaggctttgttcttggaccactgttacgtggtttgaacgatgtagttcatcacaaggattttggtcagttacactcatattacactaaattcaatataaaatcaacgtattcttctctgagtaatacaaagttctttttttttgttttatccccaaacatgtgccttttttttgtatgttttcttgtgcccatttcctttttatgagatattcttgaacctctagctatggggaatatcatattcttctacctcaaaaatccttgcctggaacactcgccacctaagcttccatttctttgtgaagtatagatctgaatatttcaaatggcagactacttgtgaaccaaaccaataaatgactgaagaagcctattcgttgatgtagccattctcagctcatatgttgtgtcatcctactttattagtacattatttggtttgatctttagctaccccaacttgcttgggactaaaggctgaatgcaaatttttgtccnngtgattattaccttccctatcantgctgtccttggacaggtgtttcactatttatgtttagaatttgaagttgaaattctaaagaatactgcactgctacatcaaaactacttagcaatttttcgtgctgattctgtgcccaaaccaaaagttgattgtgagtgcactacaaagggcgattatacttggtttgttccttgtttaaaacacctgagttgctcttacttttttgaaagagaaaaaaaatgagatactaagaagaaactgtttgcatcatgagattcttcttcttgtttgcaccgttctcttctaactcttttataatactagtatttgattattctttctggttctgttacanactgttcaacagtttattaccttttaagtactgagttgtctatctaactattttaggtgtgaagggtgtttatgattcaaaaatcataaaaggtgcagagaggttctttggtctttacgcacagagattgacaacacggtactgatttttaaacaactactaccttttttcctgtgttgcacctcgatgaaaacatggcatgcgaattctggtactttggattttggaaaggattttagttatcttcactactttcaatgattgaaactatggtggttatggtttggcctacaccacaccctgttctcatttccctacacacagaaattgcgcgccaacggccaacctgtgttctgtttatcttccccatcaatcccctccttagttggccatcaagaactcatgttcaaatccaaacacttctagtattaaaaacaacatgctttttggagaacgctttctccacatgtaaatgcgggtacatgga

SEQ ID NO: 90297 - DNA, 3280 bp, Oryza sativa
  unsure (1)..(3280): unsure at all n locations
ccaaaaaaaaagatatactaatatgatggacgcagttaattgaactcgcatcgatcgcaggagcacatccctgtggaggaggtgttggatcacctaaaatgcacgcgcgagggtctcacctccgaggttgcccagcagaggatccactccttcggctacaacaagctcgaggagaagcaggaaagcaaactgctcaagttcctcggctttatgtggaacccgctttcctgggtcatggaggcggcagccatcatggctatcgccctcgcacacggaggaagagatgccaggggaaaggtatattcttcatcatcatccactcttcttattgattttggacaactatagagtatacactacctacctagattagctgcttctaattgcaagtgcaaccatcaataaaccaaccacgcagagaatgcgcatagactaccacgacttcgttggaattgtactgctactctttatcaactctaccattagcttcatggaggaaaataacgctggcaatgctgccgctgcactgatggctcgcctggcaccaaaagctaaggtgcgtatacctctacttacctggacagctggacttccaattcataaatcattctactagttaattgaatttaacttatttctaggttttacgtgatggaacctgggatgaattagatgcatccttgttggttccgggcgatataatcagcgtaaaactcggggacatcattcctgcagatgcacgccttctcgagggagatccgctcaagattgatcaggtttttctggcagctcagccttctcctttgcatctaggactgtcgctcaattctgctaagaggaataactccgctacaaaaatatgcagcaataacaacaccacaatgtatcacttaatttgcagtctgcacttacgggtgaatcgctacctgtaactaagcatcctggagatggaatttactctggttcaacctgtaagcaaggtgaaatagaagcagttgttattgccactggaattcatactttctttggaaaagcagcccatctcgttgaatcaactactcacgttggtcactttcaaaaggtgagtcttcagcaaacaatgtctcttcaattggtctggcataagtttatattttgtttcctgtctcaccatgttttttcctgtatcatgtttcaccacatctgactgtgtattcattaggatacaaactgtaacttctgttgccaatgtcatgatcttggctgccatcgtggatgttttccaggttctgacttcgattgggaacttctgtatttgttcaattgctgctggaatggttattgagttacttgtaatgtacgctgttcatgaaaggaaataccgccagattgttgataatcttcttgtgcttcttattggtgggattccaatcgccatgcctacagttctttctgttactatggccattggatcacacaaactggcacagcaggtatgcctatacacagatggccagaattctctggttaccatgccccatgaaaagaactctggctaccaacgaattgaacagcattttagaagtgactacttcctttttattgtttacagggtgctattaccaagagaatgacagcaatagaggaaatggctggaatggatgtcctttgtagtgacaagactggaacattgacactcaacaaactgagtgttgacaaaaatttaattgaggttgtatgggttcttttagcatgttatattttcgtagctgtagttcattcattaaccacctactgagctaacattttcaaacgaagcacctacccccaccttcccttctgcgtgtgtggcccaattgaaatgagatatggaaagcaagcattttaatgcagtttcagctctgaaatgatttctcttacaatgattgtgacctttatcaataaatgaccatgagcatggttttaattttttaatccatgctgacccttcgcactgactattgatggcattgcaccaacatttatttgtaggtttttgaaaaaggcattgagaaggacgatgttgtattgatggctgcaagggcttcaagattggaaaatcaagatgctattgantttgctattgtttccatgttaccagatccaaaagaagtacaaaactcttgtctgctgatttccttcaaagaattacccattccagtgactcacttctacctatctcactcgaactaacaaatgtgcactgaggaacaatgtctatatcatcctgttctttggaattatccccattgtagtttgatctagacatttagtggctttcaactatcatatgattttacagctggggttggcatcaatcatctgttaactcaagtttacaactcaagtgttccttttgctctatctataattaattttctggttcgttgttacaaggccgatataatgttatcctatgacaatgagtcatattgttaggcatttctagtttatggtcaacttaactttcctatacacttctgttttattctcttctgtctgctgctaggcgcgagctggcattcaagaagttcatttccttccatttaacccaacagataaaaggacagctctcacatacttagatgctgagggtaaaatgcacagggttagcaaaggtgctcctgaacaggtatagattgactctgataataatcaaattcttatctctactattaaaaatttgaagatgtttccgctggaagtttggtacgtcatccgtgtttgagttggttgtatgtcgcttgtatccaattcaacgtgagtctggaataactattaaacaccccctcccagcccaacccaacaggcccacaccatcccaccgcccccccgcctccacttggggccgcgcgtgcccctcccccaatcgctgtcttttttttcttttttcttttactcctttttttccccaatcatcctgatcctctccctctccttccgatctccctttatcttttttttttctctttgatttctcttccaaatttttctcgtcataaatattttccttttgaaattatcattggttaaggtgtgtatgtggcaagtttgtcactttgcaaatactttccatctcaagtaaaaaaaatcactaattggataatattaatttcaatctttagtcgatgaggtataacaaaatacacgagtcaacttatggaatagtcacccgatcgatttatgaggctatgaaaaggtttacataaagggattcttcgtgtgatgacgcatgaaacaagcacaacggtttcagtgatat

SEQ ID NO: 90298 - DNA, 1177 bp, Oryza sativa
acttcttatataccctgatgttacaaaaaaaaaccctaaagtgttgatctacacagtacacctagtagttgtgctgtgcatcacaaatctgttctcaggattgcttagctattttgagcttcagaataattaggaagaacacttccgaatattcacacaaggagagtaaatccttgtataacagcacattgtttgagtgtttcccattttggtgaaatggaacaactatctataacagtctccatggcagttggaaggtacatggacagtggatatcaagcatagttcttatgggtcttgtgatgcacctgtagtacaacaaagctaaacatctaaagaatgaaaggttccttagcacatagttcatcctaaaactcgcaattaaacatcaatatgtaagaaaattaagcaataccaggactgaccatataatttggtattagatgattaatcaactttcatactatatagtttttgttcttttacttttggtatttcttgcccattatctaaaatttttaaaaatataatgcaatttcacctcctctactgttttctttcaaaaaataatattttttgtgtgtactgtaacatcaagaggaagttaaggattaaaacagtactttgaagactatgacttaagcctaaaaggccacattaatttacattcattgactgctttgaatttacaccctaaactggatacagtatgtgcgttattttttaatttgaaattcatgtgttccaaactgggccgttctgctgatctacacccttagggatagtagtagcactgtaaatctgtaataactgtgcttagccaacacctcaaatctgtaattcattatctacattgcagaattgctgatacatcctggactctgtcattatcaatgtggtttgttggaaatattttcaggtgatcagttggctattggtaaggagacaggccggaggttaggaatgggcacaaacatgtacccttcttcatctttgctgggtgacagaaaagatggtgatatcgctgtcctaccagtggacgagctgattgagcaagcagacggatttgctggagtattcccaggtacagattaattttctatctcattgttaatgtctgtcgctctaacttgttttccttccagagcacaaatatgaaattgtgcagaggctgcaa

SEQ ID NO: 90299 - DNA, 2403 bp, Oryza sativa
tccatttttccaatctgatgcaggcttgcagagcttgaaaactggtactagatcagatatatcgtttttagcatttaggtaactcaacttgattcttgagggacttggcatgattaggagatatgattggtcacacaatgggtgagctgctaggatctttaagattatgccaaaccttgtaatattgttactgttgtaaagaatgtgaactctgcctggttacagttatttcacaagaatacatgtgtggtaccttgatgttaattttactgcagctacctataatagctcatctttgtttatttgcagtctggtattttttgcattcttgctgattccctgattaaaatggagatctactcagactatgtccaggttcgtgtagtcatttgcacttgaaaatacttaggtggattttttgtggaataatttattgaatggtgaattgcaggcacatcttgcacctagtggttacatgaaaatcccaactgtgagttttttatgacttgaattcttttttgtcatcaccctgaagacataatgctttttatgttgcttggttgaaattttaatttgatttttcaattattgccttgtagttacaaactatcagaaaaaaaattataagttagtaaaatgatgaaaacaccgatctttcttcaaggcatgataattactggaaatagaatttgatgtgtatttatgttaatgtttcgattaactgaagtttgcataaccttcctatgcttttcaggatatttcagattatttaaagggttgtagatttcttccaaagcttaacaatgagttaccaggtgaaagaaatgccacctacaaggaaaggtttagcagcttagagaatttggtattaatcatggtaagtttaatatagtccaaggttgtattttgattatgttcatgttcaacctccaagactgttggtagcatcggtttataagcgtcaacaattgtgttccttaactccttggtatctacttaggtttatccgatttctacttgtatagcgccctgactgttctagaattctggagcatatcaccagggtatagttgtatggacccatcagcagtaccctggtggcaataagataagttgggtagattgttggccgatgctgatcccctgctaacctgtttgctacctctgttccatggctaaacttgcttcatatgtggagctggagcttatgcagcaagccagcaacttggagttgttcatcattgtggtgtcaccgcatgtgttgaccattagttctatattagattaagttaataaaatctaatgagtttatgatattataacagtgctttcgaagagaaatctacacataatatttcattttaaactaagcatttgggaaattattgatggtccaatttttaagagtttgactaaatcttgtcctaaatgtaaaatatttatgaccagaggggggtaatttattactcattagtctgcctttagtgtgtttatccattgtttaatgtttagtttcaggatgacgctgtcttgatacctcgggaaacagcatggtttggttactatccagatggaggtttcgatcctgtcctgccccctcagaaggttgagccttgcattgcatgtagtgcaaatggaatgaagtaaatcctctggccttaacattggtagcaacatgtcctggtgttgtggttgcagacaaagctgtacatggaggactggattggtctcaagacgctggatgatgaggggagagtgaaattcgtgtccgtgccaggggggcacctgggtatttccaagactgacatgatgaagtacatcgtgccctacttgaagggaaaggacaatggaaaggcttggattgctgcgacttggcgtgccatcaccaacaccatcggtggggaagcgtttgtgctcaactagctactagtactagtatcatgttgcagcctctttcttggctctgatgatgattgtaaaaagatacaggtgtacagtgcaggatacgcgtttcattccctgtgcaagtatatgtattcctcatcatgtatacattcaccaaactaggagttcaagtaacaagtactcctatatatgaagacaaaattgagctgatcttacatgatggtatcacaaatgattcggagaagtagtaacaaatttatttgtgggtttgcggccaccctgggacttccaggcagtgatggcggtgagcagagagcggttgggcacaagtgtcttgtttggcatccgaacattggtgaccggagacacatccttgtcgcacacccacatctcaatggcgtggcgctcgtacgagtagccgtccgacgcgatgcacggctcttgcataaccctctgcattgcatctcatggatgaggtgttagttaggagtttgcatt

SEQ ID NO: 90300 - DNA, 779 bp, Oryza sativa
aaaccctgttcatgaagacggaattaacgagagtggcatagttttggtagcatgcaaagatgagcgctcatgcgtgcagctgcaagaatgcatatcaaaaggctcgcatcaggtaacagttgaagtataatgtagttagcaacatagcatcaatcaacatcttaaatgcaagttttactttgatatatttaaaactaaaccatattaatccttcacacgcttccttgtttttaacaaggtcatgcgggccgagtgggagaagtacttgcttggcaaagctgaactgcatggattgcataggaagaacaagaaaacatctcagcaactaaaagggtttggtgttctggatggggaagttcctatgaggtctggtgagagtgcaggtcctgttagcattagcaaggttgaggctaatgccttacttgcggctgcctctgaaataagcactgtaactaaggaagcaaatcttgctgatgattcaaatgtcagctgcaagaagagatcattcggaaaagggaaagggaaagggaaatttaagaaaaccatggcaaagagagaagccagtaagttgagaaacagaaatactacagaacatactgatttggaagttgaaggtcaatcaggaaaaacaaatgaacaggctgagactgatgcttgtaagttgtctgcagaaaatgattctgcatcagctccagctgttgacaaagctgctaacaatttatctgcttttggagactctgtggataccgaaccactacctcctgtgcaattttacgccc

SEQ ID NO: 90301 - DNA, 778 bp, Oryza sativa
gagcaggcgcgccacaatctggaaggtgcccgcgccgagagggccgcactggatcagcgggccgctaagctcgaggcgcgggcaagggagctggacgcgagggcgcgcagcggcggggcggccgcaggcgacggcgacctagccgcccgtctcgcagccgctgaacacaccatcgccgagctgcagggcgcgcttgactcgtccgccggggaggtcgaagccctccgcttggcgggcgaggtagggcccggcatgcttcgggacgccgtctcccgtctagaccgtgccgggcgacaggcgggcctctggggagggcggaccgcgaaatacgccgccaaccaggggggcctcgcccagcgcctctcagagatggccgggaccctccagcggctccccgaggagctcgaggagacgatcaagtcatcctcgagggacctcgcccgggggacggtggagctcgtactggcaagctaccaggccaaggaccctgacttctccccgtgggcagcgctggacgagttccctcctggaaccgaggatggtgcgcgcgcgcaggtccgggacgccgccgaccacatcgtccacagcttcgagggtacggctcctcggctcgtgttcgccctcgactccgacgaggagggcggtgaccggtggtgcggacgacagcgacgatgaggccggcgaccccggcgcgtcggcgtgagccccagccccccgccatcttaaatagcttttctttcttcttctgaggccttcgggccccctcttgataaactaa

SEQ ID NO: 90302 - DNA, 943 bp, Oryza sativa
atctcaagctatgcttgaagcatactttatctaacctagagctgcatctgaccattgtgagcaggattcagagagtacacattcaggaggaatagctcaaagagctagacatccagaggagctgaaaagaaaccctgacaaatggatgattgatattgactactatttatcgcagcaggttccctttgcatagaaaaagaaatataagcttatttcgttatgctatgtctatattctcttattctggattccgtttacagattcatcctgtagtttcccgtctgtgtgcttcgatccagggcaccagcccagctcgcctggctgaatgccttgggcttgattcatccaaggtgaaaaattcttcatctattttcatctttatatgattgatctattttctgctatgatgttttttgatccttttaattcatggaatcagttccaatcaagattgactgagtctgataatcaagatacgtctagcatgctcttgtctgtaattgatgatgaagatgagaggtaaattacagtgtatgcattttgcttttattactgtgatctgttactttagttagaatgacttgaataatatttgcagatatcgtggttgtgagcccctgcgattatcatgcccaagctgttctactacctttgactgcccccctgtgtctagtctgattattggttctagctctggaaatgtatcaaatccaaatgaaggaaatgatgcttccattaatttttggcgtcggatgcggtgcccaagatgtccagatgacactgatgagtccagagtttctcctgcagtacttgcaaaccaggtgaataacaattaatgtaagatgatcgagcattcagattgcttgtaaaactgaactatattttctctatgtgcagatgaaaaggcaggctgatagtttcatcaatctatattataaaggtt

SEQ ID NO: 90303 - DNA, 626 bp, Oryza sativa
tccgagacagatgtgcttttggctgggttcagttgaaggatcttgcaatatcaatctgatgaattccttgtcctttgtaaacgtcaaccttcaaatatcggtgaatgagctaagaattcctcataggacgtgcaacgttgtgttcttgtgttgtagaagctacatcacatgctgagttgcagacatccaaattacaagatagtaggctgttccgtgagggtgtttctcaacctgtaaagtacagaattttcgtagtatatttcatttgaattcaaatgttatagctgttgcttgggagcagacccagatgagtacctttcgtagtgtttttagtgagtgaatgtaccatgctaaacttgtaaatatggtgtagcaatataagatcccaggatatctgacttcgtgtacgttgtccctactaacctacattctttgtataacatagtatcaaatgtttcccttgctgttatcatcgtcaggtaaaagtgttgctatcctgagtatcacattcataacaagtatacgttcttgtttcagtgtatctggcagatcaccaatgctctgaaagataaaactgagaaggaaagtgcacacttcattctagttccaggcatgctgtttgcctg

SEQ ID NO: 90304 - DNA, 2066 bp, Oryza sativa
cggagtctatcgtgcggtgcggttctccgctcgccacgacgacgacgagccccatgcctcctccgccccatcgcggcggcggcggcggccgcgacacgagcgcgttcttcgcggcgacgctggtgctgtgggcggtgtcggtggggttcgagatcggcgcgcgcgggcggcgggagctggcgcccgtggccgcagggtttgccttcttccaggccgccagcgccgccgtgcgcgccgccgtctcccgcgacccgctcttcgtcaacaccgccgtttcgctcctgcactcctcgctcacgtcggcctccggtctggcctctccctcaccccccaaaccccccacttttggttccgtggctttccctattcccgtgcttaggatccatcggatacacgaaatcgtacgctctgttccaacattacgctagtttgaggacatagacgcgcgtggaggattaaacagtaggtaaactagatgatgttgatgcttgatgctttggttcagtactagggaacgggaagcagcatggaatatgtaatcctactgtatagtgctagttttagtgctgcttctgtgggccaaagtggtaatgcaaaatctactaatttgtcttcatttaagctctttttggttggaactgtccaagatagcttacatcccacattacttagtatatgttgattccaagaggtggtgtgcttccaagtagctggcagccaacaggcttggaaacatttccatttcttcaccaaaaaaacatcttctgtttaacataggactgtcttttcccccgttttgtattggaatatactcaaacctctgcaacaatctaatgttactcgaatgtgaaattgagtataaggaatgatataaattgtggtcatcgtacccttttgtatcagcatatagtcgcttacgttacctctgcaacagcctatgactatgttactctaatgtgaactcgagtatgtggaatgatataaattgtgctcagcaaagaaggggactggcttgtcgtggccatgacttgtgcgtactaatttatatgacaatagccgtcctactattttttcatgacacttcttgggcacataattatgactagcaagggtgttgtacaaaactgctagcctctaaacaaaaaaactatacgtgttaaaaaataccatcttatcttggtgaatacgtggacttagtttcatccattaactccaccaaatgttatttctaattcttatgcctgtaaatcagctttatcccgtatgtcttccattcctgactggatgctgttgtatttgcagttatctttgttcttgtcaaccgatggcataataaggacctcaagaacatgtttgagcatgaagaattgtttggtggcagttgggttggagcatattctgctctgtgcttttcttgtggctattttgcttatgatcaattagatatgcttcgttaccgactgtacagtggacggattcctggaattctcatgcaccacctgattctgctcatttgctttacactagctctgtatcggaatgtgacgatcaactacctaattctaactcttgtatgcgaggtacgcctagctcttctcattcttgggcactctagttgtgtagacaaagttcatctttttggcaattcagacaaattttgaatttttgaccccaccttttaaccaggataaactaatttgctcacttatcactcaaagggatagatttgtgtttcagtataaggagtctctattgcacaaattttagccttcattacaaccaggcaaccagctatccatcttggtggcagcttgtctcaagtgtgacatattcagtagttgtttgtaaaaatcattttgtatctctgccctttgcacaaaaggtgcaagctcatgtaatacatatttgatataaccttcatgtctaactaattgttactgagattgaattgatggcgtgtagggttgtatatgatattagaggcttagagctgtttttgcaaagaatactttgttggtaaatacccgcacagactgtcttttactctattaagttgctagagaata

SEQ ID NO: 90305 - DNA, 1163 bp, Oryza sativa
catctacatattgtatgctacggatatgactgtatgtaccttcttttcagagaaaagatgatgtgcaaagccttaatatgctgtggtttgaaataagagaagaactcaacccagtggattgctctttcttttggagaaagtgatgaagggaagagttcttcagcaagtataagctccatgttctgtggcctgccataaaaaagaggtcagaatcaggagagtttgattaatggcatgatcctattacaaagttacaaagcacaaacctgaatatttcactatctttatcaaaacaaagtgttaaaagttgagctgggatttgttcatagtgaaaattaactgtggcaatcccttttgagcatttcttacagtaatctcggtataggtctagcaacttaagcattacatgctttctgacagatacctacaaaaaaggtttaagtgaggcaccgtaataaaacctgcagtagtgacaaaatgcaatagtttatgctgacctttttatcacgtagcctccctgctgcttgcaatattaccttagcaggaaatgagtttagatttgatttggccatatcgcagactgcagcaacagctcggatcctcactttgtcatcaaaatccaatagcctgcctgcaagtgatgctgccaaatacaatattttcatcaacgtgaagaggactctaatatagaaatacgaatgtaatagcaacagatataaatagcagacttactaagaatatcttctgcttcatttccagatgatatagccatgtaacagacttttgctgcatcaattgcagcaattcttacttctgcagatttgtcagagaatctcttcaagaattccttaaaaattaattggttttcttgagcaaaccggagattagataatacaagaagcctcccaatcaggtgaactgcctccagccggatatcaacacggtcgctctaagcaagcagaaaatacacgatcaaggctaatacacatgtaaaaggatatcaaaggagacacgaaataacataccaagagctcatgagttaagtgtggaataacagcaaaaagcatctggggtgcacactggaacatttccaggataatcttatgatgttgtttcctggtttcattagctggcacatccttgttgaaaatgcacgaagacaa

SEQ ID NO: 90306 - DNA, 1522 bp, Oryza sativa
ccattaagatcactcctactggaaaatatgctatagctagcttttctaacacgcataaccatgaactcataactcctagcaaggcccatttgttacgttctcagagaagaatgacagaagctcaaaaagctcaaattgacatcttgaatgattcaggtgttagacccaaagaaggccatgaggtgatgagtaggcaagcaggtgggcggcaaagtcttacatttaccagaaaagattataaaaattatctccgatcaaagcgcatgaaatctatccaagaaggggatacgggtgccattcttcagtacctacaggacaagcaaatggaaaacccttcattcttctatgcaatacaagtagatgaagatgagatgatgactaatatattttgggcagatgcaagatcagtattggattttgattatttgggtgatgtcatatgctttgacacaacatacaggacaaataattatggtaggccatttgctctttttgttggtgtaaaccatcacaagcaaacagttgtttttggagcagcgttactgtatgatgaaacaacatcaacatttgaatggttatttgaaactttcaaaagagccatgtcaggcaaagaaccaaggacaatattaactgatcaatgtgcagccatcattaatgctattgggactgtctttcccaactcaactcatcgtctctgcgtttggcatatgtaccaaaatgctgcggtacatttgagtcacattttccaaggttcaaaaacatttaagaatgattttggcaagtgtgtttttgattttgaagaagttgattagttcatatcagcatggaacaagatgatagaggagtacaatttgaatgataaccaatggttacatcatttatttgagatcaaggagaagtgggctttagtttatggtcggcaaacattctgtgcagatatgaaatccacacagagaagtgagagtctcaatgccctgctgaaatatatgcaacatatggattggttcttgaaattttcttttatttatatagagcaaacactcaggcacaaaattgggctttttttacatctcgatctgcagttcaatgtcattaatatttccatttgcaatctaaacaatatatctatgcttatggtgtgtatacattatagtacaagaaaaaattattaagcagttagacattaacctgtgacaggcttggtcgatccagagcaagcccaacctaatccatcaggactgcatgacctctccctgctctaagtctccatggcgaccacggctccttccgccggccactctcccacggtgagcgatgcgacctcctcaggacgccccacggcaagtgcgcaagcctgtagtggcacccggcaagcaccgccgccccaccccggcggcctgcctcgagaccgtcgtcctcttcgatggcccatggtgagcaccacttcccagccaacggcaggtgtgcaggcacatttgcagcagctggcaatggcgtggtaagcattgacctcgctcccgac

SEQ ID NO: 90307 - DNA, 778 bp, Oryza sativa
atctcgcgggccctgaccgcgacgacgtcgcccacgcggacgtcgcgcacgctgacgacatcgcccgtcgtcgcgaggaccgccttcgcaggtagcatgcccatcaacgacgacatctcggcactcgcctgcaacctcgcaacgtgagtgttcgtccaggtttgtgtaagatcgccatggatttggtgaagaagacgataacattgacatgaacctttgtgcatgccagtgtctcgagccattctgcggtggtgaagaggaagacgatggcgcggcagagcgcgccggcgccggcgatgagcatgaggacgttgatgtcgagttacagctggctcgccgcggcgaacccacggcgcaccatcggcggcgcgccggcgacgacggccgccacggccaggcactgcaagggagggaagagccactcgaagaaggaggccatgaggaggacgccagaggcgacgatgtacgggctcggccaccagatgaccatgccgctgctgccgtaggcccacaccgacgcctcgaggccggccttgttcagcgccttcactggactccagacaaagacggcgacgagccgacgacgactcgattccgtgagaatcttgcgcgagaatcgcatggaggattaatggcgcgcgcgcggtggcttacctatggcggactccgtggcggcggcggggtcgtgctcgacgacggcggcgcacgaagccgataggaggagtggagtgggcggcgcgggcgaagccggcaggcacacggagcatcgacggcgggc

SEQ ID NO: 90308 - DNA, 961 bp, Oryza sativa
tttactgaatttacttttatatgtctaagaaataacttattgaaatttaaaagtaatttagacatatcataaaagtaatttgtgatttttcatcaaaatataatcatgtgagatcttgttataaagatttaattattacgaacacaacggtgtaatcgtattgtaaatcggatgagtaatttaagagataattttatttcaagcatagatgctcaatggattaatagcaaccaaaactcctaaagtatgggtgtctctggttaagactaattggatgtctctggttaagactaattggagaggcatctccaattagatttaccgcagcaagtagctaaatctcacgttaattttctccatgggcattaattaacaactaattaaacaaggtacgtctttacacctacacgtacacagtacatatacacttgaaagaaagtctcaatgatgcgcaagcacaacaatggcggcgaaacctcggtagatcgatcgatcctcgtaattctactcttcgtcgtcgtcgctgacgaacttgccggtgccggggttgatggcggcgatgaagaagaagacgacgttgaagaggacgagcggctcgatctcgttgatggggacgccggtctcgatgttgagctgcgcgagggcgcccttgccggtgatgatctcgccgatgatggagaaggcgatgccgagctgcgcgagccggccgacgaacagctcgttggccttggtgaagccgaacagcgggccgccctcgctgaggcccagcgcggagcggaagcccttgcccggggcgatgacggccttgtcgaggcccgtcaccggctggtcgtcgacgaagctgccgcggtcgccgagcgcgccgatggcgccgaggagggtgaagaggatgaagaagaggaggaggggctccgcctcgtagatcgggatccccgtctccaggttcagctgcgccaggatt

SEQ ID NO: 90309 - DNA, 905 bp, Oryza sativa
tgcatcaagcaaattggacattgcttgctctttgaacaaggacaaagaaatatggacaacaagaagagttcaagacatgttgcatttccaaagttacatgagttgcatcttaaggggatgatggaatggaatgagtggacatgggagaagcatgtggaggccatgcctgttctaagcgtgcttcatgtcaaagactgcaacttgagccatcttcctcctggacttccttaccaggcaagggctttgaagagattatgcgtaataaatgctcggaacctaaactccgtggagggtttcagctcggttatcaagcttgaagtctatggcaaccctaatctcgagaggattgttgatcttccaagcctgcaaaacctaaccattgtgaactgtccaaagctgatgttgttggatggtgttgcatcagttcagatcatggaacttggggaccacgggatggaaacgctccccgagtacctgcgacatctgacgttacgacatttgaagattgtttgcagcttgaatctgctcaggttgatgtcgaccaagcatgatgcaagcaggtcagagtgggagaagatcagccatatcatgcatgtggagggattcgctagcgataacggcgacggcatcttgagatggtacatgtcctacacaagagatccatacaacctggagacaaacattacaagcagatagctccacaccaccaggtacatgcatggttttgttcattacgagtaaattaactcccctttgccatgcaatacatatggcattctcattatatcaatccagaaactaagcgaactgtaaatttattctctatctgttctatccgtatgtgttcagaaggtgcatcagaataaaatgcgaagttgagggaagaacgcgatcgtgatgggaag

SEQ ID NO: 90310 - DNA, 3347 bp, Oryza sativa
cgtcggacatgcccggggtccccagggaggtgatcgagcaccgtcttgccgtacgaccagatgcgtgacccgtccggcaaaaagtgtggcgtcaagccccggagcgacatgccttcatcagggaggaagtggcacggctcctggaggctgatttcatccgcaaggtgatccatccggagtggctggcgaacccggtggtcgtcctgaaggccaacggcaagctgcggatgtgcatcgactacacagacctcaacaaggcatgccctaaagatcccttccctctaccacacatagatcagatagtcgactccactgcggggtgcgaccttttgtgttttctagatgcatactctgggtaccaccagattcgcatggctagggaagatgaggaaaaaactgccttcattactcctgtgggcaccttttgttatacaactatgccttttgggttgaaaaatgcatgccctacttttcagcgcatgactcgtattactttgagtaatcagatagggcgcaatgtagaggcgtatgttgatgacctggtggtaaagatgcgccaccaggacacgttgctgcaggacctggccgaaactttcaatagtctcaggtccacacgcgtaaggctgaaccccgataagtgtgtgttcggtgtgccggcgggcaaacttctcggttttctagtctcttcccgaggcgtagaagcaaatcccgagaaaatgcgcgcgatagagaggatgcgccccccagcaagcttagtgatgtgtagtgcgtcactggatgcatggccgccctgagtcgattcatatcaaggctgggtgagtgggcgctgcacctattcaagctcctcaagcgctctgggccgtttgtatggacggaggaagctgagcaagctctcaatgagctgaaagcttacctcacttccccctatcttggtggccccggggccagaggaaccattactactctacttggccgcgaccccctatgtggtgagtgccgccctagtagttgagcgcgaggaaagcgaacgagaggcccctttggctcgcgatggcccctcgtcccccgaaggcctagtgcccaaagcacccagcccccgggaggaccccgaggcccccgagggaagaggggaggctttggtaagtggccctgaggcctacgatcccgaagtgacccgggatccccccggggctcccgagcaggggcgccccgggtcatctgcccctgacaacacgaaccggccctgccgaaaggtgcagcggcccgtccacttcgagatgcgaaaacccggtacccataggcccagaaaatgctttatgctgttttaatggcctcaaggaagttgcgccactatttccaggcgcatcgggtttccgtagtgatatcgtatcctctcggccaaattttgcacaaccgagagggcactggacgggttgtaaaatgggccatcgagctagctgagttcgatctgtacttcgaaccacggcacgcgatcaaaagtcaagtcctggctgacttcatcgtggagtggacccagtggatgaacctgtttcgtccaatgtccctctcccccgggagaggaagaggacccaaacgctgacattcgtggcgggcactggattatgcattttgacggctccctcaaccttcaaggtgcaggtgccggactcacgctgacgtcgccaagcggagacgtcctcaaatacgtcgtctgattcaatttccgagccacgaacaatatggcagaatatgaaggactcctcgcgggattgagggcggcagccggaatgggcatccaccgtctcctggtcctaggtgactcccagctggtcgtaaatcaagtatccaaagagtaccagtgcaccgacccacaaatggatgcatatgtccgcgaagtgcggcgcatggaacgccacttcgacggactcaagctccggcacgtgccccaacgcgacaacacagtcgctgacgagttgtcgcgtgttgcgtcggcacgagccccactccccctggggactttcgaggaaagactcgcgcaaccatcggcgcgaccgaaccccttgagggaccccaacgacacgccttccgtcccgacccccggcgacccgcacccctcagggcccgagggggtcgaccccgacccccctcgttaggtcgtgtggatgaccgacatccgggcatatctcgacggcaatactctccctgagcatcgcgcagaagttgagaagttcgcgcgcatctctaagtggtacgtcctcgtagaagggaccctctaccggcgtgccgccaacgggatactcttgaagtgtatttctcgggagcaggcatcgagctcatagccgacacccattagggtgagtgcggggcccattcggcctcacgatctttggtcggaaaagccttccagcaaggcttttattggccaactgcattacaagatgcccaggaatgggtccggcggtgcaagacatgccagttccatgccaaacagacccaccagccgacccaagccttgcaggtcatcccactctcttggccttttgcggtctgggggctagacatccttggatcattcaaggcggctcgaggcgggtatcagcacttgtacgtcgccatcgacaagttcaccaagtggcccgaagcttacccggtcgtcaaaatcgacaagcattctgccctcaagttcatcaggggcatcacgtctcgattcggagtgcccaaccgcatcattacagacaacggcacctagttcaccagtgagctgtttgccgattactgcgacgacatgggcatcaaattgtgctttgcctcgcccgcccaccctaagagtaacggccaagtcgagcgagccaacgccaaaatcctcaaaggcctcaagaccaagacgtacaacgtcctaaagaagcacggggattcatggctcgaggagttgcccgccgtgttgtgggcaaatcagactactccaagccacgccacaggggaaacgtgtcgcgtcccaaaacgactctaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttagaaaggttttataaaaagaaaaaaaaaccctaaaaagtcctttttcccccttcccctcttgggccggctcggcccacctccctccctctctctcctctcccccgtggcccaatcggcctcctccccgcgcgcgtgccgctgac

SEQ ID NO: 90311 - DNA, 1558 bp, Oryza sativa
ttatgttaacttcgccacactcgtttacaaaactagctagctaggtagactatatgtgtgacaattttagtaccagtcatgatgtattctggtgcggcatagccctgtgtgcccatcactctagtggagacatgtgtctcgtcttcttgaggcccatctttggccagtccgaaatccgaaagttttgcttcgtagtcctaccaataattaaacaatgtcagtcacaaaatgtcatatgacaacagctaccaggatgggagaagctctccaatatttcctttccatttgataaattgcagcgttttaatgtgtgctccactcatttataattcatatatacagataaagacaatttgttactagcttaatacacatcctctgctacggatatatattgcttagaacaaattagttataaggttttctttagaacaatgcatccttattggtatttttgcatgataaacttgtttttatggatgaaataagatagataaaaacaatatatataagtactattttgaaatattaaaaggatgttggataaaaaccaatgtataaataagctcatatagatagatatgtataccgagttgagtaggatgttggaggtcttgaagtcgcgatagatgacgggcttggcagcttcatggaggaaggccaaacctctggccgctccaatggcgatcttcaagcgtgttgaccacggcagcgacgcagagtactctgcagtttcaatttgcacaatcgatcagttcatgcattatttcatctacaactaattatgacccatcgacaaatcagatgatgaaagcaaaaggcggcaatgcaaattgttaggagcagccaattaagtagtaagtatgtgcatctccactgaaattaattcaatgcaagctttgaatattttttgttgtcttgataccaacattaaagaagattaattgctagctaccagaaataactgagagcatgaattgtcttccattctatcttgtgaagttgacaacattgattaccacattagaatgatatatataggcttccatggtaatgcagatgatgcactatttcttttattatgtagaaaatacacaagcacacaaaagcccctatatgaatgcagctcttaacacatggtcaagagataaagaccaagagtaaattcgtttatactattattgttatcgaaatttaaactctggtagatggagttatacacccataaagccatcactccacaccagcattttgctttccctatctgcactttttttatcttttatgatgagattaacattttgtttgttgtcacatgcatgattggctacttttgacttgtgtggcctatataagtgccttatccaaattacatgacttgtaatcattgtggcctacttggattctccaatttgataaactatcaaagcaattagaaatttatgcttatttttccacgcttcaattcgatccctttatcaactaacaatgggaatgtgtgttgtcactttaatttgagctgatgaccaaaacgaattttaggccacacaccaaatta

SEQ ID NO: 90312 - DNA, 2799 bp, Oryza sativa
ggatggtgctggccaacaccgccgccagcggggaggagctcgtggcggacagccacctcctccccgccgtcgcggtggggaagctcgccggcgacaagatacgcgagtacgcctcgcgccgcgccgccggcggcgccggcgcgccgatggcaattctgagcttcggcggcacggttcttggcgtccggccatctcccgtcgtggcggcgttcagctcgcgcggcccgaacaccgtcgtgccggagatcttgaagccggacatgattggccccggggtgaacatcctcgccggctggtccggcgtcgccgggccgacggggctcgtcaaagacggccgccggacacacttcaacatcatctccggtgagcattccattccattccattccacactccatgccaagctaggagtagctctctcacactgctcagattcaaatggttctgaccaccatgtcatgttgctatcaagtttttggagttattttactcatttactgccatcacagtatagacaatccagtgggacaaaagaaaaagagcaagcaaacagagcctctttggatttagattcagccatggatggaccctgtttgcagaaaggcaattttcatttcaactttcttgttggttggatgaaatggcatttgctttcattcactgcctccctttgtcaggggatgcacatgtgatgctcttgcagatgtgaaacaagggaacagcagctgagacaagttacccttttacttttgtttcttttgattgcccgttctgaaagtgataaactagcatgagatggggagacaatagtacatcactggtttctaactttatactaagctggatcttattaaagatgtatagttgcattttcattactagcttgaaacgagagtgttgcatagtaccatataccattgcaattcttgtgcatgtttgttagtcctaatgtttgcttatatatattattgctagcaaatcaggaatacactgttgagctctgtggggataaatttcagtagacagcaaatgggaacattttgatatatgaggcttatcttgtttgtgcctttcaatgcttaaatagtggttgtgtcctatggctatgagataagtaagcatgtaatattgttgatttgcatgttttcatcagccaagatgaaatgctacatttttctcaatgttttgcacgtaacaatgctgacttctatttgatccattcaggtacatcgatgtcgtgccctcacatcagtggagttgcggcactcctgaaggccgcacaccccgaatggagccctgccgcgatcaagtctgctctgatgaccactgcttacaccgtcgacaacacaaactcttctctccgagatgctgctggaggcttgcttgcaaccccattcgccttcggcgcaggccatgtcgacccgcagaaggcgctatctccaggccttctatacgacatctcgactaaggactatgtttccttcctctgctccctgaactacaccacaccacatatccaagtgatcactaagatgtccaacatcacctgcccaagaaaattccggcccggcgacctcaactatccctcgttttcggttgtgttcaagaagaaatcaaagcatgttatgaggttcagaagggaggtaaccaatgtcggcccagcaatgtctgtttacaatgtgaaggtcagtggccctgcatcagtcagtgtgaaggtgacaccagcaaagcttgtgttcaacaaggtagggcagaagcagagatactatgtcatattcgcgtctacggttgacgcaagcaatgcgaaaccagatttcggttggatatcctggatgagcagccagcatgttgttcggagtccgatcgcgtatacatggaagatctgaggggtgaggacagtaagtaaattatattggagatgttgaattattccctggagcagatgaaagatagatagcttgatgatgtagtttgctgattgcttcacaaagagaatcggcgtgaagctctctctactgcaaacctggagttctttcttcgcagtgtcggttactcgccgaacttctttttccccccttgtagttgtcagtgcggttgcccgtcaagaaacttatgtgctattaacatgtgagatttccttttctttttctttctctagtttcatgttctcagacatgaaataaccctgaaatgaatcggttgttttatggcaatgatcagctcacatcagctattgttttatcaatgttctgattctgatcctcctgagttaactgaagaattgaaatggctgtttcattggcaatgtgttctcttcttttacatgtatccagaaattttagctttgtgcataagtaggaaccaatttcagcaggaaaggaaaggggaacagagatcagttcagggatctggtgaagctgagtctcacagacaatgaactgtaaagtgatggccaaaaagaaatcaaatgatctgaattctttccgccgaccgtgcgtgtgcatccgtaacgcacgcgcgttcgctttcacgcgctggcgcctgtgtacatgattggtcgccctgcctgtttagtgtttactagtagtagggtagtactggaggactttacataacacccacgagagactggcccaagttttggcccagtgcagccgaagcatgaaaagaataagttcactttcactcccttcaaagtgacccaaatctaattcgtatccctcaaccgcaaaaccagatatcttgacccttaaactgttaaaactggtgcaattttactctcttggcggtaatgaaggg

SEQ ID NO: 90313 - DNA, 2245 bp, Oryza sativa
gtcgcctcccatatacaaccctctaaagctggcgaactcccccctcttcccccttcccctcccaccctatcccaacctgagaccctaactcgtagggtcctctgcgggagtctacggtgttaccggcaccggagaagaaaagcagatcatcgaagttggagaagacctggagcacgaatcatgaaactcatccggtggtataagatctgcaagatttgaagatggttttatgtgggcagaagattagctattcccttttttattcctaagattacatatggattcgtgcctaaaaacaacaactttatcctttccctttcttcttctcatcctgcgatctagacgcgtgaatgagtttagctggaccctgagattattgtcttaagaataactgttcacatgttaactttatgtttactttatacttagactagaaaaaatacccatgcattgcaacggatgaaggctattgtaatcgtattattgttagatattttatatgggatttttattttgatagtattgatatctaattcggaatccttattgagatgacgatcatatcttgtacattgctttcttatggcctggcgagaattctgaagtaattaggagtccgactattaaaataagttagcatgtgagatttttaagatgatttcttatacgactccttatgtatttttcaaaagcgaacgaacttaaaaactgactcaaatacggatgatgtaccaaagtaagtatcagtggaaacatctttaatttttataatagtagaaatagagataccaataccaaaagtgaaaaggaggcaaaaagaaaggagattggaaggagagggtaaggattagaacgaccgagagaaaagaaaaggagaaaaagaaaatagagcaaaaaaatgtcgggagaggcacgtgcgctttgagtggagacgcgcacgatggtgtgagccgattaggttgggttgggttgggagggaggtgtataatagttattttaaactcatgtcgaattgggtacgggagacgtaaaaccaactaaaaaccactcaaacacataccaaaatttcagcgaaaatattttttatttttataatagtagagatacaaacatttaaatcctaatcgaaatcttaatacgaatcataatcaaatgcataaactttcggtgggttaaattaacagaaaactaaaagtgtgtggtgaaaataaaaggagcacgacgagcgtgttacaaataaaatccgaaaatccttctatccaggcgaccgatcgagtaagaaaaaatcgggtgcttctcctctctctctctctcatctctgacgcgcctcctctccccgtgctctctctcgcccctcctctctctctctggtggagcggcggcagccaacagaggcctctcctcaccggcggtggtggcggcagcggtggaggggttaggcggcagcttccgtctggcttcgtccccccgcacggcgtccatctgttgcagctggctccggaggcaatagccacctcatcgctggccactctagggtttcgaggaggctgtttccgcttcgatttcgccctgcgtgtgacgcccctctggtgcagtcgacggcgaaggcagtggcggcaccggcaaaccgaggagacttcgcgcagcgtcgacgacggcgaccgagctccgtgcggcgtcgacgacggcggatacgcaaatgtggccgagctccgtggtgtcgacaacagtggctatgtagatgtggtggagctcggcgcggcgtcgatgcggatgtggttgctaatcaccagagtggaggaagaggtagatctaggttttcctcttaatttttttaatgtttcagtccatgtaccgtgatgtttcatcggttagatttgaaacgttgtagtgggttttcgatggtgtttcatccttttcttggatatacttggattcttttcatattttagtacattcggaaccgttgttttatacgttgtagtaaaatgtttcattgtgtgatttgattgtgtttcaccattttcagcactaaacattttcaattcgatggagtttcattcttttcctcaatgtactcggatttgtttcatgttttaatatattcgaaactgttgtttcatacgttgtagcaaaatgtttcatgatgtgatttgattatgtttcagctttttaaaagattgaaacattttttatctacttggtaaaatattttcgatctacttagtgaaatagtacccgattt

SEQ ID NO: 90314 - DNA, 643 bp, Oryza sativa
tacgcggcgacgcgcgccccgggcgccatcccgcgcgccgtgccagtggcatacccgagcaagctcgcgttcgccaccaccgcgcccgccgccgtcgtcgccgtgtgcgtcccgtgcccatccctatcccgcgccgagacgaaccccttcctccccacgccgccccttgcaccaccaccaccaccgccgttcgccgcacggagcccgcgcgagaagctccgcgcgccgacgagcttcctcccgcacacgctcggcgagaaatcgacgcccgcctcacacacccccttccacctcgcgggaggcggcggcaggtcgccaccggcaaagctcggcgactcgggccaaacaccagtatcaagaaccccaatgaccacgtcatgcgtggcggcctcgaagccatggatggcaggctggtacgccggggagagcagccccaagaactccggggtgcgggtggtgtgcaggtcgaacacctcgtcgggcaccacctggagcacgccggggctggcccggagcagcggcaggtggtgcgggagcagcgccgccgcgaagccgtgcgcggcggcggagtaggagtagagcaggtgcctgtccgggtcgatggcgagcgactggaggtgcgccgcgtgccccgccgccggca

SEQ ID NO: 90315 - DNA, 2027 bp, Oryza sativa
caaacgcagattggcgcacaaattgctatgagtattgtaagatgtatttgatttttcgcttcaaaacttgtgcttacagactaacttttaaaattttacagatcctgatggccgcattaaaagatgtcgaggaccaactaaattggcaaatattgaaaatcttccagagggtgttaagattattgtcagagtggatcgtttcaatataccttgctcccaatctgctatagttcatggatcctagttaggaacacttgtcaggaagccacatctagctccactgaacattcttcaatggaatcataaactttataagagagcatatcatccaaaaatgatttctgaagtagaggtattgctctttaattttcacagctttttaaatcatattcttatggtgattccaatataattccattcactctttatttttcatatgcactagagaaagcttgcaattgatagaagagctaataattggattctccactagttagatggcaaatggaggcagtacaagtcaaaactgaaaaggggctattacaagcctaacttacctatggaacgagtattgcaaaccgtgcccaaaattgttgctaaatctcaatgggccaccctagtttcttactggtacttagaggactctaaggtaaatatatgttgggactttttagtgactgaatgaccatcattttgatttatatcagctcattgatgctatatgttgtatcattagaaaatcagtgacaaaacaacgagaatgcacagaatattaagcatccacacatattaggaagaaagagttttgcaataaagaggaaagagctggtaagattttaagcaattttcatatattaattcactattgcttcaatttcgcccgcccttccaatgcaactaaagatgtataatctgcaggaagttaatggagtggaggtggactgagcaaccttctttgatgaatgccataagacgaaagatggcagatatgttaacgatgctactgaagaagaaatggtatgccatattgcttttcttatataaactctttgtaaaacaaaatacactacattaagagtctacaatcttttccaacgtagaatgaagtatatatgaaattggctgagaaaagagtggattgccaagaactcagtgaagctgattttgaacaagctatgttagaagtgcttggaaaggatcataggggtagagttagaggcatgggtccaaccattactccaacaaactattatggtagaagatttttgaatatatcaggaagcaatgaagggaatggctccagtaatgtaaatggtttcattagttttatagtatcatatttgactgagaaatatccagaggataatttgatttctaggttgccaccatcagttgctagggtcattccaagacaagaggtatggccacaaaattactaattttaaatgttgtaacttatatagccataagcttccagaataacaaattcatgcatgtatcttcaggttgatcagaatgaaggaagtcagccaccaaatactgctacatcctctcttccatttgatcagaaccatgaaaatcagctaccaaatactactccatcctctagtgctagagcatcatctcagtcttgcagtgaagaagagtgatttacaatggcaattgtaccattccgtactacttgctgcattagaatataattattttttgtgttaatttgtttgaacctattgtttcattgttatatcagaaaagatgttgaagtattttcattgtgaacaatgtatagatattgcttttgattttaatgacaagctactggcgttaaaagtcttgttaatgtggtctgatggtaattcaatctgttggtattgttttgtttatgggttttctgaatgaaagatgtattgattgttggcatgtggccaatagcggggttataaataataagtgtagatacaggcacaaccgtgtctatagaagcagaaattgtctctaggaaagaaataagtaataaattcattatg

SEQ ID NO: 90316 - DNA, 5342 bp, Oryza sativa
ggactgacatgctgtagcattatgttaatataaaaaggtctaatgtttttgtaccaaatgcataatagtccaaggggagcagtcagcattatgttgttaggtctagtttttttgtaacaaaatccaaaatcctaatagcccaaggaagttttgtagttgcataaaatattttacaccaatttgtttggttactttcggcttcctgattttctatcacaatttatgtgttaaataagcaatacctaagttataatctggaaataataaaaacttattttatatttagaaccagtaggcttcattaatgaaactgaaaatgaatatagaggtgttcaagtcttacagtaacaaacttatttacttcttcacataagcgcattcatgacaccacatcgataaattttggggggaaaagtgctggatcattatttccgtattatgtctgacacaaatacctcatgctgtcatccttgtaatcaatgtaagacttgtgtcatcaactgctggattaaaccatgaaatttacattgcaacagcttcctctgttccccaaactggatctgaggaaaatttgtgcatactgcataggacaaaaaaattggacatgctattttgaaaattatttcagaatgccaatcaccatgtaaaatagtttcatcaatattaattaaagaacatcttttgtaacatggatttaacatcatgtatcatcaagttcatctgaaatagttcagatgtatgtaacatcttttgtaacatggatttaacatcatgtatcatcaggttcatcttttgtaactggtgtgtgtttgtacatatgtatgtaaatttattgtcacacctattaatgcattgctactattaatgtgatgtctatgtcttcccatgatttgctaatactgagagtagagcttgtatttgatgcagaatgcaacgatggggaatctcaaatcagaatgtcaaaacttccagggaatccaaagcataaggttaggacagctagaattttgtgatgtctcacacgttcgacttctttgttgtacagagatcattggaagcacaaactgtccataaaaatgcattggcacaactattccaatatgcgctacattttttttcaacgaacattgaaatgacatggagtgaaaaatgctatggagaagctatggcatcgccggtagaaatagcaaagaataaacaaacaaacaaacaaataaagaactagctgacactaactggatagtgtagataaatttcaatatatatttcttaacatttcatgagaattaatgcatgctgtgtctcctagttggctctaaacataacagaaaaacgtgaagacagtccattgccgtctcctagtcatcgcccgatgggtcgaactccaagtggaggtcaactaaggaagatgttcacagaatcccaaattggtcgatcgagcttccggaaacttctagaaccaagcatatcagagagaccagggagtactccttatagagttgtccttggtgatgtgaaagaaaaggttagagccatactttatcatttattatacgtctcatgttttcttctccggaagtaggcaaacaattgcctagtctactaatagaggttggattaagggatgcttgattaccaaatttgtacaatattctttaggattaaattaatctcactaataaattcccagagactctactcctgttctttggcaataaagtttgggataaattttatgtggcattttactattaaaaacatatatgccaaagatacccaaatagttggacataggtactctcaatctttggtaggaagacaaacctcaatgagaacaagaagagattatgctatgtataaacagtacccatctgttatatttttcttgacctgttatattttttttaacatggcaaaattttttccttttgattgtgcttaccactctgttttcagctgatgaacacacggagacgactcgagcttcttcttgaggatctaccatgtgatcgtgatacttcagaatattatgatacatcggataaacttttggagcccttgcttttgtgttatcaatcactggttagtctaattagctgatgtagggtcgatcactcatccctttagtgctgtactaccatgatcaactatattctatccgtgcaagtgtgtctgtgtgtgtgctagaaaaaaaaacatttgacacaaacattctcagcattcttcaaaattgccctttaccatctccacattcttactggctaggctttgattagtcgtgacttgtgagaacaatcgttgatgatggagtgggtggaggtttcttttcatcacataatttcctttttgtactgactgtgttcacatcttcaactattttatgaagcaatcatgtggatctagtgtgcttgcggatggccggttagcagatttgattcgacgggttgcaacctttggtatggtgttaatgaagcttgatgtacggcaggtgggcacattgatcactactgtttttatgcttactcacacttaaattttcctgatgtaacttcagaatagcttcaagcgaagtccagtagtccattaatgaatagaatggcgttatattactgtaggaatcaggccggcatacggaaacacttgatgccatcacatcttacctggatcttggtgtttatagtgagtgggatgaacaaaagaaactggatttcttgactagagagctgaaagggaagcgccctcttgtccccccatacatacaggtcagttgttgaatgtagacatcaaatttcctatcctagtggctaatgataacttatattttagttgtgataaatgttcgtttacatggaaaccagaagtgtcaattgagtttcatcgtgtggaacagtacaatataaatccttccatgcaaacaaacatttatcacaaactaaaaaatgctaccaatcttaccacaaattgaaacttatactacacaatcattttgtggtaagattggtagcattttttagtttgtgatgaatgtttgtttacatggaaacaggaagtgccaattgagtttcaatgtgtagaacagtatgatagaatccttcagaaacagatatagttcctttccatatagtcattttgtggtaagattggtatcacctccgccaacgccaaaatggttaatactatgctaacttctgatgaataagcaatgttttatacagaatttgatgaggcatcagatataacatcactgttcattcaacatggattttagtttttttgggaatacgcataagacttacatatctttttattaagattgaggggtggacttacaaacgcaaccgataaaggaagcaaaaacaagaacaccaggaaaagaaaaaaaaagaaagaaagaaagcacagcagagggtgttatttcgcaattaaccaattgtgcgactgaaacctagacgaggaggcttagatcggcacccccgcgcgccataggcttgcttcttcagcagccaagtttgccacttctccccaggatcggcgttggttgttgaaagcctggctattccgttccttccaaattgaccaggcgaccagaataatgatggtgtcaaagccgcgcctcttttggacatccaaccaaaatcccttatattttgggatggagtattttcttttacaagaaagatataggaaaagggattgcagtgttggtacataagaatatttgaatggcaactttatggttgcatacttcattgtagaagagaaaaagggaatggagattcaccttgaagtggaaagacttacatttgcatttcctttgtattcctttcaggttactgctgatgtgcaagaagttcttgatacattccgtgttgctgcagagttaggaagcgatgcacttggagcatatgtgatttcaatggcctcaaatgtatgtagatacgcaagtcttatgtagcactaaataataagaaaaatctgaatatccatcctgcactttagcgttcttgttaaccctcacctgtaaccggccggtggttccaagcattttgccatgtcatgccttgtaccatcttgatcgcatggatcaaatgacaatcgtggcacattatatttatcactctacattaaatatgatgtgttcctctggttgcaggcaagcgatgtcctagcggttgaactgttgcagaaggacgcaagacttacagtcagcggggacctaggaaggccatgtcctggtggaacgtaagtatgattatatatatatatatatatatatatatatatatatatatatatatatatatctcatatgttcagtgtgctactcgatcaattgaacttatgaactcccaattggttggtttagtagttacacaaaactaagaacaaagttgattgtgcaaactaagtagaaatggaaaagaaggaattgcgcactgtgtctctgagctagcaaggaaaattcgactgcgatcttttactttgccagtggctaagccaactgaacttgtttttgcaccatatagatcgtatattatgttttgtaccatggccagtgtttgattgaatagtgtgttatattgtttgtgaataggttgagagttgttccactgtttgagacggtgaatgatctgcgagaagccggcccagcgatcagaaagttactgtccatcgactggtacagagaccacatcatcaagaaccataacgggcaccaagaggtagaatgatcgatgggtttagtttcgaatatctcaaactcattttgcttttgtttcggatatctcaaactcgatcgggaggagtttgcaggtgatggtgggctactctgattccggcaaggacgccggccgtttcaccgcggcatgggagctatacaaggctcaggaagatgtggtggccgcgtgcaacgcgttcggcatcaaggttacgctcttccatggccgcggcgggagcatcggccgcggcggcgggccgacctatctcgccattcagtcgcagccacccggctcagtgatggtgagcactggcaggcactgattaatcagtccattccatgtgtatgtgtttgcgagctaataatgaattgaatggtgcatggtgcagggaactcttcggtcgacggagcaaggggagatggtgcaggccaagttcgggctgccgcagacgtctgtccggcagctggagatatacacgacggcggtgctgctggcgacgctgcggccgccgcagccgcgcgggacgacaagtggcggggggtgatggaggagatatcgcgggtgagctgcgcgcagtaccggagcacggtgtacgagaacccggagttcatcaagtacttccag

SEQ ID NO: 90317 - DNA, 2356 bp, Oryza sativa
tgctcccggcgtggctcggcgtggggcgcggcctccagaacgcttgcgacaagggccacacccacgagctccgcgccatgtacgaggagtggcccttcttccagtccacggtggacctcatcgagatggtggtggccaaggcggacgcgcccatggccaagcactacgacgacgtgctggtgcacgacgcggggcggcggacgctcggggcggagctccggcaggagctggcgcggacggagaactgcgtgctggcggtgagcggtcacaagaagctgtccgccaacaaccgcagcctgcggaagctgatcgacagcaggctcacgtacctcaaccccatgaacatgctccaggtcgaggtcctccgtcgcctccgccaggacgacgacaaccgcaagctccgcgacgcgctgctcatcaccatcaacggcattgccgccggcatgcgcaacaccggctgactcctcttccctcctctcctctgcaaattaacttatatttcttgcaactatatttccgtctgaactaattaccggagttttttttctcgttcaattttccctcaaaataagaaagaaaccttgcatgtagcattttcacattggattggatatgtacattgcatggagaatgaaatagcattatagactatagtggtgtggattgatgtatgtagttaaaagatgagaccattggtttggttcccttcttcatgggccgcaactgtatcgcgaccaacgatcggcccatattgaattgccccaacgggattgctgggtacgtgcggcccatcttaaccggaccggaacggaaatgtgggtacgtgcggcccacgtttgttggaccgtcggggggattgtgagggtactgaggcccatattaattcggccgtaaagtgtgggatacatgtggcccacatggttgggccgaaatctgacgttgcgtgtatggtctgaaaaggcccagctctcttagcctcgacgaatattggactcccatcatattttctctcggcaggcaccagaaaatcgaaactgaataaatgaagggatctttacaacctctatgttcatcagcagatgagcagatcacaagtcaggaaaagataaatctctctttcgatctactactacattacattatctaaaaaatctactcgaactgtagtagtactgggctctgttcgtattcgtatgtgaaggttcccaactctcatttctcgtttttcacgcgcatacttttgaaattgttaaacggtacgttttttttgaaaaaaaaagtttatatatgaaagtagcttaaaatacatattgatctattttttaaaaataataaaatattaatcaatcaagcactaatgaactgtttcgttttccgtgctggagggatggttcccaatccatgcatatgaacagagccatacgcgatgttcctatgacctgaaagaatctcaggattaatagaagagattgaatgatgaagagctgcatctgcaagcatgtcggtgtcggtgcccgtccgtccgccaatcgagcattgccttgcatatttgcattgcatacgcgcatttctcgattgactgcgtctgtcttcctccctcgcgccccgcccatttcatataaaattcataaaattgatgtgagctaatctcatatcgtagctgccaattgcagcaacacttcatataaaattattcttctgctacgtccaaggaagtttcttgcctcaaatcttgcccacacaattgcttggagtactaccttttctccgctgaaactgttctttcctgtgtccttaattatatgtactaaaagtgaaagaaaacattgtagtacctcaattattgtttatcatgcattccattctctaatcaaacacaattgggtatctaaagcaaatgcataaatggattggtcacacgggatttttaaggacaacacgcttacatgtttgtttgctccatccattgtctcctcgttggatcaacgtcaaccttgatcatatctagctgtttactactcctacatgcaaagtttgcattgcatggaaagcgaaagatgcaggaatatcacgacagaaacaaaatgcttgtttaggtgagcggcagccaggggcgcatctacccattaggcagggtgggtcgaccgacttagctacgactcgtgtcgccccacaccctcaagaccccccttaccccattatagtagttatgtgtcatcaaaattaagtataacaaagtgtgaatacttaacaaattgagtcagttatgcgaatgaactattaatatgatatgtgttgtgtctgaattctcttaacgagtgaacattttcgttctccgccccatctatattttaaa

SEQ ID NO: 90318 - DNA, 612 bp, Oryza sativa
tatgctgtatctgagagcaaaccacaaaattaattaaagcatacagtacagtacagtagtattatatatatatatatagagcctgcattatccatgcatgcatgtacgttgttaaaacgtaccacacgacggtggaggaagatatatatggagagagtactcgctagctagtacacagtacgtggacacgcacgttcgtacgtatgatgaggacatgcgtacgcaacgcagtcgagttccagtaagtatacttgagttgagagctagctagcttaattattcaaaaactatattattgtaataatatagtagggccggccggccgcatccgcaggcgtgcttgctttcttcattatggatagatagatagagatagtaggctattactattagcggcggcggttggcgggctccctctgggagttgaagtggacgacggcggtggggaggccgagctgatggtacgccgcgaatgctcttgtgttgaagttgggcctgtccgccgcggcatcagcgcgccgtccacgaagcgcgccttctgctcgtacagcaccagcacgtacctgtgtatccccaccgtcggccgtggccccatgtactccaccatctcct

SEQ ID NO: 90319 - DNA, 636 bp, Oryza sativa
ttgcggggactctcgaccacggtctctactacccaaggtgtcctggcaaggcacacttcgtcgggtacagcgaccacgccggcgacatcgacaccagcaagagcacgagcgggattctcttcttccttggcgagtgccttgttagctggcagtcagtcaagcagcaggtggtggccctgtctagttgcgaggccgagtacatggcggcctccgccgcttcgacctaggcgctctggcttgctcgactgcttagtgatctcctcggcagagatactggagcggtggagcttagggtggatggcaagtccgctctggccctggcaaagaaccccgtttttcacgaacggagcaagcacatccgggtgaggtaccacttcatccgaagctacttggaggaagggagcatcaaggcgagctatatcaacaccaaggaccagcttgcggatttgctcaccaagccccttggaaggatcaagttccttgagctttgctcccggatcgggatggctcaactttcccacaagacgacgcacaagacttagggggagagtgtaggaataagtcttggctggttggtcttggtcttggggggctttttcttgctttttagctttctaggacagcatctctactttc

SEQ ID NO: 90320 - DNA, 7303 bp, Oryza sativa
tgcagttgccccgcttcttgccgccaccgctccgcctgccctgctccgctccgaccgcggcccgccgccgccctgctccggtccggctaccccgctccaccggcccacgctccgcccgcggacttgctccgctccgactgcccttgctccgccggccaccccgtccatcgcccgctctggtcgccgccgcccgctccaccgatcagtgaggagagagaggggagatggggagagaggaggaagaaaaggggtgaggatgacatgtggggcccacgtgggccccaccaatttttttattaatttgtgtgtgaaactgacatgtgggtcccacgggttttattatttttcggatcgaattaccacgtaagcgccacgtcaataccacgtcagacaaagaccgagtcaaattagccacgtaggcgccacgtcagccaaaaccaccctcaaaaccaccaagggacctaatctgagccggttttgatagttgagggacccattgtgtctggttttccattcgagggacgaaaatcggattcgttgacaagttaagggaccttagatgaacttattcccttagaaaaaggtaaagcccacatgtcaatgctataattgcatgggagagggataaacggatgagaagtgccacaataatcctcatccaatataatctactccatttatcctaaaatataagataatctactctaatcgtctcaaaatataaggtattttaaaggagtgtggcactttactaggaattgagtagtccatatgagccaaaaacacgctagaggattgaacttgaaacaccgaaaatccctaataatctaaagacgcgtgcagattagcgttgattttagacagctcaaacggcgtggcgcgccgcgccgcggcgcctaatcaatcaggccgacccggcggcacgacgagccgcgcggcgtcgaggcgcgggctcagccggagcgcgacgcccctcatgtcctccatgccgcgctcgtacccctccagcgcgtgcgccgcgagctcccgcttgtgctcctcggacagcacgtactcctgcaccgccgccgccttcgccgccgcgagcccgcgctgcgccttctcctcgacctccttccgcatggcgtccgcctccgcggcggcgtcgcgctcccgcgcgcgcagcctctcctccagctccagcgcgtagtccagcgagaacgtcgcgtagttcgccgcctgcgacatgagaacgagtgaacgcggcggcggcgacgacgacgacgagcatcgcatcaatggcgggatgtggatagcgaaacctggagcagcgtgacgtagctcgacgcgacgacgtcggagggcttcgccgccgggaactggcgctcccgcgacggcgtgacgatgccctgaagcagctgccgcgcggccttccagtcggccgtgtcgccgtcgtgcttgtcgggcacgtgccccggcgtacgatcatggtcgctcgccgtcggtttctgcgcggagaacataggcttccgatcttggtcgctcgccgtcggcttctgcgcggagaatcccggcggcggggaagacaggccggaggccgagcacgagaagccatggggagtaggtggcgtcccgtctttcgcattggcctctgcttcaaacttcctcttcttcaccgacgacggcgaacaccgcggcgtgtcgctctccggctcggtcttcaccttctgcgccgtcgccggtgcctgcgccgcggccgccttctccgcccgcatgctcatcatcatctcaaagactgacgggtccatccctgcaggaacacgacgggagttataaattcgttaatgtcgccggagccaggaaggtgttcgacactttaccttcggccctagtagaacgagaaggcggcggcggctgcggcgacgcggcggcggcggggttggaggagaatgcggcggcgaggttgctctcggtgagatacgtcctgagatcaaccgcggcgcggtgcttgtccagaagcttcgccgcccatttctcctcctcaccggtgagcaccggatcggcgatggagctcttggacggcggcccaccccaccgcacctggcacggccacggcgccgacgacgacaagaagaagaaaccttccttccaacctttgaggtgtgtgggcatccccgtgaagagcaacccgacggtgtccttgccgcggaagtggtaccagccgttcgacttgaacaagcacagcttgaagaagtgccggaacacggcgagcgacggcggcacgccggcgtggtgggagagcacgaggaagccggccatgatgcgccacccgttgggcgtgacctcgctcggcgcgaggccgaagtgccggagcacgtcgcaggcgaaggggtgcagcggaacgcgcatcccggcctccagcgcgtccttgtacacgcacacggcccccggcggcggcgtcgagcacgcgcggaggtcgccggcggggcgcgcggcgaaccccttggggacgccgtgcttcttgcagagcgcgtcgacggcttcctgcgtgcgcagtgacgaggcgatgcgatccgcgatggacctcgagggcgcgggcggtgagtcgacggcggcggcggcgtcgtcggcggagggagaggagaaagcgtcggcgtcgatgatctcgacggaagacgaggaggaggaagaggaggaatgcatcgtcttctctcgtggtcaaagcagcagaggtaccagcgggacacaagtttactcttgtaggagttgaaccaaggcgacggttggttttcccatgatggttctgcccccaaatccaattccccccctgctccccccctctctctctctccgtctcctattttgactacaaaagattttaaggctgtgtttgctgggggaggttgggaacgaatcttcttcgcacggaaaacggagcggtccattaacgcgtgattaattagaaattagctatttttttttaaaaaatgaatcaatatgattttttaaagcaatttttgtatagaaactttttgaaaaaaatacaccgtttagcagtttgaaaagcgtacacgcggaaaacgatggagaggtgttgggaacccttgggtccaaacacaggctgtgttcttaccctcaagtgcccaattcatctatcttattttccgcgtacatatttttcaaactattaaacggtatgtttttttaaaaaaaatctatatgaaaacggcttaaaaaatcatattaatacatttatcaaaaaaaatagctaatatttaattaatcacacactaattgattattttgtcctccgtgcacactgttccggggaacatccacatatcctatccttcagagtacaatgaatagatgatgtgtcacattcacccaaaatctctttatattagaattaaggaaaatttgagaaactatatacaaattatttctaaaataacttatctagtacaattaaaactagcagatttttcacacgagttgaagccgcgattcagagatgagcttttatatgtagttgtggcacaggcgttcgcaaactgggtaccattcctgaactcctcaattctatcggatggacttacaaattgaggagttcatccgataaacacggaagatactttatcgtcgctgtcacttacaaattacttatcatttttttttcaaatgtaatgtttgtgtaaagactatactaaattttatactggtgttctgtgtttattttaaaaataatggaataaattccaacctttgatactggtgttctgtgtagtaccttagttatccctgcttaacgttgctctaagctgcatttgttatacacgtaagagctacacttaatttttgactcaaaaagctacgttgataaccaatgcttcgttatcgttaaccattatttcctacattttcatcaggatactgaattacaaatatcgctatcatttttcttcctttttttttacccctttcctacccttcttgatccttaagcgcataaaaggaagctcgttttttttttttatttcacatctttgtacaaaagcttctgctaccgtgggcttcaaatccaaacaggcccaaatcttccatcttagcagcacatgggccagcccggtaggcattggcatttggatcagcccaaatgacgttgtcttccagatcaactgatcaaccaaacaccaacagcgcttgtgcccccagatcgccggagagttcaacgccgccgcgaccggcgaggcggagcttgatgggcgccgtgtgggggttccataccgcgcggctccgggaggagagtcccctcacgctggtaagaggggattagtggattggattactccacactgacaccgaggaaggtgacggggttatgattgattttttgggggcaatgtggtgtggtgtgcagatgatgctggagtggaaggattcgagatcgatgggcgggtgatggcttcgcggagctcgtcggcggcgtagtggcgcacgatgaggggtctgtgagcagccgcgacgaactggtgatttatttcctaactattccctgtaaattttattttattttattttcggttcatagagttctcgtgctactgaatatttcgctctagtgaattgtttagcttgttgctgctccacaaatcaaatagcagtaatactgaaaagaaattagatttccagtgtgcacgatttggtagtctaagaatgcatgcactgaataatgtaaaggcatacattatatattgtggaaatagatgcgccttatgcatatagaacaaagtatctaaacaaatagactaatggttatggtgaatattacaatttgatggaatacaacaactactaaaatcacatttgacattttaccttaaatctggcgcccattgacttgtcttttcaacaccataccttattatttttctcacaacacacatatcagcttagatagagttgtagcaatagcaaggacattattccacaagagaaagcaggatttcaaccacactgctcatgctcggtcttctgcgcctatcttcttccacacatgacactgcaatttttagcactgttgctgcctgtgaatagttgaattctccattcatcctgcagtcaacaaagtccagcagccatgattgatcttcgctagctaatttctcttttagaacatcagcggtgcgcttaacagccatttccacctcctcttcaccatcaaccacccatctggaaacccgattcccttttactaactcaagaagcactactccatagctgtaaacatcagccttgcctgtgatcggaagatttagagcccattctggcgcaatgtaccctctagtcccatgcacttttgattgggtttctgtgtttgatcctcgactaactagtttcaccagtccaaaatcagcaatctttggctcaaaatctttatctaacaatatgttctctggtttcacatcacaatgcacaatccactcaagacattcgtggtggagataggccaatcctttcgctaccccaagtgcgatattgtacctttggctccactgtagcacaggaaacaaacccagattgtcagataatactctgtctagagaaccattctcggcaaactcagaaaccaagagtttgtttgtcttttcggcacaaaacccccaaattctgaccagattcatatgataaactctccctatgatacttagctctgacctgaactcctgttctccgtggatcacatcatttagtttcttcacagcgaccttccttttatcatcgaggattcctttgtaaactgctcctgatcctccacttcctagcatttcttggaaacaatctgttgccttctccaactccttgtagttgaaccttcggaattgactggaaattatggtgtaaccttcgtcttgaatctctggtcttctcccccatttgttagcagcccaacatccaactgtaattaaagtcatttcaactacaagtaatgtcaatgctgaagaaaggaagtaaccaaacttgatattggaattgttacccgtgagcatttgtgatgagggataggcttctttttcagtcatcacgcaagcatgcgatggtttggaagccaacaattgtgaatagggcgtcgccttgggaagttttagatagaaatcattatagtggtcttgggacttcctgccattaaaaagcaaggccttcaaaaaacatttccctatacccttgtggtattcaaaggcttgacaatcagcattgtccaagcacatccttttgcactgccagagtgtcactggcttggagtagttcaagtcatagccatagaagtcggtgtggggtatcttcttgaatatgaatccgtggttagacttgctgtttgcgttgttgttccaaatgagtgtggcgtttgccttgtaactgcacccttggctccagtcacctggtttaaccatctcaaagccttcgagacaagaacagcgagggtctggtttgtaaatgcacaaactgtttttaccacacactccatgtatttcacatacttgacagaatgccatccaagtgacagaccattttccagtggtcatgtttagactatacaacctaaggtttccatcataatccagtgtcaacctcctcatgacatccttctgaccatgatcagatgcttcaaagttgagctggtcagtagctatgaaccaaccatcagagtctagaaccccatgtcggctactgtaataagtggtcctaccattgtcccatgataagaaggcaggattaggccaatatatgctactagtctcagggccattgtatataagactcagcaaattgttactgtcaaagaaaaaggtgtataaacctgaatagggtaaccccctagcggatgcagacaccagctttgtatctcgagtcatcggctgcaatggcagaagtgtgtcggttggcgagtcgaagctttcccagaggcactgaccttctgaatccatgacgatcaggttgccactgttctgaagctctgcacggctagcaccagtggccgtggtgttggtgctccatacaaccgtgccgttgtaatcaacaagggccaagcccccgtccttccggaaggtgagcttggagcccttgccgttcaccggagcatcacgtttggccgtccacgccaccgtcttctccgacgatctggagaaccagatggagaaggtgaaggcgttggtggccaccttgtagaagccacaggcgaagtcgccattaggcgacactaggatggtcttggtatcatcctctgtggagacagatgaacctctagcaaggtagcttttcttat

SEQ ID NO: 90321 - DNA, 690 bp, Oryza sativa
agttgatcaagaaggtcgtatgaccaactttttcttcagggatgccaaaagtagaaatgattttgactgctttggagatgctgttatatttgacacaaccttccgcacaaataaatacagcctggtatgtgctccttttgttggagtaaccaccattggcagaatattgtttttggatgtgcattcttgttagatgagtcctcagcttcctatgtttggttatttaaatcattcctcgagtcaatgggtggccggtctccaaaatcaattttcactgatcaggatgacgctattacgcaggcagttgagctggtttttcctaacacgcagcactgtttttcctattggcatattctgaaaaatgcacagtctcatttaggcacggtaaatacctctcaaacatttcaaaatatgtttattaagtgcatgcaaggacctaactcagaaacggagcttgaggaatcatgggccacaatgttaaatgaatataagttacaggagaatagctggcttagcgacctttataggtcccgcaataaatggtgctcagcatttaataaagatactttcgatggtgggatcaattcatctcagtggggggaggtctcaaacaatacatttactggaatatctgatgaatctacccctcttacacgatttgcccttttactagaaaaggttttcaagggt

SEQ ID NO: 90322 - DNA, 1004 bp, Oryza sativa
caactcgttggctcccattctgtaaggcctcttgtggattggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggttcaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaacccgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttac

SEQ ID NO: 90323 - DNA, 1252 bp, Oryza sativa
cggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagcggagtacgacacctccgtccatacagtgcttcgaatggtgccatctgcagactagcttggtaactgttgttgtacgagaactcagcatacggcaagcttttgtcccatgctccaccaaagtcaagcgcacaggctctcaacatatcctctagtatttggttgacccgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacatgattcttgctagatagagttctgctaatttctttcctgagtaggtagtgtgcaccggaatgaagtgagccactttggtgagtcggtcaacgactacccaaatagaatcatgccccgatgacgtcctgggcaaaccggtgacgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatactgagtttgatgagcctcggttagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgaacctcaccgcatagttcctctacccatgcgacgttgcagtaactcttcctgctcaaggcatctgctaccacattagccttgccgggatgatagtgtattcccatatcataatctttaattagctccaaccatctt

SEQ ID NO: 90324 - DNA, 655 bp, Oryza sativa
accacggcggccggcgagaacgaggaggtggcggagatatgcaagaagacgtcgtacccggaggtgtgcattgccacagcggggaagcaggcgtccaagtacggcgccgccgtggacccgctggcggtgctcaacatgcaggtggacgcgttcgcgctgcgcacggaggcggcgcggaagcacctgacggaggcggtgaagacggcgacgccgaaggcggcgaaggcgctggacctgtgcgacagcctgtacctggacgtcgaggacaacctcggcgcggcgcggcgcgccatcgggttcaaggacgccgtcaccatccgcgccatgatgggcatggcggcgcaggacatgcagggctgcgacgagcagttcaggaaggtcggcgagaagaaccccatggaccacttcaaccggtccctcctcgagatgtccgagatctgccgctccctctccaacatgatctgatcgatcgctctcgccgcccgccaccgtgccggcgcgcgcaccgcgcacgcgtgccgccggccggcgaccctttgcgtgagagcgagcaagcgcgctccagcagcgctggtgattgaagcttctctttttaatttgttttctttcgcttctttttttttaacgatcttgttttcttagtgagggctgcagg

SEQ ID NO: 90325 - DNA, 844 bp, Oryza sativa
caactgccgtgaagcataagaaaccactttgccatcctgcatcaacacacatcctagcccctggcgagatgcatcacaatagacctggaaatctttcgtctgatcaggcaggattaagaccggtgcagacaccaaccgtcgttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgatcttggcatatagctggtgctcttttaacttttcaagtaccagccgaagatgctgctcatgttcttcctcggacttggagtagattagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacaccgtagctcctttcaactgatcaaacagatcatcaatccttggcaaaggatacttgttcttgatggtgacctcattgagtgcgcggtagtcaacgcacatcctcttggttttgtctttcttct

SEQ ID NO: 90326 - DNA, 1847 bp, Oryza sativa
tcaactgccaatcataaattcataacatagaagaccccatgactaattaattatgaggaaggtcataattaatggggataaggttggaacagtgagatgagaagacagatgggaggtggtattctgaatttctgatgcgagtctagtggagcttacagggatcgcaaactatcattctttaaacttcagtgcctattcttttaaccagtgtcattcttttaagtaaatgtgtgcatcatgtcaatactcactgctgtcatcccaaagttacatctttcgatgaaatgtgattatattggtagaacataagagaatatccagtgcatgactatattgttctttgcatctactgatacggaaaatatacaattgccaataaatgcccctaaatcttgcttcttgcaaaagaaaaacaacaagacagatgacaatggcatcagaacctagtctattggctaagtcattgacattgtaatgtcacaagggaaatctaatgaaatatcttggttatggaagtaacttgcagaaaatcaatacatctgttttgtaatagaaaatgagacagctaagcgcaatttgcaatttccctccaaattaagcaagtgtacaaggatatatacctcaagcagattgtacctctccagtagtgttattcttggcaaaacacctattgaaagctttactgggataagaaacttcaaaattctcctataaaattgagcattgatcagagttcgaacaggttgcatcataaattatatgctagaaaacttcaaaccccatgtaatacaagtacctcaaatttgactcatactgaggattacagtgcaccaaagcataagttagcttctgatctgcctgatttcaatagaacaaaaccagggaaaaaaaaaactttggtatcagtggtctcatcattttgtgtgcaagtaccacaaccatgtcgagagggagagagagcttacaacaagaaagttctcattaaacacctctaatctgccggtataatacatataagtgacctgaaacattatgcataatcaatagtttattagaaatggcaaggtaattgtaagtctttaagacagaaacagttaccagatttttgctaatcttaccttatctttcactggaaaatcttcaaaatcaaaattcctggcagtttcaatacttcttatgacactgcgacaaaggtgaactgttccaagctgcataatttaagaatattgttatatcgaagtatcgaactatagagtagatacatgtgtttgtgcatagtacacttcactatataaaaaatatatatgtattgagagtaccactttacaagaaaataatccttactctgaagtaaattttaaatagctggcaggtaacatagagtgctccaatgcgtttaggccctttaacctgtaaatttggaaataaaatagcttcagaacacaatccagacaagcataaacataatccatgaaagaacaagcacaaagaaaattttctgtgcaaaacatcatggtttaggttgcaactgctaaatggtagtaaggaactatgagccagaacatctctaacatcaatgttacacccataataacaaaaggcaacagaactcccttcaattcaattatcgtgcttacgcagctacttattaccactcaagaaagaagaatcattttagagtttcataccgcgagtgcaccgaaaaccttcatcaggaaggacccagcagactgcagcttgtcagggttcttcccactcgttgcaagctccctatctgcctacacaaccaagcaaacaaacaaagcttccattaggcatgagccgaaaattttcacattcacagaacc

SEQ ID NO: 90327 - DNA, 1008 bp, Oryza sativa
cagtagagatgcggcatatggatggcacagcagatggatctctggctccagctcgtgcagttaacaaagcagcatgtttctctgcagctgcaactgcttctgatcctgtagcaccattggagcccaaagcctccaaaagagcctgtgaaaaagaaaccacagcagtgacataagagattgaaggagtcagcagatcagaaacacatgatggctcttatagccttcattctgctagcctgctcgctaagacagttaacactgtaatgttaccaacctgaggagttgctggcaacctgcataagctgttatccaagctctgaccaaacgcagacaattctcgctcgatgagatcccttgagttagttgacatgtctaccacagcattacaagcagggatgattgttcttgacgcatatcctcttgcagataatggctgttgctcccaaaatgttgatgcctcctatatatagcaagtttggcaacatctttcaagaagtgatcatgcccattgtattcaattattgagacatatatcaagagtaagaagagtgtaagacccaaatccatgaatccccacctaagatatttctaatagctcctagtttcctatggtgctaccttcataaagctgccaagccactataatgaacataattatgacttgagctcactacgctgctgtattagatggaaagttactaaaatggcaaccagtaaccatgctggaaagaatgttgataagtaactgcttctatttctatattcatgtctatatctaaaactttctttaaaaaattgaatagcgaactaagtaaagagctagtaaggaaaagtacaaaggctccagactaaccatattggcccgcagaagagcattgtaaatgcactcaagttctgatctacgagcatcaaattcttctattttcttccactttttcttcaaggaatcttccgcttctttccactcagcacataacttgtacagacgctgtacctcagaatcagtgt

SEQ ID NO: 90328 - DNA, 656 bp, Oryza sativa
atcaggctgcttaatttgggcgttgtcatcgcacagttcacaactatagtatgtttactttatcgccaggtggcatatgctgatatgcacaattgcacacaggaatcttttctttcagactaactggcgagtagaaatgtgcacatggactttgactatttaatcttcaattagtataaggctctaaatatcactcagtgtagatgtactgattcagcataaacaagtactctcggtagagtttaaatgaaatgcttttggtaaaaaaaaatatatatcgtaaacataatgcagaactgagtataaaacaaacactctcaaaccactagattccaggaaataagccaaagttttgatagagaggtagagcactgcaggacaaaaggacccacgcaaagtctttgagccctgcacagccacctatcttgaccaccattccaccacacccttatgacgataaaattcgaccacaaaataaaacaataatagcagtaaccattgtgcaaaagaaaattaaaccctaacctctgattcttcccaccttcacaccacacattctaagacacgtacgcatgcctgtacacaagagaagcccagcaaaagtgaaagacactcgtccatcctacagtgtttttacagtctgcgggctgcaggaa

SEQ ID NO: 90329 - DNA, 1198 bp, Oryza sativa
accagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgtccacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactctttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtggggctgcagga

SEQ ID NO: 90330 - DNA, 3719 bp, Oryza sativa
ttcgccgatcagtgcaatgggtccttcctccggcatcgacgacctcgtcttcccacccgggcagacgtttcggttcggcagcctcgacttcgtcaccgacaatttcggcaagatttctctccttgacttggaatcggaccagtcgggagagaaccggatctcagtcccgtttggattcccaaacgcggctgaaacctacttcaagaccatctcaatcgagtcggcttcaaaccactcggctgagatcgcatcttctccaacgacaccagatcaagatgatggggcttacccaccagtcctgatgaagctccccgacgatttagcggccgtctccaccacgacagcgtcttcatcccgtaggcctatgcggaagtcggtctcaacaccgatttcgcctagcttcagggaagtcggcgtcatcctccaaccactcggcacggtttcgacggatcagctagatgaccactacagctctcccaccgtcgactcgcgccccaccgacatcgtggagtacgatgagtttagctctcgctaccacgacttcgacgacttcgacgacttcgacggaagcctagatgacaactacacccctctctactttggcgttttcatggccaataatgagacggaggagcaacgccaagcccgggagaccgaagaacgtcgccgactggaagaggagcagcaagcacaagaacaggaacggctacggcgtgagcagcaggaccgtgagcggatcgccaaggaggctgaagatcgacgtcagcgagctttggaagcagggcgccgagcgcgtgatctcatcggccaacaagacgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcggcttcggtcccagttaactccgaaagcgtccacacgccgactggcagccgagtcccccacttccgatctcaggactaccgtcatccaagcctcagcatcaccggtgcaggatccaatcgcaggagcaggggtcacgacgagcggtccgtgcactcgcctcccgactaccgtggggagcgccgagtagaacggccacgttcaccgcctcgtcgccgccccatcgatcttcgcgacacaatcatacagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggctcaccgtctacggtctcgcaatccgcgcagcaggaggagacaacaaggccatggcgaattatttaccagtggctttggcagattccgcccgatcttggctccatggactgccccgtggtacgatcggatcttgggccgaattacgcgaccacttcatcgccaacttccaaggcaccttcgagcgtcctggcacacaatatgatctttacaacgttatccagaaatccggagaatcccttcgagagtatatccgacgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaagaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttacgagtctaaaaggaagcaaaagctgaccgaacgggagatcaatgctgttcagcccgacacgccccaatatcttcgatggtcagagatcgcaatcaggtttgaccgctcggatcatcctgaccgagtggtccacccggggcggtaccccctggtactagacccagtggtccgtaacgtcaagcttcgcagaaccctcattgatggcggcagtgcactcaatatcctcttcgccaagactttggatgatatgcagatccctcgctccgagctgaaaccgagcaatgcgccttttcatggagtaattccaggattatccgccactccactcggccagatcacccttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatggcgtctgcccgagaggaaatccgactggctgcaaccacggtgagcgaaggagaagtgcccgctgccaagatttcaaaaagtggggaaactgaagccgagactaaaaagattcccttagatccttctgatcctaccaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagacgccaaacctattaaacaacgactccgccgatttgcacaagacaggaaggacgcgatcaaggaggaattgaccaagctgttagcagcaggcttcatcaaagaagtccttcatcccgactggctggcaaacccggttctagttcggaagaaaacagggcaatggcgcatgtgtgtcgattacactgaccttaacaaatcttgcccaaaagatcctttcgggttgcctcgcattgaccaggtagttgactcaaccgccggctgcgagcttctcagttttctggattgctactcggggtatcatcagatccgactgaaggaatccgactgcttgaagacttcattcatcacgccttttggggcatactgctacgtcaccatgccgttcggactaaaaaacgcaggagcaacttatcaacgcatgattcagagatgcttctcaacacagatcggccgcaacgttgaagcctatgtggatgatgtagtcgtcaagaccaagcaaaaggatgatttgatctcggatctagaagaaaccttcgcgagcatccgcgctttcaggatgaaattaaaccctgaaaagtgcaccttcggagtaccgtcagggaagctgcttggctttatggtgtctcataggggcatccaagccaacccggaga

SEQ ID NO: 90331 - DNA, 4206 bp, Oryza sativa
ccgtggagaaaatagagcactggaccatgcattttgacgggtcaaaaagactttcgggcactggagctggagtggttttaatttccccgaccggagaaagactaagttatgtactttggatacatttttcggcgtctcacaacgtcgccgagtatgaggcgctccttcatgggctacggattgcaatttccctagggataaagcgtctaattgttcgaggtgattcacagctggttgtcaaccaagttatgaaagagtggtcctgcattgacgacaacatgatggcatatcgacaagaggtacgcaaactggaggataagttcgatggacttgagctcagccatgttcttcgacacaacaatgaagctgccgatagacttgcgaactttggatccaagcgcgaggcagcgccatctgatgttttcgtcgaacacctttattccccgacagtacctcgcaaagatgctactcaagttgcggacactcatgacatagctatggttgaggccgactggcgagagcccctcatacgatttttgacttctcaagaactccctcaagacaaagatgaggccgagcggatttcaaggcggagcaaactttatgttatgcatgaagccgagttatacaagaaaagcccttcaggaattctgcaacgctgcgtatctttagaggaagggagacaattgctgaaggacatacattctgggatatgcggaaaccacgctgcagcgcgcaccattgttggcaaagcttaccggcagggttttttctggcccactgcagtgtccgacgccgacaaaattgtgcgcacatgtgaaggttgccaattttttgccagacaaattcatctaccagctcaagagttgcagactatcccgctatcttggccgtttgcggtttgggggctcgacatggttggcccgtttaaaaaggcagtcggcggttacacgcacctcttcgtggccattgacaaattttccaagtggatcgaagctaagcctgttgtcacgattacagcagataatgctcgcgatttcttcatcaacattgtgcacagattcggagtacccaatcggatcatcaccgataatggcacacaattcaccggcggagttttcaaagacttttgtgaagactttggaatcaagatttgctatgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacgggccagtcaccttttttccttgtctatggggcagaagcaatgttgccaagtgaagttgaattcgagtctttgcgctttcgaaatttccgtgaagatcgctacgaagaggaccgagtggatgacttgcaccgattggaagaagtccgcgaagcagctttgattcggtcggctcgatacttacaagggttgcggcgctatcataattgcaatgttcgatctcgtgcctttttagtcggcgacctggttttgaggaaaattcaaactacacgagatcggcacaagttatctcctttatgggaggggccatttattatctctgaagtcacccggccaggttcttatcgactcaagcgcgaagacggtactctcgtcgacaactcttggaacattgaacatcttcgtcgtttctacgcttaactttatcattgtatttccctattttgactgtcaaacatcaagttttctccttgaagttgtcagtcgggggctattatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtattgtacaaattgagcctccatgtattacattcaaactcagtcagaatcagtcctttcatcatcagagtcttcattactcggctggaggtcgttgttgcgaaattgctctacaacatcactcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgctagctcccatacttccagctttcttgatattcttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaactgagcttgagatttgatcttgcgatctgcaaaacacatttatgatgagcatctgttgcattataaggagagaagctcagattgttagctggcgttaccttcgacttccttcaaggctgagtccctttgcgcagccagttctgtcttgtctctctccagggcttcaatttgcttcgccatctgttccatcctggcggcttgcgctgtttgaaatccagatggttgaggatgcaattatgacagcataaatcaatggaacagatctggatgattaccttttgatgaaccacttagttcgaagtttgcatcctggagctgggcgattcggtcccttaactctttctctgtctttttggcgcattccttggcctcatgcagctggtccctaactgcttctagagttcccaaatgaggaaccagcttttccaaagttgtagtcttggcctcattgcgaagatggattctctgcacgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcggcttgtgagttctcgtcccaccatttgatcaagataggaggacgagagtcgtcggtcgcctttatgcgagggatttcttctccgtcatcacctgatggtcctgatgtgtttccaagacattagatggatacattgaggttatttaaatcgccattgtttgagaagacaactaacctgaagatgtacctagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcagtcggctggttttcagcagtcggctcggggtcctgggatatattttgctctgtcatggcaggatcggggtcttttccagatggatctatatcagatggtttcctgcagagtgttctttcagtatttagcattattttcatcggaaaacatgccgaagcggaaatcataccgagagatctaatacctggaagatgttctgatctttggcattgcacggccagccagttttttcctgggcatggtacgctttgggggattattaggcgagcccttatccccagatttatcatcgtcgccttcatcatcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaacaagatgcttccatagttagtcaactcagcgtgaagataaaattatgttctgatcacggtttgagggtttcctatgcatacctgtggaggcggattgaatgcattatatggcacaactggcagttggtgagagtagctgactacaattgcattgggctgcaggaat

SEQ ID NO: 90332 - DNA, 1155 bp, Oryza sativa
catccaaaacatccacagacaacaaatcacatttaattcatctatacagcagcaccaataatcgaaacaacaaatcacatttcattcatctaaacaatgcaattcatccatcggaaaaaaggaggaatgggggagggtggcggcatacttggagaagcggcgtacttggagacggcggcgcaggccgtagtcgtcctggatcctagtggcggcggcggagaggcagtggcgaagaggtcgaggcggtcggcggtggtcggggatcccggcgtcggggaggtcagggtcggggaggtcggggaagtcgatggacggacggcggagaggacgaccggcggcgagggcggcggtggaggcggcggcggagatggcggtggagaggacggcagagatggcggcagagagggcagcggagatggcggcggagagggcggaggagaggttgaggcggcgacggtggagatggcggtggagaggacggcggcggtcgagagagtgagtgaggaggcggcggtggagaaggaggcggcgagggcggcggagagggcggagatggcggcagagagggcggcggcgaggagggtctggatggcggcggagatggcggcggagaggtcgagacggcgacggtggagatggcggtggagatggatggcggcggtcgagagagtgagtgcggcggcggtggtgcaggccggcgtcggtggagaggtcgaggcggcggtggagaggagggcgtagagggcggcagagaggtcgagagaggcgaggcggcggtcgagagagtgagtgagtgagagtgggcgccggatctggatcgatctagaagatgtccaaccctaggtcaaccctagtcaaactcacctgtgacgggctccaactatgtggctgtcacaggtggcctcacctgtgatgggcgccaaccgtggagccgtcacaggtaagaccacctgtgacgggcccagcactctgggccgtcacaggtgaggtcacctgtgacggccctacagatagagcccgtcacaggtgagtttgcctagagcaattttattttattttatttcacttagttcttttattttccttaacatattttcacatacactacatatttttttatacttaattattttatttcactaacagtagtaattg

SEQ ID NO: 90333 - DNA, 1951 bp, Oryza sativa
tttagacttgtgtttgagttcaataaatgtgtcgtatctaaatatgtgacttttgttggaaaaggctatgacagcggaggcttcttccgcttttctttgaatgacatgtgtaataatcataatgttgtgaaccatattagcgagaatgatgagtctaatgtgtggcattcgcgactctgtcatgtgaatttcggttgtatgacacgcttagctaacatgagtttaattccaaaattcactttggtcaaaggttccaagtgccatacttgtgtttaatcgaaacaacctcgcaagcctcacaaggcatctgaggcgaggaatttggcaactctagaacttgttcattttgatctgtgcgaaatgaacagcgtgttgactaaagggggaaagaaatatttcatgacactgatagatgattgcactagattttgttatatgtatctattgaaaacaaaggatgaatcattgcattactttaagatctataaagctgaggtagaaaaccaacttgaaaggaaaatcaaacggttgaggtctgatagaggtggggagtatttttccaatgagtttgcatccttttgcgaagagtttggaattattcatgagaggatgcctccctattcaccccaatcaaatggggtggccgaaagaaagaactgtactctaactgagatggtgaatgccatgttagacactgcgggactttccaaggaatggtggggtgaggcagttttgactgcgtgtcatgtcctgaataaaattccaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggagtacccgacatgcatgttggtacaatttttgagtctagagatgctacattctttgagaatgaatttcccatgaaacatacacctagcacctctagtcaagaaactgtcatgccccatgagcactttgtaccgatagaacacaatgatcaaacgcctgagggaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtatgcagtgaaatagactcgattatgtctaatggtacttgggaagttgttgagcgtccatatgggtgcaagcccgtaggatgcaaatgggttttcaagaaaaagcttaggcctgatggtacaattgaaaagtacaaggcaagacttgtggccaagggttatacccaaaaggaaggcgaggacttttttgacacatattcaccagttgctcgcttgaccatgattcgagtactacttgctctggcagcctctcatggtcttctcgtccatcagatgaacattaagacagctttcctaaacggagatctggaggaggagatctatatggaccaaccagacgggtatgtactagaaggtcaggagggaatggtgtgtaaactgttgaaatccttgtatggcctcaagcaagcacctaagcaatggcatgagaagtttgacaccacgcttacatctgtaggctttgttgtgaacgaagctgacaaatgtgtgtactatcgctatggtgggggagaaggagtgatcttgtgcttatatgtcgatgacatattgatctttgggaccagtctcagtgtgattgaggaggtcaaggactatctgtccaagagttttgaaatgaaggatttgggagaggctgatgttattcttaacatcaaactacaaa

SEQ ID NO: 90334 - DNA, 1151 bp, Oryza sativa
ttaatcctgttagtcgcaacttgctatgttcctgttcctgatgttcatgcctttagcatactggttatgttacatgttcctgctcctgatgttcatgcctttagcatgctactggttatgttacatgttatcactagatcaccctacactgttcatgccataattattgtcttaatattttggattaaaatatgccgatatatgaccatatttccaacagctctctcttgaccatcttatccctaacaccaaaactctaacccgatcacttagctgctggagagagaagatgtggttatcttggacagtgtaggtggaagccagagggatactgccaccctagagctaaacatcggcaaccactttgtttgtgccactgctacaactacttcgcctacagacacgaagggggggtggtggagttagcatagaggatattgccgcagcgaggttagtgcggagaaaattgcggcaacgggaattcggcgcgtccgcgcgtcggccaggttttttcgtgatttcaccgtaggatccataagcacaactccttttttatattagtataaatatatgctttacaaaatatgtggagaaagatcagaaatcaaattttaattttttggcaggaaaacgatgaggctttcaccggtcagcactgtctagttgggcccacatgtcaggcgctgctttcctgtcaggcgctcctagtcctatctgaggagagtttagcagcaacgcacagttatggacgtgttcgtcaccaccgccgaccccgacggcatagcagcgcttgacgatgacgcgctgctcccggcgatggacgtgttcgtcaccaccgccgaccccgacaaggagccgccgctcgccacggcgaacaccgtgctgtccatatatcctcgccgcgggctaccccgccggcaaggtgacgtgctacatttccgacgacgcaggcgcggaggtgacacgtaacgcggtcgtggaggcggcccggttcgcggcgctttgggtgtcgttctgccggaagcacggcgtcgagccgaggaacccggaggcgtacttcaacgccggcgagggtggtggtggcaaggcgaaggtggtggcgagggggagctacagggggatggcgtggccggagctggtgcgcgacagga

SEQ ID NO: 90335 - DNA, 1194 bp, Oryza sativa
tgcccagagagaaacacactcccttataggcgagcaaaatatttttggaagagataaagctaaaaatgatattgtcaagatgatttcagaagctgctgaatctaattctaataccctgtcagtgcttccactaattggaatgggaggtgtaggcaagactgccctagcaaaactggtatttaatgataaatcaaccaaagataagtttgataagatgctatgggcatctgtatctaatgcgtttgacctaaaacatattgtaaatataatcatacaatcagatagcggtgaaagcaataaccaattaaccctagaagcattaacaaagaaacttcatgagcttttaagggacaagagatacttgctagtgttagatgacatatcaaatgataatgtcaactgggaagaattgataaacctgctaccgagtggtagaagtggatgcatgattttaatcactacacgtcttacaaaaattgcatcagaattgaagacattagaaccatacgaagtgccaaaacttccacatgaagaatgcaggaaaatatttgttcgatatgctttcagaggagaaaaggcgaaggatagagagttactaaaaattggagaatccattgtacagaaatgtgatggccttcctttagcagctagaacattgggatccctattgttcagaaaagacatttctatgtggcaagaagtaaaggaaaataatttgctgagtactgggaaaggtaaagatgatatcttgtcagtattaaaactcagttatgatgcacttccatctgatttaaaaacttgtttttcctggttatccacttttccaaaggactatgatattttcagagaacttataataatgtattggatggcaatgggtctattgaatccagctagtcgaactaaggaggcaataagagtgggagagaaatactttaatgagcttgctggaagatctcttttccaggactatgtttttaatcatgatggcagcatctcacattgcaaaatgcatagccttgttcatgatctagcaatatctgtgtctcaaaatgagcatgcaattgttggctgtgaaaattttactgccactgaaagagttaagaacctagtgtgggaccacaaagacttcacaacagaactaaaatttccaacacaactgagaagggcaagaaaggctaggacatttgcatg

SEQ ID NO: 90336 - DNA, 1385 bp, Oryza sativa
gacgagaacgagcagtcgtgcgggaagcactccccaaaaacctgatcacccgcctacccgatgcagatctcaggcgaaggtgtggttccgaaggccctgctccttccaatctctcgtgcacgcaagcgatcagaagcgaggaggcgagagagcagcacaggcgcggaggaggaggaactaacacccgggaaagaagcaagcggatcgttctgatcggactcgcgacctccttatctatcaggagagaggcagtcgtgggaacgtgggatcatggacgcgccgttgcggaggcagtcgtgggaacgtgggttcatggttgcaaaagaatagtgacgtgacgtgacgcatgcacgccagccaagcctcggctcggcgcgcgcgcgcgtgcgtgtggctttccgacccccacctcaaccagtcaacaggaagcctccaataactccctatttaggttgagatattcctcgcttaaatcctgaggtggtattattatccttaacacttattatgggcctttgagatttaataggataaattgggcctagcccaattattctaacaatccccaccaaatttcatggctcataagaaatgttctcaaggttgttcctgtttgatataccagggttttggtggagactgttaagttgaacttccacctaggaaatgagctacatcagatcacaactgaataatggactatgccttgaattgtcagttttgtgtgatctggtttcactcagatccttgactggtactgggctgtcgttcgcatcccctctgttcggagcatataagtcaaactctaggcctttcatgagtatctagagatcgcccaaacctcatagactgtgactagcagtcgaactcatataggtgtgttccttctgagatgttctgcaagtcaacatctctgcttggaaaagccacccggatcacattaaggcatgagccatcctaccatgcgggaaagaagagaagtacatcatgaaaatgagcccttttcaagggtctcttctctcagtcacacaatagtttgtttcgccatccaaattcacaagatctccgatcacaatggacaggtttccactattgtgcaaccttaggtgggtatcaagcccatttccctcgatgcactatctatcacattacgtggtagccccttggtaaactgatctgccagatttctagccgtttggacatagtccaatgctatcactccggagtttttctgctttctgacagatttcagtcttctcttgatatgcctagatgacttcatgttgtcctttgaactgttcactttaataatcactgtttgattatcacagttcattaggatagctggcactagtttttcaaccactagcaaatccatcaggagt

SEQ ID NO: 90337 - DNA, 673 bp, Oryza sativa
aaatatgtactaaaaaaccatctcatttgaatcaaattaagcaaacgaaggggaaaaattaattgaaagaaagaacttctttttttttggttagctaggttgctatgagcctctgatgatcatgccaccatctgctcctgctccggccactgcgcgaatatgtcgccggcggcgtggccgtccttgacaagagagttcacccatgacacgtccggctccgccgccgcggcgtgcgtcgccaccggcatggcggattggccgcggaacgcgaacgacgccgacttgcggagcttgtgcagctcgtcgccctggacgccccagtccagcttgccgtccggcgagccccagtccgagagaatggacggcgcgccggtcgtcgccggcgacatgagcgaacgcgccgccggggcgcggcctccgcggtcgatgaagctctggctgcgcttggcgaacgccgaggcgcgggagctcatgatcgccttcgccatggagtggtccagcccgaacgcggtgttcgcgccgcccaccatcggcgaggtcggcatgtgcatctgcgtggtgtccgccatggagctgtacgcgggcatgtcgccggcctgcttgagggacagcgcgtggagctgggacagcatggccgggtcgacggagccgagcaggtcggtgtagtccggca

SEQ ID NO: 90338 - DNA, 672 bp, Oryza sativa
caaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatgcgctggatgcgttcactcccttcgcagtcctcgggtagagtcttatctgtgaggtacgcctggatctcagtgatccaagcaatcaatctaagggagctgggagcactcccctcgggtcccgaggcctggactccgacaggcctcgggggccgttcaggcgcgtccgtctcccctagggggtcgggccgcgccgacagctgggcaagcctttcttaaaaggcgcccggtggggtctgggctcgcgaggaagcgagccttgaaagttcgtcggcgaccgcgttatcccgtctgggcacgtgccgaagctctatcccgtcaaaatggcgctccatacgccgcacttggcgcacgtaagcgtccatct

SEQ ID NO: 90339 - DNA, 729 bp, Oryza sativa
tctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgtttcggggcctgccgccgcactttctgccggaccggccttgcgcccggccgcacggcaagacggtgctcaatcacctccctggggaccccgggcatgtccgccggtctccaggcgaagacgtcggcgtttgcccgcaggaaggagacgagcgcgtcttcctatttgccgtccagaagaccaccgattcatgtggtcttggacgggccgtcgcccagggcaacctctttgaccgggacctcgtcgcacgtgatcatccgctgcctcggggcggctgggacggaggtgctgagcctctcgttgccaccctcgggcttggacgcggcggcgaggtggtccgcgcgctgctccatacaagcaagcgtgactttgaggtcgccatggccagagatggggccaccggggcccggcatcttcatctggaggtaggcgtagtggaccgcccccatgaacttcaccaacgcgggcctccctaggacacgcgttgtaggg

SEQ ID NO: 90340 - DNA, 1361 bp, Oryza sativa
cgtggatcgaggagttgccagcggtgctctgggcgaaccgaaccacgccaagccgagcaaccggggaaacgcctttcttcgtcgtctacggcgcggaggcggttctcccatccgagctcaccctgaggtcccctcgggccaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaacggggcccagaaccgagccgtgccccggggcgtggtgaactccgggggggaatcggcaaaggcccacaatcgggtcatccataaccctcggtcaccacgttcccggcctggccagtctcgacacgcggatctccccaggcactagccccgacccgcgccatttgaggctaggacctgggcacgagccctcgttcaagccaagacacagaaggactgcggcatagaccatcctcgtctcatacacacaacaaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcaccgccctcctcgtcggagtcgagggcgaacgcgagccgaggggccgtaccctcgaagctgtggacgatgtggtcggcggcgtcccggacctgtgcgcgcgcgccatcctcggttccaggagggaactcgtccagcgttgcccacggggagaagtcagggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcggtccgcccgccccagaggctcgcctgccgcccggcgcggtctagacgggagacggcgtcccgaagcatgccgggccctacctcacctgccaagcggagggcctcgacctccccggcggacgagtccagcgcgccctgcagctcggcgatggtgtgttcggcggctgcaaggcgggcggctaggtcgccgtcacccgcgggcgccccgccgctgcgcgctctcgtgtccagctccttcgcccgcgcctcgaattcagcggcccgctgatccagtgcggccctctcggcgcggg

SEQ ID NO: 90341 - DNA, 920 bp, Oryza sativa
tccgacgttaaaccaactacggtctaacgctgggggctcgctctgttctcttctgtataaatcatgcttgtttacggtttacataatgcctgatatttaatctgctcgttatatcctgataatactagaagatccacgcagtttttgagtacatactcgatatcccctgctatatatcttgtcttctagaaaataattttcagaaacaattgagcactcgagtaggttgtagtcgagtacaccgcattatcgagaacgatctcgacaaatgcagagtcgtcgcgcccaacctaccaacgaagaccgacgacctatctcatagctccggccatcgctggactactcgagaaaagtttgttaacggataattcctcgctaacgccgtcggcttgatcacccgacatgattgcgaacggacatccggatatgctataagttgggtatgtgagtcatgctggccacataatatgcacatataataaaccaactttaacgcccctataggtaattaagagactcctactcctggttctcgaaccagtaaaatgtaatgatctctctcgcctcactttaagtggtcgagttacgactactgcctggtcctcgaccagcggcgtagcgtttctcccactacttctactttcagtggtcgagttacgactactgcctggtccccgaccagcgatgtagcgtttctccggctacttccactttaagtggtcgagttatgactactgcctggtcctcgactagcgatgtagcgtttctcccactatttccacttcaagtggtcgagttacgactactgcctagtcctcgaccagcgatgtagcgattctcccattacccctacttcaacaaagttgatgtcaggtacacaagatcgccaagggttttacccagagatcccttacccagat

SEQ ID NO: 90342 - DNA, 1444 bp, Oryza sativa
ttcaactgtggcgagcttggccacttcgccgacaaatgcccgaagcctaggcgtgccgggccaaggtttatccaggctcgtgtcaaccacgcatctgcggaggaggcacaagcagcaccagaggttgtactgggtacgtttcctgttaactcaatccctacaacagtactttttgattctggtgcaacgcattcgttcatttcaaagaagtttgtcgggatgcatgggttaataagagaggaacttagcacaccaatgcgggttcataccccagggaatagctccacttcggttcaattcagcccttctataacaatagaaattcaaagatcaccgtttctagccaacctcattcttctcgaatccaaaaacctagatgtcattcttgggatggattagctgaccaagtttaagggagtcatcgattgtgtgaatcgcacagtcaccctgaccaacgagaagggagaaacggtagtgtacaaatcaccaaactcaccaaagcaaggggtctccttgaatcagattgaagcggaaatcccagtggtcaccatggagaagaatttgaggaaattggaagatatccccatagtctacgagtatccagaagtgttccccgaagacctcactaccatgccacccaagagagagattgaattccggattaacttggcaccgggaaccgctccaatttacaagagaccgtacagaatggcggccaacgaactagcagaggtcaagaagcaggttgatgagcagctgcagaaagggtacattcgaccaagtacttcaccttggggtgctccagtcatttttgtggagaaaaaggataagacgaagaggatgtgcgttgattatcgcgcactcaacgaggtcacaatcaagaacaaatatcctttgccacgaatcgatgatttgtttgatcaactgaaaggagctaaagtgttttctaagatagacctgcgatcagcctaccaccagttgataatccgggaagaggatattccaaagacggccttcaccactcggtacgggctatatgagtgcacggttatgtctttcggacttactaacgcacctgcattcttcatgaatctgatgaacaaagtgttcatggaatttctggacaagcttgttgtggtattcatcgacgacatacttatctattcaaagtccgaagaagaacatgagcaacatctccgtctggtactcgagaagttgaaggagcactagctatacgccaagttcagcaagtgtgacttctggttaacggaagtcaaatttctgggccatgtcattacagctcaaggtgtggcagttgatccatcgaacgtggagtcagttaccaaatggaccccaccgaagaccgtgtcgcagactcaaagttttcttggacttgcgggatattaccgccgattcatcgaaaacttctccagaatcgcccggg

SEQ ID NO: 90343 - DNA, 737 bp, Oryza sativa
cggcgagctcggccccacttcttccgacgagcacgacgacgtggtggtggtggtggtggtcgtcgtcgtggacgacgacgacgacgacgacgacgagtgctgcgcgtgcagcaccgacaccgggcttgagctcggcatgccgcgctctgtcgccgccgctctcctcctgccgtggccgggatgctgcgcctcgtcgtcgtcgtcgtcgccgccgtagtgcagcttgcggcgggggcagccaccgctctgtttcttggctccgacgtgtccgctcttgccgtcgggttcgccattgtcgtggcgagaagcggcatccgggctgaagctgaggacgatgaactcgtcgccctcctccttcaagtacggcgccggcggcggcggccacccctccgccgagctcaccgacctgctcctcctcctccgccgctgccgccgcagcggctggcactccgtctccggcggcggcggcggcattgcgtcgagccccatcagcctggccacgacgcaggggctcatcccctcctcctgctgtacctgcacctgcaccaccaccgcaccgtcgtcgtcgccgccgcccgcattgccggcggcggcgtgcgcgcagagtaggcggcggaggaagtcgagagccaaggtggaggacgccatggcaatggcacctatggcagcatcagcttcgcaatgctgctgctattatatcttcttcttgcctccgttcttgattcgggctgcaggaa

SEQ ID NO: 90344 - DNA, 713 bp, Oryza sativa
atgtttgctgtctcagcatttggcttatttgttaacatcataatggctgtcttgcttggtcatgaccatggacatggacacggacatggtcatgggcatggacattcccatgaccatgatcatggtggttctgaccatgaccatcaccaccatgaagatcaagagcatggccatgtacatcaccacgaagatggccatggtaattcaattaccgtcaatctccatcaccatccaggcactggacaccaccaccatgatgctgaggaaccattgctcaagagtgatgctggttgtgacagcacccaatctggtgccaaggatgccaagaaggctcgtcgtaatatcaatgtacacagtgcttatctgcatgtgcttggggattcaatccagagcatcggtgtgatgattggaggggctatcatctggtacaagcccgagtggaagattattgatctcatctgcaccctcatcttctccgtgatcgtactcttcaccacaatcaagatgctgcgcaacatccttgaggtcctgatggagagcacgccccgcgagatcgatgccaccagccttgagaatggcctccgcgacatggacggtgtggttgcagcacatgagctgcacatctgggccataacggtggggaaggttctcctggcgtgccatgtgacaatcactcaggacgcagacgctgatcaaatgctgaacaaggtggg

SEQ ID NO: 90345 - DNA, 664 bp, Oryza sativa
caatgaaaaccaccacaaacttatccaagtattccatgagacactttgttcattaagttcatgaagaaggcaggggcattggttaaaccgaacgacatcaccgtgaattcaaacagtccgtatcgcgtggtgaatgcggtcttcggaatatcttcttcgcgaatacgtaattggtgatatccggaacgaagatcaatcttggagaatacagtggcacctttaagctgatcgaacagatcgtcgatccggggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcagctcttccaactgtttcttaacttcggccagttcatttgctgccatacggtagggtcgcttgtacagaggagtggttcctggagcaagatctatccggaactcaatctctcgtttaggcggcataccaggtagttcttccggaaacacgtctccgaactctctgacgatggggatttctgacagtcctatctgatgaagttctgaacttctgactgaggttgggggtgcaaagaaaacaaccggttgttccggccctcggtacagagtga

SEQ ID NO: 90346 - DNA, 3559 bp, Oryza sativa
tgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaggcccagcacacacaaagacaaacgagaaacagcggaagactagggcgacgaccacaggcacttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggccccagctcgtcccaagccaacccaggccaaccattccatattttagttgttaagcaagttttaagaattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaaaccacctaatgttacctaattaaatagcgaagcatctacctaaaatcatactagtggtaccatgagtagagtgttcactagttggggttttgttggttctagggtgaacaaggtaataataacaataacaataataaggtcgtaacaaaggtaaataggcatggctaaataaaacagtgataacgcgggaatttaaataaataggcggccataggcacggcggagcggcggccgagagaggggagggaagggggaaacgaaatggcggtcctcggctcaccccgggttgacggcgacgacgggaacggcgaccgaagcggagagaggcggcggcgcggctcgggtcgacgaggacgatggtgctccggcggtcggcgggcgaaacggaggagtggacgaggtcgacgagaacgcggcgaagccgaaggaggcgacgccgaagcgggaggaggtccggggcgacgacggcggcgaaccggagctcggcggcgacggcggagagagaggacgacggcgcgagctcgaatccgatggggagagcgagcggcggacggcggaaacggaggagggaggcacggggagcgtttaaatagggttgggagtgagagagggcggccggaggggaaggaaatcggtgcggcgatctcgggctccattgatgcgccggcgaagatttcgggagagtaaatccgaacgaatccgagggagagagagagggaaaagaggggggaaagagagagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcggggaggaggctgatgggccgcgggggagaggagagagagggagggagttgggccgagccggcccaagagaggaagggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattcttcgcacaatttcgaggatgtattttagagtcgatttgggacgcgacaccagagtaggcatctagaaaacacaaaaggtcgcaccccgcagtggagtcgactatctgatctatgcgtggtaaagggaagggatctttagggcatgccttgttgaggtccgtgtagtcaatgcacatccggagcttaccgttggccttcgggacgaccaccgggttcgccaaccactccggatggataacctcgcggataaagtcagcctccaggagccgcgccacttcctctcggatgaaggcctgccgctccggggcttgacaccgcactttttgccggacgggtcgcgcatccagccgcatggcgaggcggtgctcgatcacctccctagggaccccgggcatgtccgacggcttccattcgaagacgtcggagtttgcccgcaggaaggagacgagcgcgctttcctatttggcgtgcagggtcccgccaattttggcggtcttggacggatcatcgccaagggggatctccttgacgggcacctcgtcagccgaggtgaggcgcttcttggaggcgtgggacgcggaggcctccggggcctgtggctccgtggccactgccaggttgtcggcgcgctgctccgcgcaggcgagggtgactttgacatcgccaaagacggtgatgggacca

SEQ ID NO: 90347 - DNA, 838 bp, Oryza sativa
cggaaaaggaagggaaaaagaaaaagaaaaaaggagaaaagaattttccctagaattaaaatattgcttgctcaattttaattggttaaaattatttttagggctctgaaaattccacttaaaatcctgttagtgaatttcgacctgtagaactcaagaaaaattccacatgccaattccgattattatttgcattgatttaaaaggggtttactcttactttgcaccggtattttcttaggatcatttataaattaaatttaggcttggaaggagaacttcagggtgtgacacccgcccccgggcggagggaggccacgacgcgtcggggcacgacgccgcctcacttacggtgacggcggctcgccccgaggcgcgcttcaggcggcgggtgtccttctgcggcatccccccgtgaactcggagccggagacccctgtccagcgctggttgaacgacgtggccaacttggtcaccactgcccagcggcagttagccgcgggcggccgagccgccgtcaccggtacgtcgcatacccccattgccctctcctcgtcagcgaggaggagggcccatcgatcggccacggccttgaggcggtccacggctccaacatcgtcgggggcctcgggaagccggaggcgtcccgacggtctctacggggagcaggacgctcgaatcaatatcgagcgacgccgggacgagcgccgagctgcccgcatggggaaggcgcctcctcatctggagtgccgcgttcctccccacgagacggccctccccccacgctcagccctggagggactggttgtagggcattcgtggcgagtcttcggaatgt

SEQ ID NO: 90348 - DNA, 1061 bp, Oryza sativa
ccccggagcggagtgacacgaagatacacgtaatcccctgcctcaaaagtgagctcccttcgacggttatccgcgtagctcttctgcgagactgggcaatcctcaacctttccttgatgattctgactttctcttctgcttccgctaatacctctgtcccgaacagttgacgctcgcctgtctgatcccagaagaggggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaatatatcttccaagatttgattgactcgctcggtttgaccatcagtttgcgggtgataggccgtgctgaaatttaaacgggtccccaattcttcctgcagcttctgccagaattttgaggtgaactgactccctcggttagatacaatctttttgggtactctatgtagacacatgattctcgagaggtagagctccgccaaccttttgcccgtatacgtggtatgtactggtatgaagtgagcaaccttagtgagtcgatccatgactatccagattgaatcgtgacccgatgatgtccagggcagtcctattataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatggatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctactctgactttatccacgagcgtaggccgtgcc

SEQ ID NO: 90349 - DNA, 646 bp, Oryza sativa
cggtggagttccaggtccaggcctcttccttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccttggaagttcatggtgaactgctagcacaaatcctcccaagagtggaccgacgcgggcggcaagttcattagccaaccccgcgcctgtcctttcagggccatggggaagaaattcgccatgaccctgtcgtcacccccggcggcctcgatcccggtcatgtagacctggagaaactcggcggggttgacgcttccgtcatatttttcggtgatggtgggccggaaccttgggggccaacggacgttccgaaggctcgccacaaaggctcgacagccgacaccaccaatcgggggcacggggggctggcccccgcgcccgaaccgaagtggcgctccggacgaggaagcgccttccgttgcgtgggaagc

SEQ ID NO: 90350 - DNA, 637 bp, Oryza sativa
gtgccgggccaagggttatccaggctcgcgtcaaccacgcatctgcggaggaggcacaagcagcaccagaggttgtactgggtacgtttcctgttaactcaatccctacaacagtgctttttgattctggtgcaacgcattcgttcatttcaaagaagtttgtcgggatgcatgggttaataagagaggaacttagcacaccaatgcgggttcataccccagggaatagctccacttcggttcaattcagcccttctataacaatagaaattcaaagatcaccgtttctagccaacctcattcttctcgaatccaaaaacctagatgtcattcttgggatggattagctgaccaagtttaagggagtcatcgattgtgtgaatcgcacagtcaccctgaccaacgagaagggagaaacggtagtgtacaaatcaccaaactcaccaaagcaaggggtctccttgaatcagattgaagcggaaatcccagtggtcaccatggagaagaatttgaggaaattggaagatatccccatagtctacgagtatccagaagtgttccccgaagacctcactaccatgccacccaagagagagattgaattccggattaacttggcaccgggaaccgctccaat

SEQ ID NO: 90351 - DNA, 930 bp, Oryza sativa
cttaggagcggcttgaaaccgtgcacacatgcaaacactaaacatgatatccggcctagatgcagtaaggtaaagcaagctaccaatcatagaacgataaagctttaaatctaccggtttacctccctcatcaaggtcgagatgcccgttggttgccataggtgtcttgatgggcttcgcatcctccaagccaaacctcttgagtagatccttgatgtacttggtttggctcacgaacgtcccatccttgagttgcttgatttgaagtccaaggaagaagctcaattcttcaatcatggacatctcaaattccctagacatcatatcaccaaatcccttgcaaaataccttattagtagaaccgaaaatgaaatcatcaacataaatttgacacacaaagaaatcatcaccaatgatttttgtgaaaagggtggtgtcaacttttccaattttgaaatcctttgacaaaagaaaatctctcaatctttcataccaagccctaggagcttgttttaaaccataaagagcttttgagagtttataaacatggttaggatttttaggatcttcaaaaccgggaggttgttcaacaaagacaagttcggcaatttcaccatttagaaaagcacttttcacatccatttgaaatagttttatatcaaagcataatgcaaatgcaagaaggatgcgaatagcctcaagtcttgccacgggggcaaaagtttcaccgaagtccaaaccttcaacttgtgtgaaaccttgtgccaccaaccttgccttgtttctcaccaccaacccgttctcatcttgtttgttcctaaagacccactttgtccctatgacattgtggtctctaagtctttcaaccaaagtccacacattatttcttgcaaagttgttgagctcttcatgcatagcattcatccaatc

SEQ ID NO: 90352 - DNA, 3041 bp, Oryza sativa
gcggctgcgctgacgacgacgaccggcgcccatacactgctgcttcggtctcgcgcatggcggcgccgcacaacggaggaggaggacggcggcgggtttcggggcggcgaggtggtcggggcggcggctgcgggcgctgccgccgcaggtgagcgagttcctcagccccgagcagctggtccccggctcgccggccgacaccggcgacgtctcctccctcatcccaatcaggcaaagtactctatacatattgtacttcaccagcattatcctactcgctccgttctatattataaatcgtttaaattattttttatcaattttttttaggtttgatcaaatttacagaaaaaattagcaaacatttataacaccaaattagtttcattagatttagcattgaatatattttgataatatgtttgttttgtattgaaaatgttactatatttttctctaaacttagtcaaacttaaaaaagtttgataaaataaaaattcgaacgatttataatatgaaacggagggagtactaagtaaagtatatactggtacctgcaatacttgatagcaaaatcaagcaagtacaggatgaaatacgtgattaacttatgcttaagggttaagactctaattttaggattacagagctaatcaatacattgtgttaactaactttaagcttatatggcatcagataatattacaagacatgtatatatattaccaatgaaaataacaaattattccttggccttcgaagaagcagcaagataatgtcaggaaagacaatgttttgtatgaacaaaatataactgtatgattgtatcttatatgaaagtgggtgtaaatttattgtgttccaatgggctatgaaacatccaaattctcatctttaactgggccaaactaggccttgctgtgtcttgggctaggtagaacctgggttgggcttgggctaaccaggtcattgttggaagtgccttagtttcacatgattttttatttttgtgcttagcattttttatctccaacaattgacaaaaaccaggacttgatagtcactgtatggtcagtgagctcagactcaaaacatgacagtctagatggttactgtattttacaccagctgcaaaaacatgcgatcaatacgcatctaattaacagcataacctcacatctgacaaatgccacaaaattcaggactcattgatttttgcctctctgttttttctttaacttttgttgatggatgttcttgcgcctgtgtgcaaaatgcagtgctctgatgctgttcttctacttcgtgtccaactgggtggtgcctgagttaatcatgaaggatttgcaggagcccaaaaaggctgaagaatcagaagaagctgcctcttcaccggcagcaaccatgtcggtcgccggcgacggccaacctgaagctaaaatcagactcaaggtgaagaagacaaagaagaacaagaaggctgccatgaaggtgtagtgcacacaaacatgcatcaatataatgcatgctagtatgttattgcccccctcatgatgataatagatagcatcatcagtcaaagatcacactaaagtgctaattataatcaaagagaagattaattctccatcagaaggggggggcttacatatagtatgtactcatcatgttctgaatctgtgagccattcaattgaaagataattattccattgcatatttgcatctatgcttagctagccagtactaagtatcaacaacagctagcactagctaataaagttttgggagaagaatgaaaggtggagagggcattggtacaaacaggtggggcttgtattgtggtagcaggcaaaagtgggcaaatcagtcggttatcagtgtggtgggctgaactccacaaaatcctctcatcgcatcaactggttgttgttgttgttgttgttgccatcacacacaacagcatcaatgggaaagcttaggcatgctcagctcaaaagtaggaagggaccaagggcaggcaggatcatcaacttgcaaagcatgtgtaggtttcagtttcatggttcaattcaacaatcaacaccaaaaacacttcatggatcagagagattttttaatacgtgaaaatcgttcgttagcgcctttttaggaacaaattaggaatgacataggattatttgaggaattttttttcagggtatggaattctaagaatcttatggagaattttatccatgtggctctctcaaacaaaagaatgaacttttctgcatagccatgtgttcacatgtaataggcagccacacaggaaatctaacagaaggtcaaactttctttaatactctctccaaattcatatagaaatttatccaatagctcaattgagcaaatcatattctgcaattccttatgattcaacttggcgagccacttttgttttgtatttttttttatatggcagattccaccagagtgtaaatctgttgttccagaatttcgcaatttgtccggtaccatgcccttctagaatatctgacgagaccaaaatatggaggcataaccacttgcaatgaactgaactgaaaccatatgtaaagtatgctgcagagatcgatgaaggatgatagatagatatattccatttcttgctttgaagcaacagaacaaaaaaacccacacccacacatcactcctcccatttcgatcagaaataggtactgcaaaatcttcctgcttgcttcagaatccagaactctccattaatttctcgaaacaactgcctctagtacagtacagtgatagaaaaacataacaaaatgataaagaaaaagagagcaggattcagtcaattgacagccacagataaaagcaagaaacatttttctttcactcctgccgattttgtttctgaatttctgatgacagttaatttttgtggttaaggaggagtccagaacatcagatgccactagaaagaagatcattcaaggcgatgagtggtagaaaatcatccacacaactaaggccagggtaaagcca

SEQ ID NO: 90353 - DNA, 745 bp, Oryza sativa
atgctttgttttgcatatcgctgtccgttattatagaccttggtttctgctggcacattgctctcaagaacacctgaagaaaccaagtataagattcaacacactcgtcggacacaataccacaggcaaaaatagtggtttgacgatggtggttgagcccaacaaagggaataaatggcatgttatatttgttcatcctttgtgtgctatcaaacacaacaacatcaccgaacgattgatagtccatgcgagactgagcatcacaccaaaacagatttttcagacgaccttcatcatcaacttggtactcatagaaaaaaccaggatccttgtcccgccttttcttcataagttctaaagttgcacttgcatcaccttccaaaattctagacctcttataccttgatgaataattgtacaagtcctttttgacaaatcccaccttatcgtatcctccatacttgcacttcatgaccttcattatgacattttttcgaataccaatagattctagtgaatgtatttcagatttttggaagtccttaattttcctatgagaccgaagaaatggagtcccgtcgtggctcgtcaatgggtggttatgctcatcaataaaattgtctacaaaccagataccatgtttcttatcaagcttgatgctaagactagcagcgcattccatttgagtcaacgctctttcccttcttacacaatcctcaggttttaccaaactaggatctcgaat

SEQ ID NO: 90354 - DNA, 1101 bp, Oryza sativa
agtggatcccccaccccctttcctctactggaagatccgtgattttgcgcatgcgtaccgctccgggatcacaaccccgtctgttgtcagtagccccattggattgaacaaatcattattttcttctctgcctcccctcctgcatgtgtgccacttgactttcttcttgttgcataggttgcggagcatatcattgccggtgtggaagagtggagcaacaagaagcctcccatgcctatgttggtttattttaacgcagatgatctaaggaaacaagctgaagcttccacaaagagatttcagcaaggttttcccttctctaaaatcatgatatttttgtattgttgacttttttatatatatatttgggttaaatactttcaaattgaaactccaccatattctatctcatcttcttgacatgtgatggtgctccttggctcaggaaacccaatttccatcttggacgggatctttatcgccattaaggatgacattgactgcttcccatatccatcaaagggttagttaacagactgaaggggcctggcaatttggttgctgtatctgagaagcgtattccaacttataccttttttttaaaaaaaatacaggtgctactacatttttcgacaaaattcgctctgtggagaaagacgcagtttgtgttgctcgtttgcggaaatgtggagtgttattcattgggaaagctaatatgcatgagctaggccttggagtaactggaaacaatccaaactatgggtatgcattatcatcatgtgactgcttattttgttcagatcccttagctagtatctagggagcacctgacggtttgtgtggtcacaaatgagaaatatcaacaacattttcaaggccaaacagactgtattattttattagctgtttcctagaatcaaattaaattgagcattagtaaatctagttgactaaccaaagtactgggatgaaaataaatattttgagctatatcagtcacatccaaatctaacacatttttttaaaagattaggaattcaaaattttgatccaatcttaagtgatagtccaatttactgttttctgatgcctagtgtagtg

SEQ ID NO: 90355 - DNA, 1339 bp, Oryza sativa
ttcgccgcccaccagctgcatggacccgcatctctatggtgggaccatttccaggctatgcagccggagggacagcctgttacttgggcccgcttcaccgccgctttccggagaacccatgtgcccgccggagtcgtggcccttaagaaaagagaattccgagagttgaagcaaggcaaccgctccgtgatggagtatttgcacgagttcaacaacctggcccgttacactccggaggatgtgcggaaagatgaggagaagcaagaaaagttcctggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaaccaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcaacagaatcaacaagggactcgagcgccccgtcctcctacgccaactgtgcagcctggtcaaggccgcagggacgcttcaggtccgcagcgtctgtgcttcaactgcttcgagccggggcactttgcggataaatgcccgaagccaaggcgtcagcaaggccaagcgcctccccgccccaacaacggtggtaaggacgtcagtcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgatcctgctagacaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagataggactgtcagaaatccccatcgtcagagagttcggagacgtgtttccggaagaactacctggtatgccgcctaaacgagagattgagttccggatagatcttgctccaggaaccactcctctgt

SEQ ID NO: 90356 - DNA, 1927 bp, Oryza sativa
tcactatcatcctggtaaggccaacgtggttgccgacgctctaagtcggaaaagccactgcaacactcttaacgtccgtggcattccactcgaacttaatcaacagatggaagccctgaacctaagcatagttggtcgcggattcttgactacgttggaagccaagcccaccttgctcgatcaaatccgcgaggctcagaagaatgatccagacatgcatggactcctcaagaatatgaaacagggtaaagccgctggtttcacagaggatgaacacggaaccctatggaacggaaatcgagtatgcgttccagataacagagaacttaaacagttgatacttcaggaagctcacgaaagtccttattccatccaccctggcagcacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggatttcatcaccggacttccaaaaacccaaggtggatatgattctatatgggtagttgtggatcgattaaccaaggtagctcgattcattcctgtgaagaccacctatggagggaacaaactagccgagctctacttcgctaggatcgtaagtctccatggcgttcccaagaaaatcgtatctgataggggaagccaattcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctagatttcgggaagacctgggataagagtctcccctatgccgagttctcctacaataacagctaccaagccagcatacaaatggcgccttatgaagcgttgtatgggcgcaaatgccggacaccgctcctgtgggaccaagttggggaaagccaagtgttcgggactgatatcctgagagaagctgaagcgaaagtcagaaccattagggataatctaaaggtggcacagtcccagcagaaaagttatgcagataaccgtcgccgtgacctggaattcgcagtggatgattttgtgtaccttcgggtcacgccattgcggggtgtacacaggtttcagacaaaggggaagctcgcacctcggtatgtgggtcctttccgtatcgttgctcgacgcggagaagtcgcttaccagttggagctgcccgcctccttgggcaacgtgcatgatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggtccagtggagcaaccacgccgaagaagaagctacctgggagcgcgaagacgagctgaaggcagcccatcccgacctcttcgccagttcttccgaatctcggggtcgagattccgtttaagggggataggtttgtcgcgtcccaaatcgactctaaaatacatcctcgaaattgtgcgaagaataagtaaaatccatgtgaaagcctccaacaattaaaatgtgcaaagctaaaagtcaaataaggcttggaggatttttgtatatttcctaaaagcctaaaatgcgtaaataaattttagtggaattttcagagcacaaataataattaagaagaaataaacaaagttaaaagggttttataaaaagaaaaatccctaaaagtccatccccccccttcctctcttgggccggc

SEQ ID NO: 90357 - DNA, 674 bp, Oryza sativa
gaaaattacataccagatcactcattaaccaaagaatatatacatatatagcaccttaatatggaccacaaatgttaaagcaaaaccaaaataaaggtaagtcaaaaggtcctacagatgcgaatacctgacaatgataacctggttaagctggtcaactttgcaatccaatatcttgcatgaaatagctttcacaatccaatactccacttcatcatcattgatctaataaatgttttacatggtcaatataaattcttcgacaggtgaacagtaacacaatggcaggattgaacagctaattcaccttaagtgcatctatgattgcatggtaagggatctccccagcacaacggctgctgaggtcaagcagggacatcagtctcatttttgttatgcaatcctcatgaaccagtcctgccaattgtttatcattagaaatcctgtaaacgaagcatcacattttccatatttgctccaagtaaagacatttaatgttttcaattcagcagttgtacataccataacctttcagcaaggcagaattagctgactgaaactctaaataggaatcaagcctctgagtaagggaatatcttcaagagctcataaaccagctgatacttttcgtcttttccagctgtgcaactgctggcatattgagtagatcacac

SEQ ID NO: 90358 - DNA, 847 bp, Oryza sativa
atggccgaacgggcagtggcgcacaccctctctccgagcgctagcggtgacgacagtgagcagaacccgcgtcgtcgagctcgtactccaccgcccccctctcgccgaagtcttaggcgggaggaggcgctcgagggggtcgaaagatccgcaacttcgccgcccacgagcgatggagaaggacggcgagacggggagcgtcgcctcctcgtctacggcgatggcagcacgccccagggcgcgctccaagctgcgggcgcgctcttgcgtcacccgcccgttgtccccgatccagagactccagcccgatgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcagccgttacccgccgttcgtctgccattccctcgtcaactgtcacaccctgattttcgtgttaggatttataaattatttaataaattattaatagaatttatatgaaatgttcattaatttacaagtgaagttaaatgtgggaaataaaatttcctaaatataaagcatgggtggatttaatttttattaaattctccatggttaattatactctctggaattttctcggatttttcggagctcaattcctaaatgtaaatgatacagagaacagttcagtaattatttgatcaataatgatctaattataattgttaagtgcttttcttgtttaaaatccttaaattataaattgttgtttaaaaggaatattagaaatgattttaaaagcttaaa

SEQ ID NO: 90359 - DNA, 659 bp, Oryza sativa
ctctatcaacgtccgccagaatctcaccgatgtcactgtgccccagctgggcgctgccgccgcccggctcgccatcgccgactggggccggccggcgtgcgagatcacccacctggtgatgtgcaccaccgtcagcggatgcatgcccggcgccgacttcgaggtggtgaagctgctcggtctcccgctcaccaccaagcgctgcatgatgtaccacatcggctgccatggcggcggcaccgcgctgcgcctcgccaaggacctcgccgagaacaatccaggcggccgtgtgctggtggtctgctccgaggtcgtctccatggtgttccgcgggccttgtgaatcgcacatgggcaacctggtagggcaggcgctgttcggggatgccgccggtgcggtggtggtcggcgcggatccggtggaggctaacagtgagcgcacgctgttcgagatggtgtcggcgtggcaggacatcatcccggagacggaggagatggtggtggcgaagctgcgggaggaggggctggtgtacaacctgcaccgcgacgtggcggcgcgcgtggcggccagcatggagtcgctggtgaagaaggcgatggtggagaaagactggaacgaggaggtgttccggctggtgcatcccggcgggagggacatcc

SEQ ID NO: 90360 - DNA, 4361 bp, Oryza sativa
tgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaggcccagcacacacaaagacaaacgagaaacagcggaagactagggcgacgaccacaggcacttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggagttataccataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggccccagctcgtcccaagccaacccaggccaaccattccatattttagttgttaagcaagttttaagaattaaaacactaacttgggtacattgctcggcttgcccataaccgagggcgcggctattcgaatagattatactctgatcagagatgtacatctttacccacaagacacatcttcctcacgtgtaaccacgtgccacataccaccacggtatacagacgaaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaaaccacctaatgttacctaattaaatagcgaagcatctacctaaaatcatactagtggtaccatgagtagagtgttcactagttggggttttgttggttctagggtgaacaaggtaataataacaataacaataataaggtcgtaacaaaggtaaataggcatggctaaataaaacagtgataacgcgggaatttaaataaataggcggccataggcacggcggagcggcggccgagagaggggagggaagggggaaacgaaatggcggtcctcggctcaccccgggttgacggcgacgacgggaacggcgaccgaagcggagagaggcggcggcgcggctcgggtcgacgaggacgatggtgctccggcggtcggcgggcgaaacggaggagtggacgaggtcgacgagaacgcggcgaagccgaaggaggcgacgccgaagcgggaggaggtccggggcgacgacggcggcgaaccggagctcggcggcgacggcggagagagaggacgacggcgcgagctcgaatccgacggggagagcgagcggcggacggcggaaacggaggagggaggcacggggagcgtttaaatagggttgggagtgagagagggcggccggaggggaaggaaatcggcgcggcgatctcgggctccattgatgcgccggcgaagatttcgggagagtaaatctgaacgaatccgagggagagagagagggaaaagaggggggaaagagagagggaatcacggggagtgatttccccctctttattgcgcgcggggacggcgggatgcggcggaatccgcggcggcggcggcgctagggcacgggcgaggcggcgggcgcggcgcgaggtaggggatgacgggtgggccccacccgtcagcgagggtggcgggcgggcccgcccgtcagcggcacgcgcggggaggaggctgatgggccgcgggggagaggagagagagggagggagttgggccgagccggcccaagagaggaagggggggaaaaggacttttagggatttttctttttataaaacccttttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattcttcgcacaatttcgaggatgtattttagagtcgatttgggacgcgacaccagagtaggcatctagaaaacacaaaaggtcgcaccccgcagtggagtcgactatctgatctatgcgtggtaaagggaagggatctttagggcatgccttgttgaggtccgtgtagtcaatgcacatccggagcttaccgttggccttcgggacgaccaccgggttcgccaaccactccggatggataacctcgcggataaagtcagcctccaggagccgcgccacttcctctcggatgaaggcctgccgctccggggcttgacaccgcactttttgccggacgggtcgcgcatccagccgcatggcgaggcggtgctcgatcacctccctagggaccccgggcatgtccgacggcttccattcgaagacgtcggagtttgcccgcaggaaggagacgagcgcgctttcctatttggcgtgcagggtcccgccaattttggcggtcttggacggatcatcgccaagggggatctccttgacgggcacctcgtcagccgaggtgaggcgcttcttggaggcgtgggacgcggaggcctccggggcctgtggctccgtggccactgccaggttgtcggcgcgctgctccgcgcaggcgagggtgactttgacatcgccaaagacggtgatgggaccactagggcccggtatcttcatctggaggtaggcgtagtgggtggcggccatgaacttcaccaacgcaggtctgcccaggaccgcgttgtagggcagattgaggtccgccacatcgaagtcgatccgctcggtacggaagttggtggagtcgccgaaggttatcgggagctcgacgtggccgaggggccacgtgtgtcccggagtcacgccgatgatcggcagcgacggctggagcttcatccccggggccttgagcgcattgaaggcggctggggagatgatgctcaagctggcccccccgtcaaccaggactcgcttcatcctaacgttgtgaatggtcggggagaccacgagggccaacttcccacctcgagcgagcactgtcaaatggtcgctctggtcaaaggtgagcttcacctccgaccagtgcgccttccgagccgcttcgtgggttgggacggtggctagaagctctcgccttatggcttgaagcctcggcgggaggtgtgagcgcaagccccccctccccccaggtcgagcgtggcgacggttccctgaggtatctggaactccagatcctcgctgttatcaccatcatcggtgggggccttcttcttcgcttcccctcgtcggtcatcggctggggtcgcgggggctttgccctctcgtcgaccctaccgcttctcctcatcggcttcccggaaccgctcggccaaaattcttgactgagcggcagtcggcgagactgtgctgataagtgttgtgcaccaagcaccacttgtctgccgaccggccctcaccgg

SEQ ID NO: 90361 - DNA, 745 bp, Oryza sativa
tggatcccccgttttttaaaaaaaacggaccagaaaaggatctaggccagtttaggtcatggttcttccattgcctgctttgaaccatgttatacctactcaggcatatatgctcaactttaaccagtaggaatcagtaaaagttaggtataaatctcacacaaaaaacacaaaaccactaattttattgcataattaaagaacatatacataaaatccatagttttggttaaatttattaggatatgtagattagaataatggacaataaaaataaaggatatcaattttgtgggcatgttttgaagtttgcatggaagcatttggaatataaaggggcaaacaattgtaacaagaatggactaagatattgaaatttactcacagtagggtgaagcccaacacgaggaggatccacaatagcaacaatgtcttcgaactgacatgcagtagctgcagtcacatcattgttagaaatggaagaaccatcatcagatgtctttctgtcctccaaacagtccgatactttcaggtcaacagactcattgatcaatgatgcttccccatgaatatcttctccagcaacctcattgtattcatcatggctgccttccaacccattgccaaccctatcattggaattcccctttatctcatctatggcagaagaggaagaatcagctggtgcatccccgagctgctggctttcgccattgtcatttttctgcattgagctgtccaaatt

SEQ ID NO: 90362 - DNA, 750 bp, Oryza sativa
agaacaaatatcctttgccacgaatcgatgatttgtttgatcaactgaaaggagctaaagtgttttctaagatagacctgcgatcagcctaccaccagttgataatccgggaagaggatattccaaagacggccttcaccactcggtacgggctatatgagtgcacggttatgtctttcggacttactaacgcacctgcattcttcatgaatctgatgaacaaagtgttcatggaatttctggacaagcttgttgtggtattcatcgacgacatacttatctattcaaagtccgaagaagaacatgagcaacatctccgtctggtactcgagaagttgaaggagcactagctatacgccaagttcagcaagtgtgacttctggttaacggaagtcaaatttctgggccatgtcattacagctcaaggtgtggcagttgatccatcgaacgtggagtcagttaccaaatggaccccaccgaagaccgtgtcgcagattcaaagttttcttggacttgcgggatattaccgccgattcatcgaaaacttctccaggatcgcccgacccatgactcagttgcttaagaaagatgagaagtttaaatggacagctgagtgcgataagagttttgaggagctcaaaaagaaattagtatccgcaccagttttgattctgcccgatcagatgaaagacttccaagtctattgcgatgcatcccgccacggacttggatgtgtcctaatgcaagagg

SEQ ID NO: 90363 - DNA, 1739 bp, Oryza sativa
gattgccgcaaaaacccaccggagtccacttctcctcgtgctccggtgagtttgtccctcccctccgcctccggccgtcaatggcgtctgccgtggtcattttccctactcctaacccctcttctcccctcctctaggtgtcgccgccgctcgtccgcccctcctctcaccgagtcgtcgccgccgcctttcatcctccgctccggtcgttgtgctcgccggtgaggactccttgcccctccttttctcccccttcctgtgagcgccgagccacgccgcctttccggccgtgcaccgccacctttgcgccggccgtcggtcgccgtcggaggccgcgcgccgccgccgccgtcctgcccctctccccttgtgccactgacaatcggggcccgcctgtcgacgccgccccccccccttcgctgacgtcagccctgggcaatattgcgcaataaattgattaaggactttttctttattagtaaaaacacagattatcttctaaaattcatatctaattcatccaagctccgtttaagtccattcaagtctcagtaaatttataaaaatccctagaatccattaaaaatggttttgtttcctgttttagtagtcttatagtgtgttttgcttgtgtgctttgtttgtcgcgtagatttcggccgtttcgtcgatccgcggtttctcgaagatgttgctgtggtctcatcagtgcgagagcaaggcaagtcatgcattacatttgatcatattgtacccaatttacaaatatcccgcatttctattaaatgtcgcattcttttacaatgtcatgtgggatgggtcctattactcagccatttattgtttaccctatgccattgataacttgggtatcaaaatgattagatgttggtttaggaaatgcttagccatgcctagttcaactagtacacaaatggggatcacattattacatagactttgactattagcatagctttggattggtgccaccgtaatggtgttagttaattaaaatacactgaatggtggactgtgggtgcatggttttgctggtcgcacccatggcaattaaggaccggttcacgggaaaccctgggagacttaccgtgcttaccacaagcgggagtgggtaactgctcggtctgaagtatagctcgactctttcctaggcaccggtggcgagggtgggcgtgatggagttgggtcggccggggtgtccggttgtccagctaccggattcaccgcggcgcaagaggggaccacccactacccgttgggggtgggggtgaaaccttagcatggtgtggatggttaggggagggttatgtggagggtcttgtcacaatttccccctttgtagtatcatggtgatattttggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagtttaatgaactggtgtagttcaggtggttggttgggcctgttgcaacgtggtgtagcgttagacagtgattggttaatattgattaattactacaattgttttaccgctttcaactactgtttttaaatgcctgctttattgcaaatgaaccctagcctcctttggttatatcctgcatcatacctcctcttccagtatgattggatgagtacagtgg

SEQ ID NO: 90364 - DNA, 1059 bp, Oryza sativa
cacgttgcacctgcttccggcggagtggaggttggtatgacccatcccatcggaggctcattcggacagcagccattgcaaatctccgcccattaatgagggaggacagggttatcccggtgtcaggcgaaggtacgagccaagttttggtcaaagtaggatgggtccccacccaaaagaagggtaggtagaaatggtgtatgtggtatccccttgagatataaaaggaggaccatgcctaccaagaggggggactggagaaaagaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcccgcgcggtctcccggtgaggagccccacgctccgtcaatgtcctatacggaaacaacctacggatataggagggagttccggataaggaaagacaaccagagttctacatggaaacgacaaggactactcggattgtatccatattgatttccctagttctacttggacaaggggacacctatgggtataaatacaagcctccctaggaggacagggggacacacacgcccaccacgagacaatcaactcccaacacaatcaacatagaagcctacatacaccaagacaagccgccggatatcgacatcagagatacgcctggatcgaccctatctggtaccttcagaggccggccgtagggatctagcactgtctctgattccgtcgggtgcgagctcgaggaggaaggctaccctgttgtcgactacgagtcagaccttcagaccgccatgtcgacaacagttagataggctaccctacatattgtactggtgtgattatggtgaataaaaagcaacatcggctccggccaacaggatgtagggctattacctgatagctcaggg

SEQ ID NO: 90365 - DNA, 2244 bp, Oryza sativa
tggactctccgacaacaagctactcgatgacttcggctgtgaggagatctaacccaactgaagtacatcttccgaccagatcggaaccatcatcgtcatcgacaacttggtctatcgagatcatccaagcctcaagatacgcggcgtaccaaaatatgtcagatcatattatgtccaacgagtacacaataaggtaattggtagattggtttttcaaattgatctactaatttcgtagatacagccggcatgtatctacaaaggtacgcaatattttatatgcaatttatcgtacctattcagatcatacaatattgtcagatctataatttattatgtttacctagagcatgttttttatacaatatctattgcgcggatgtttccgacgttaaaccaactacggtctaacgctgggggctcgctctgttctcttctgtataaatcatgcttgtttacggtttacataatgcctgatatttaatctgctcgttatatcctgataatactagaagatccacgcagtttttgagtacatactcgatatcccctgctatatatcttgtcttctagaaaataattttcagaaacaattgagcactcgagtaggttgtagtcgagtacaccgcattatcgagaacgatctcgacaaatgcagagtcgtcgcgcccaacctaccaacgaagaccgacgacctatctcatagctccggccatcgctggactactcgagaaaagtttgttaacggataattcctcgctaacgccgtcggcttgatcacccgacatgattgcgaacggacatccggatatgctataagttgggtatgtgagtcatgctggccacataatatgcacatataataaaccaactttaacgcccctataggtaattaagagactcctactcctggttctcgaaccagtaaaatgtaatgatctctctcgcctcactttaagtggtcgagttacgactactgcctggtcctcgaccagcggcgtagcgtttctcccactacttctactttcagtggtcgagttacgactactgcctggtccccgaccagcgatgtagcgtttctccggctacttccactttaagtggtcgagttatgactactgcctggtcctcgactagcgatgtagcgtttctcccactatttccacttcaagtggtcgagttacgactactgcctagtcctcgaccagcgatgtagcgattctcccattacccctacttcaacaaagttgatgtcaggtacacaagatcgccaagggttttacccagagatcccttacccagatgacacctagcgctgaaacctatcctactgtccctttacgccgtcttgacaaggcctccgaggaacctaagggatcttcggctggggacgcctagagccgataaggccttgtcggatcctgtagagacgaaagaccatgtaagatctggtcatgtaagagttctcgccgtgcgtattaaccaagccgtgtaatcggaaattaactttccaacttcacggctgggggctaggatcagtgcttattcaaccaacgcaggtcaagggtccaagagccttatccttcgagaacgattctccgacgacaaggctgggggctagggagagtgtatgactctacaaattgactgatcgaagtcggtaagagagaagacgctcatacacaaaacattggtctgtaaatttatttcatttttagtttccatatatattataacatgtcaccctttgagcgttcgctcgggggctatttctatctgatattcttttttgagtgttgatttcaggaaaattctattcgacattgacgaagactccatgtctctatggttctacaccaagatcgactaaggcgagtacgacaaatgttgacaaggctccgtcgtagattctgcgccttctcaatcactcgagaacggttggtgaatctcgataaggaatacggaatgaagagatggtgtacccgccgagataaaatttcttgacttcaatccaaattttctattacagcaagacaggagacttagtcgtacgctctatactttctcggtcgacatcagagattgacttagacaaaccctttcggtgcccgcacgaggctgacaaaggaagtctaacgttatctctgaactcaccgaaaacgttcacatgagctcgataatagttattccaaagtctgcgcgtgattgagaatatgaattcgttcatttgcattaaagtcaggg

SEQ ID NO: 90366 - DNA, 1263 bp, Oryza sativa
ttgtttgtactttaactaaatttttattccttctaatatatccggcaaatctccagccatcttaagtttcaaaaaaagaatgccaggcaacccaaaaaaccgatccgattaaaccaagcaaacccacccctacgtgatactatcatatacccctgataatttcacaaaactatttgtgcagttgtgctccttagcgtgggagatgctgtgattagcggtagcggccggcaaggcccaaacaacattgtctcccttgagtagcctggcagcaatcgaatatagtataagtatatgctctctccgtttcacaatgtaaatcattctaacattttccacatttatattgatgttaatgaatttagacatatgaatgtgggaaatactagaataacttatattgtgagacagagaaagtagtatacatgaacccactacagaatcatgaacattaaatccaattgcgatcaacatcttgacaaattgttcaccacacaaaagtaaatcaacacaatgatttcacacagtaatagacccgatatatggagaaaagtacctaactttgttttcctgtcatcagatggaatggatcactactagaaaaaaagatttttccaggcggcccaaaaccattttcacaggaggggaagaggatcgccgctaccatctcgactgtgaaattaaaccattttcgcaagcgcgcccgtggcccgccagcgaaaatcatcccaggaaaataaaaaaaaccacggggcaccgccggccagggctcccctccacccgtcgtcgtcggcgccgtcgtcgtcgtcatcgtcaccgtcatcgtcgttgtcggcgcggcggcggagggggcgaggagatgaagcggctggtagaggcggcgaggagggaagccggcggcgcacggatctggagccgtcgtcgtcgctcgtcgtggccggcagcggagggatgcggcggcgcgcggacgttgtcgtgaagggagccagtggcgcggacgtgggagaggagggagccggcaacgcgcggatctggagccgtcgtcgtcgctcgtcatggccagcgacggagggatgcggcagcgcgcggacgtcgtcgtggagggagccgacagcctggacgtgggagaggagtgagccggcggcgcgcggatctggagcggagggagccgtcggaggcgtcgcggttgtcgtcatcgtcgaggagggaggccgccggtggcgaggagggatgcggcggcgcacggacgtcgtgtggagggagccg

SEQ ID NO: 90367 - DNA, 1463 bp, Oryza sativa
acccggataaggataatcggaacatcctaactctcaaggcgtccacagccgatgcttcaccacactgagcaaggtatcggctgatgtgctcataattaagttgacacaccctcttgccctgagaacttggagaaatcagggattttaaaccgattaggaaggggaaccctttcaaaccacttgggataagactgccgatacaaactcccagtctcttttggtctaagcccaaattgctccctcattacatcagcaatgacatcagcccatggtcgttgctgagctgctccttgtggttgctgctgcatgggctcgaactgaccaaactgaggagtgaactgttgctgggccgatcccgctggttgatattgggcttgcggggatggaagctgacaatgatagctcaagtttccccctggtagttatgtagattcggctgaatgttgcgcaccaagtgctcaggaaccatctgaggtaccacggtgccatccggttgtgcatgatgaaccaaatgctctgggataacttgattcacaaactgctgcgcaggttgccccccatgtactgcaaatctagccgatgcattggccggccccaggcgctaaatcggctgaacgacctgcagtcgtaccggagtctgctggatcagctgaggtcgttgccttggcggtgtttgctggattggttggagatgctgctgcgttgatggtgcttgctgaactggctgcacgacctgttactggatcggctgtaccactggctgaattggtggtgtctgctgagctggctgcgcgacctgttattggatcggctgtacaaccggctaaattgatgacatctgttggatcggctgctgctgcactagatcaacaattggtggtggtggaaaaaacatagcagcaacctgatcttgagtcggctgattcgaggtttgtccagcaagctgtggatgttccctcattagcaatcgagggttgatcggctgagctgacgccgtggccgatgtagcaggtaagggcgttgatgctggcgctgttggttgagtcgtggatgcgacagatggagccgcctgcacaactggctgagcatcggtgatcaaagttcgataattcagaaaaacgccttcttgcaagtacaccgggcctgtagcctgatgctcagctatcgagccatcggctatcgttttcatcatgttcgacagtgtattgactaagacctcggattgattgatcaaagcatgatgcaccgcgtaatcaacccgatcttgaaagttgttgaaaaaatcttgtgctagctcaatattctgattaagatttcctccttgcggcccttgagcagaatcacctggagctccgtgcacttcttgagggttatcgccttgatttcctatagaaccaccgatagcacccttgttgctcggctgattcgagccatctggggcttgtttcacttctccatcctta

SEQ ID NO: 90368 - DNA, 1669 bp, Oryza sativa
atagtgaacttcaaactatcattgaaaatgcttaaaaaatacctattatcatgatattaatcttaaagtacttcatgattggattgcaacctgttctttgccaacgccaatagaattatgatatggatgaaccattctttgtaatggagctgaagttacattcttgcatttcagcttcaaaattcacactggcgctgggctaatcattcctgaaatacaaaatgatggcaaggtaaatgccttttagttttttagttattgtttacttttaagcatgataatgccttttgaatttgaaggtataaaccactgtagtttgccattcacctccctcaatcgattttatttatatatctgccattatatggtttttgtttcttggtctgtataacctgcctgggcttgtatgcttcttgcaatttactagcaacatgatactttataccattatgaaggactcgcacaattgttcatagattcatttaaatacagaaaaacctcatgaagtcatacagtttacatttctgtacttctagttgccattttgttcttatgacttcaacttatatttcagtaagtatgccataacaactttcttaagtcatatggcaagcatgtcgtactgatggtttcagtctagcatactgttctagctcttgcaattttattggatgtgttaaaaggaaatatgttggcctgagctttcttagctccagtagtcttgataatacacctatcctgtcaagcgtaagccattaattgactgattcattcttgttgaatgtgattcccaaaaagtatgaaattattttattgatagatccacttgcatttatcttgttcacaggtaaaggttgatatgggccagcccattctctctggaccagatattccaacaaaactgccatccaccaagaatgaagccgttgtccaagctgatttggcagttgatggctcaacatggcaagtaacctgtgttagcatgggcaatccacattgtgtcacatttggcacaaaggagctcaaggtaattgacttgcaagttcatattctcgtagttttaaattacattctgtcaaaaccgttaatatgcctaaatatttcctatacaaatatgttaaattgttgcctattgattcatgtggatcttgcaattattcatttatggggatatcatggcttattaaaacatttcaatattttttatgtttccatacaggagtgcttgcttaggcccaaggtctacagtctagaactccagatcaatttaacgtgttttaatcctattatcttttgtttagtttttagttaaattaactgctgatcctaccagttggctttgtgatccacttgttcattaccacaagatttgctaatattgttgctttcacttccaataaatgtttgcactttctatgttatatacttcatgcaagcttgagaaatgtctctagatgcttcaatacgtgattgcctctgtttattggcccatatgttctgatatagccaacaagatccccctagcaaccataaatatttttttctgctagtgattaggttcctgtgttgtttgaactgtatatatcctagcctatccaggtccaggctgtccatataataatttattgttgtcttggctggaaaaacaggttttgcatgttgatgattt

SEQ ID NO: 90369 - DNA, 1086 bp, Oryza sativa
tgtgatacttggtagaccataagttggaaacaagaaaaatcttatttgtttattatgcaggaccttccaaacatagttacatggtatatgcattagaacaaaattattgcggcagaattatgttgctgaaacttattaattttgtgattgtgtaaagttggagcagtcataacacttgataggtaatgaatagaataacatatactgaataactatttgttgatgttcgtgcaatgcaaatcagaggacctgtacaaataaatatgtgaaatatttttggtgttattgtcccatgtcttctagtgataaattaatcctcaaagtttgtttatcttgtacttgatctccctccttttcagggcattagagtgttcctttttattcacaaatccttcaaatctaccataccatacctgaaattcacttattagcacctgaatttggaataatgtggatgatttatgggaattagatcttcctttttttccttttttttctagacctcttttgattcgctcccataatgcataatcttctttagtatcttgaagctttgagagcctgcaccagagctttttgtctgctcttatccaatagttgatggcttgatccacaataataccctgctattctgtactacatcatttctctctaatctgtgttaatgtcaactgcaggattgtttcactcccggctaacctggacttcatgatcttcaaccaccgcggaagggcgctaccttcagacccagacttgaagctgaagacatgattgaacatttacagtttctgttatttaccacagtaggatgatccatccagttattttttttgtgtcactcattgttgagggggagaaacatttccaagaacttaacgtctactatgtgtaactcaagtttttgtgtcacctgaattctatatctgtataccactcaatcttgtgccagtccatgtgaattaccagttattcattcactagcttgtgagagatattgcgatgcatggctctccatgtacacacatcacaattgtagtgttgtggagttcgcaaaaacacatccatttcagcactcaccagtcacca

SEQ ID NO: 90370 - DNA, 679 bp, Oryza sativa
gccctttacaatgatgtgaatggtaatttcttagcttgttgtgagatggttgcagaatttgacttggtaatgcaagaccaccttaggcacattcaaaacaaagagctgcaatatcattatcttagtcataaaattcaaaatgagttgagttctcttatggcttctagcattacaagctccatcataaagattgttaaagcgagcaaatatttctcggttatccttgactgtaccccagatgtgagtcaccaagaacaaatgagtttgttggttcgatgtgttcatatgtctgatgggaaaataaaagttggggagtactttattggtttcttgaaggtggatgacacatctggctcgggtcttttcaatgtattagttgactccatcaagtcatttggcttaatgttgatgatattagaggtcaaggttacgacgatggctctaatatgaaaggaaaacataagggggtacaaaagcgtttgcttgatataaatccaagagctttgtatatgccatgtgcttgctatggtcttaatctcactctttgtgatatggctaaatcatgcagaaaagctatttcattttttggaattgtgcagaggatatatgtattattttcaagttctaccaaaagatggaatgttttgcttgaccatgttaaagatttgactgcgaaatc

SEQ ID NO: 90371 - DNA, 640 bp, Oryza sativa
ccatgtgcattgattctaccttacagcatatagaaggtatggtgagttactttcagagctatagaaataatgggtttgctgatagtctggttgcagccacagaaattgcacttgaaatgggagtagagccatccttcccagtagagcgtcagtctcaaaggaagaaacaatttgatgaaactgagtacaatgaagctattttgcaagctgagaaggattttgaagtcaattattttttagttatggttgatatggcaattagttcattgaaaagcagatttcaagaactccagtcattcaatggaatattcggatttctaatgaattcaacatccttgaagtcattggatgcagctgatctaaaagaccaatgcactaaatttgcacaaactttctctttggatggttcctcggatgttgatataaatgacctaatttctgaattaggtgttatacagtttactttgccagataggccaatgtctgctatggagatttttgaatttgtcacagaagcggattgttatcctaatatttccatcgcttatcggatcctattcactatgcctgttactgtggcctcagctgaaataaccttttcaaagttgaaattattgaagaattatttgaggtctgtaat

SEQ ID NO: 90372 - DNA, 1082 bp, Oryza sativa
tgacaggtgggcccgtggttcatcggccccagatgtcagtgacaaaggcacgtacctttgaaggtagaggagcctcctgatcccccctcccacccgcacgccctcgccgccatgtcgtccgccaccgccgccgccaccgccaccatcgccgccgccgccgcgaagctcgccgccacccccgcccccgccccctcccggcgccgcctcacgctccgcgggaaccccaccgcgcgccgctgcgtcgccgcgatggccgtgtccacccccaggtcggccgccgccgccgcgttcctcgagcgccgcgagtcggagcgcgccctccacttcgtcaagtaccagggccttgggaacgacttcatcatggtgcgacgccttactagcgcttccatttcacttttcttagaaccgatttgttgcttcccttcaatttttttaatcccctttgtaatcagtcgcttcgtctgcacgaattagagcagtctctgctgctttagacgcggtgatttctgtatttttttgatttagtcttggattttttttcttcaggtggacaatagggattcggccgtgccgaaggtgacgccggaggaggcggcgaagctgtgcgacaggaacttcggcgtcggcgccgacggtgtgatcttcgtcatgccgggggtcaatggcgcggactacaccatgaggatcttcaactcggacggcagtgagccggaggtgagcaatccattgcatttctgcagtgcgtgataggaaatgtattcgggtgttggtgttttgtgatatccgtagtgattcgtcaatcataaatgcaatgtggatgatatggactaatctaatgttagcatgatcctcattaggtaggatagtggaaagaaagcgcaaaagctttgcacgttctcaacttctcataaagtttcttgtgtccctgaattgttaggcggggatacttagcctgaaaattaactgtgcaagtgtgtactagctgcttatagctctccatgtagattaggccttgtactagtttaatccacactcagaataggtcatagggaacttaagtgaaatctgctggtactctatac

SEQ ID NO: 90373 - DNA, 665 bp, Oryza sativa
ccaagctaaatcaaccaattagggagagaatctgttatgctggtcaaagcctcaaaggcatgtgcagaaactgaagagcacatggaagctaatggggatgtccccgaattctggctccagcggttctgatgttttgtcattggtgcaactgaatgttcttgtccttaagtcaaaagaattgaagtgcacaacaatatgaatgcctacttgcaaattggacagtatctgaattacttttttgttagccgaattcattccagacagttgacacttgcacatgtaagctcacatttctgttttcgatgcaggggcttgttgacgagttccgcatccctgagagggagaacagaaaggcattagagtttgtttcatcatggaggttcgccaacggaatgtttgctatcgtcttgtcgtttggccttttgctcactgcactgcggagcaggaaggctcgatcatggcgctatggaacaggtatgtgtatggaactgttgctaaccctgcataactgcagatgctatgagaacttatttactccaatctctatattttgtgttgcttatgaatcttcagcacttcagttggtccagttctgaatccctcatgacacatgaattctacctaggttggctccgtggcttcatcgccgactatggtgtcccact

SEQ ID NO: 90374 - DNA, 6597 bp, Oryza sativa
gcaattaaaatcatctctttgctaggtcattacacctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcatatgacgtggacctaacttaaaatgtatagctcaaagacaacggttagtccacaattagtgcttgtcattaattatcaaaattaacaccgggggcctagatgcttcaatctccccctttttggtaattgatgacaaacaccacaaatatatataatcaaacatagagcacatggacatatattgtattgacaagcaaaagctccccctaaacatatgcataacaatcacaaatagcaaatatgaagccaatgcacaattcaatttcacatttcaacatatcacaaacacaagagcaatatctcaatgtgaacttcaagaaatattcattcatgagcataagatggtcacaaatatatcaatgtcacaccaaccatccatcatagcacaagttcacattaagaccacataaagggctcacaaataaatataggctattataagaccacgaagggtccaaatgacatagagaacaacaaaacgaaaaaggaacacacaatatagagtaatagcccatacccataccaaatatagcccaatcctccttaacctattaaatatgaggtgactaacctcactactactagacccaacccacaaaacataaaacacgctattctcccccttttgacatcaagcaccaaaaaggtcttcactcttgtggaggaaaaggaggacgcgccgaagtggaaggatgagaagcatcacggcggcgatgatagacaaaagcttgggtactctccaaggtttggacgcgagaatccaatacacccaccctagtatacaatcttcccaccgaagtattcaagttgccaacatcggtgcgcaagccacgaacatcctcatgcaatgcttcatgcccggtggataagtgttgaatgctttcacttagggtattaatagccccaaggaccgggttgaagaagtcatttggttgcattccaaagtaggcatattgaggatggaataaagtacttggatcatacccttgaggaggagggggggctgcacttgagcttgcaccttgatcaaaagttggttggctcacacgaggagctctaggggaggagagttggagacgaggcttgtactccttatgttcttttaaattgtgaccaatttgtcccaacttgctttgaatcaacctcattatgtagggagcataatagattccttgtccaatagtcccctttgagatggtaatctccttcatcataaagttgataacatcaaaccgacgaccatccataatggcatcaataacatgccaagcaactccgcgtatgtcatcattgttgccgcatcttgggaggatggtggcccttactatgcggttgatcacacttgggagagcccttaaacccgccacctttccatatgtgtgccttcccccttcttcataaaactgagaaaagtgatcaatggggaagggattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaacggtccggaacatctcttgcacattctcaaactccggtgtctcaccaatgtgcctccaagagatccatttgtgttcggtgaaggctttcttggcatacacttgtacatacacggacttttggaaccgtgtatgaaatcttggatcattacaatcgttaggcctccgaaattgatcatgatgatggaggatagcgtattgttgagcattcctcaaattaagcacaaattggatggaggaatcgaaaggactcccatcatcacttgcctcatcatcttcaccatttccactctcattgtcatcaccatcatcacttacttccatctcatcaccctcaacattttccatattgtcctcatcactttgaacatactcatctccgcttgattcctcattctcactaacgggatcgggcgtgggcgcacgacgaccatgccgagtgcggggaggcatagctgaaaaacaaggagcaaaggatggatgagcaacaattttagaaaccacatagtgaagtgggaggaagggcgagtgctgcctgtcaggggcggtcagaccgagagccacggccggtcagaccgacggctcaaggccggtcagaccgccggccctcggccggtcagaccgcgtccggtcagaccgccactgacacgagcacacccaaatccttccacaatccacacaaatgattctaaaaattgctagaacagtgttgcacaagattggaactagaacatcaaggtgtaggtctattgaagcaatggggaaactacccttaaccctaaagattgaaatagaccgatttgagagcaatgcacaagaggaagagggatttaccggttaaaggagttgaatcacaccaagaaactaccctctattggtgcaaatcgatgaacacctcttccttcacctagggttccatgccatggatcacaaactcaataagaactcaaatcaatctatggaatagagagaggaagaggaggagattcacttacggtgtaaccggagtgattttgacggttgaaccggatggatttggtggagggaggtggctagggtttgggagaggagagaggaggagttttttcgagttggagaagagaagagatgagatgggatgaggaggggtcgggtagaaggaggaggaggaagaaaggacaaagtcctgggcccaccatccctggccggtcagaccggctatacgcggccggtcagaccgccaggatgcagccggtcagaccggtccctagaggccggtcagaccgccgccaccaggccggtcagaccgcgcatatagcgccggtcagaccgcctggccccccagccgactgtgcacagcccttgcacagttcggctacccccacacaataaaattcaacaaaaatttgatttttggagcaattttgaaatgtgtgagttgaaatattgccaaccattcataatatttgaaatttatgaagatttgcaacaaaactcacttgagtgctaggaggtgaccatttatggtctataggggtttttgggcgaatttgattttcaaacaacttttgaaatatttggattttgaatatgatttgaataccaaaaacatttcaaatcctcctctctaccaactttgttttgaaacttttctcagattccttctcaaactcattttggggtttaatctcattttggccaaaaacaagaatctagattcttcaaaagagagccaaaatagtatttttcattcaaaaatcatttttctagcaatgtgaggcttggaaaacatatagggacccttttgaaacattttccaagagatagttttcaaatttcattgattttgcaaaagttttgacttatgttgacttgggcattttaaaaacactactagcacttttagttgatttgcttacatataaaaggaagtagagcacatgcaagagtccaaaactcccccttaatgtgacatgctccattttcgcaatgaagaaccaaatggcaataagtccaaagcataagagcaaataggagcaaatatacaatatgcaaaagaagcaaccatggtgcaccatctcaagccacattagagaagtctatgacatttaactcattcctcaacttgtaaaagcgggtttcatcaagaggcttggtaaaaatgtcggctagttgatcctcggttcttatgtgactaatgactatgtcacacttggtaacatggtctcttaggaagtgatggcgaatgtcaatatgcttggttctagaatgttggaccgggttattggctatttttatggcactatcattgtcacataggagtggggttttggtgaaggatataccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccgacataattcgaatcggaatagccaacaagcttaaatttagcaccttttgggtaccacaaccaaatagtagaggaatgctttaaatatcttagaatccttttcacggccactaagtgacactccttaggaacggcttgaaaccgtgcacacatgcaaacactaaacatgatatccggcctagatgcggtaaggtaaagcaagctaccaatcatggaacgataaagctttaaatctaccggtttacctccctcatcaaggtcgagatgcccgttggttgccataggtgtcttgatgggcctcgcatcctccaagccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttgcaaaatacctcattagtaaaaccgaatatgatgtcatcaacataaatttgacacacaaagaaatcatcaccaatgatttttgtgaaaagagtggtgtcaacttttccaattttgaaatcctttgacaaaagaaaatctctcaatctttcataccaagcctaggagcttgttttaaaccataaagagcttttgagagtttgtaaacatggttaggatttttaggatcttcaaaaccgggaggttgttcaacaaagacaagttaggcaatttcaccatttagaaaagcacttttcacatccatttgaaatagttttatatcaaagcatgatgcaaatgcaagaaggatgcgaatagcctcaagtcttgccacgggggcaaaagtttcaccaaagtccaaaccttcaacttgtgtgaaaccttgcgccaccaaccttgccttgtttctcaccaccaatccgttctcatcttgtttgttcctaaagatccattttgtccctatgacattgtggtctctaggtctttcaaccaaagtcaacaccttgtttcttgcaaagttgttgagctcttcatgcatagcattcatccaatccggatcacaaagagcttcatctacatgttttggctcaagacaagaaacaaacgagtaatgttcacaaattgaagcgacatgagatcgagtttgaacacccttactaatgtcacccaacacttggtcaattgggtgatccttggaaagagcggtgtgtattcttggaggcataggtggatcttgtgccttctcctcttccacttcaacttgagcttgacttgacgaggcggaagtagatggctcatcatccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacctggtatgccttgctatttgaggcataacctagaagaaacccttcatcacaccgactttcaaatttggttagtctaacaccctttcggtaaatataacacttgcaaccaaaaactcgaaaataggcgacatttggcttcctcacaacaattagctcataggaagtctttttcaagagacgatgcaaataaagcctattggttgcatggcaagcggtgtttatggcttccgcccaaaaggaatcggaaacaccatattcatctagcatagtccttgccatctcaatcaatgtacgatttttcctttccactacaccattttgttgaggtgagtaggtagcggaaagttcgtgtttgataccaagatcatcacaatagtcctcgatattggtattcttaaattcggaaccattgtcacttctaattttcacaagagtgcaactaaattcattttgggccctttttgcaaactttttgaaaagctcggcaacaatagacttatcatgcaaaaaaaacacccaagtatagcgagaataatcatcaacaatcacaagacaatgactattaccaccaatgctcttataggttgttggtccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgaggggctgcaggaatt

SEQ ID NO: 90375 - DNA, 2884 bp, Oryza sativa
aatctcgcggtttacgtccaagtccaacagatcactagctacactgaatatctggactctgaacatgaacagggtataaaacggaagatgatagaacctcacgcatcatgtaaaatagcagcaatgcatttatcatattatatatgtagctacaaactacatatagcaagctataagtatgtacagcaatgatggcaggtaatattgccatatcaattttcctgctatggtatgtacaccagagaacgagaacaatttagatgatttgggatggtggagcatctgaaataatgcacagttcttcagacttcacctacggttcaagcactactgcccccaatcgatcatcaaactacaggggcaagagaaaaagataacttgggtatattgcaggagctgagaatatttgctaagttttcttcacctatgatttaagcactaaaacccctatgggtggaactccaggggttggagggaatgctggtgcaagcctgcgcagcaacctttgccatcgcttcagcagagatgccagcattgcagatgtttgcaaaggaacgcatatgcttcattccatactgcgctagcgagccgcattgtgcttcgaaagtgcgtacctgaagaaaatgcagacccatattaggtgtgctggtacaaaatagattatcacatactaactgctgaaaatgcgagatagcacctatatattcactagttaagagctgaaataggtatgaaactgaagcaactgtctagagcatccaaaacgtgaaactgaacagtttatatgacaagccgaaagtcaaataaaggcttaccatagacttgagacaactccagtcataacaagaggttcgccagttgcacgaacagcctttagaacccttgggccttcctcagagccaaagagaaggtttccgatcagctcaacactgttgtcaacatgagatctgtgtgccatcatttcaagcaattgcttccgagcttcgtttttctcaggagaactctcaggcaatttgcggtactgcacacagtataaaaggaaatcaatcagctggtttattcatggaatgacaaaacacatactgcaacaacaatcaaggtcagtagattcctcatgatatgcagaccttctgccagaagtaaaccaggtcagcatcccgctgattaacagcccttgagaacgatggcaacgagttatcttccacaaatgtagcattgtcgttagccggattggaacccatgtacatgaacacatgatgggcattcagctctaaagaaccgtattccatcacatgtgacccagagtaatatgtgtgctgcacagatgtcctttccttgacctgctcagccattgagctacattaggcacatggtaacacgactgcgagttcaaaggaattaaggtctgaaatacttacgagattgtactgctgcttgagtgattcagttctcaggttgtggacatcgctgtcaatgttcatagtaacaaaatattagcatagaaagaagcggctaaaggttcaaacaagaagttgtttggatagaacttcaaaaattaatgtaaaacatatggtcttcatggctggatccatctcaaatgtatgcacagctggtggcatactcctattagacagtggagcagaacaaacaaatcaagcctcaaatttccaaggctatcagattcatggtaaacaggtgaaatccttgtattttggctacagcctacatgacaacagtttcaaataggcctaggtaggagcattgcttccattctactaaaaaaacctcagtcaatcttcagcagtagaacgtgtggacagttttaaggtgcgccacacctgatattaacatctggtcaagctgacaagctcacagagtggcctgtggattctaatatttgctccatgttatttctattagctttcataagtcagatagggattcagcaacagtcacatgcttttcctattctttaaaaagaagctcacaacataccccactacatgttatgcaacatcataagcaaatcagcatattgtgcccagcatgtgcacacaggagtaaacaaacacatgcatatcgttagtgtcttaaattaacacaacaggtagccaagtagtgtcatactaattagaaaatcatttcaaaagaaacgcatccgtacagaatctgaaagtactaggtgatgtgggtgcagccaaaactggttccacatgagtgaaaactggtaggataaggataggattgtatcataccataatggtagaaaagacatagagataacagaaatgaagtacctgtcttccatccaagcaacgctgtacaagtcccctaggcatgtgtcgtactccggaggtgggctcgggtactccccagggcagtatgttccccagctgctctcatcagcgtttgatgcagtggtggcataaacattgatgccatttggcaatagaccctcaaagatgcttccagattcacaggcttcaaggtaaaagacctgcaaaggagataacagattcatcaaatcaattctacaactacaagcagcagcaattatatagtgcagaatagccaaataactaatctgataccaggcttttgtacgtcccagcagcatgcttcttcttcagaacatctacaagatcatcaccgtagaggtatggataggttggcatccctgaaattttggaaaaagtcaaaacaataagaccatttcttgtttcacaagcatgaatatagcgatatctgatcctattggtttcatataattgcaggcaagtactcaccaaggacaccaggacccccatggtcactgtaaaaaatgaaaatatgatcgttggggccactgtccaggactttgccactcccacctttgacagcagtt

SEQ ID NO: 90376 - DNA, 1568 bp, Oryza sativa
atatatctgtgttttccccactgtttttcttactccaatcaattggtgctttgtgtacaagctcgaaaggaacacacaaccacatcctgaactattttcgtacaatcatcttctgaatgcaggactgcagtagtgtttagaccaaaactgtttgatgtttcattagtaagaacatgtagcatatggacttttagttttcatcctttgtttgtgttattgttctcagctctcactacaaggtatagcttgtgcatgttgaattgattgatatacccagcagccattaagttaaaaagatgtctgtgaaggaaatagacatccatcttgttggttagtgttattgtactcagctctcactccaggcctgttggttagtgttattgtactcagctctcactccaggctagatcttgtgcatgttgaattgatagatattcccagcagtcatttatcagtctgtttgcgcttcctttggattatttttgcacatccttctatcaattgtttgtgcgaaagcttcaatgctctttaaacatgcttgcgccaactgcaagccagcttttgcacaccatgaattgtatatatgctgtgaaagggtagtcctcaataggtaaactggatgctatagacccatccaaaacattttcccccttccattaggatattatcctggaaaaaacaagtagtgctcggtccgaattagaaaaagcagagataacgatcattcaatatgcttgtcagtgcttcttgtgctctacttttgcagaaagttcatgtccagatacatttagttttgttgatacatctatttttgctctccatagcttgctgtgtagacttgtgtatgaggtaagacttgggtttttaccccttctattctgtttataatgcctatccagaatttataaatctgtgtaatcctttgtaccctttggttgtaggtttacatcagacgtcaagatcaagagcatctctgttgttggtggtgcagatggaacaagcccttctagaatgagagcgttagtctcagagctctatcttttctgttacttgactcatctatttgtccctctaacagaatgtaatggtacaaaatttattaagaataccttgacatatgttacaggtttatcaaccgagaaggcattgacttcaatgatgctcaaaatatgcaacctgtgcaggtgtggtttttaattttcttctcgtcttatccatgccataataagaagatatcagctgtaatttgaggtggtatttgtttgattaggaatgggagctggcagagaatttgcagggagttcttgagtaccaaacaaggtttttccatttcccgtttgttctggtctagtatgctggtcttgctaacattcatgaatcgttcagtcaaattgtaattttcaagctaaaaaagtgtgtttctgaatattgttccattaggcgggcaaaatttagtgggtatacgcaatactctggtgctaggcactctgaaattcattatatgctttcattgatggtaatgtgaaccgatactagtagagttattttgcactgacggtagtgaaatt

SEQ ID NO: 90377 - DNA, 1684 bp, Oryza sativa
attcctgcagcccgataatcggttgggacggccggagcaccatccccggggccttgatagcatcaaaggccgcgggggaaagaacgttgagagccgctcctccatctatgaggacacgccccaacttcacattgcagatggtgggggaaaccaccatcgcaatctgccctcctgggcaacgcacggtgggtggtcggtctggtcaaaggtgagggccacctccgaccaccgcgcccgacgcgtcacctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgttgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctggtcctcacgtccatgtcgaggtgacactctggacgaagaggcgccctccgttgcgcggggagtacgccggctattacgccgacgctcgatgtcgaggcgggcatccggctctccatgctgatcctcccgagtcggaggtgccgacgagggagtggcagccgaatggcgtgcaacagccgccgctcgccgcgccctccgtcttgacgacgcggaaccggtagtggcggcgccggaggtcttggtggtggcggaccgtccaccagcacccaggcgctgctgtaccgtcatgaccaagttggccacgtcgtccagccatcgc

SEQ ID NO: 90378 - DNA, 939 bp, Oryza sativa
cccataaagaaggggttggttgattcttgccagatttagagcctagagcgggggagaagtgggctcacactttgtagctcattcatacacaaatccacaaaaacacaggagtagggtattacgcttcgcagcggcccgaacctgtatacatcgccatgtctcatgtgtcttgccggcgagtaatctttccacatacagagagagcttgagatctcaccctaagcccccggccgaaccggcaaaggggggcctgcgcggtctcccggtgaggagccacgagctccgtcaggcatatatatagaaaaggtgttgaagaaattcaatatgtacatatgcagtgctacacctgctcctatagtcaaaggcgaaaagtatggggcatcacaatgtcctagaaatcagtatgagctcaatgaaataaaaataaagccatatgcgtcaactgtaggaagcctacagtacgctcaagtgtgcacacgacctgacttggcatttgttaccgggttatttggcagattgcaaagtaatccaggcctagaacactggaattagtaaagattatttgcaaagaacaaaagccttatgctgtcttacagaaaatcagaatcgctccacatagtggggtattcgaattctgactttgcaaaagataatacaaagttaacatcgggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtacta

SEQ ID NO: 90379 - DNA, 2232 bp, Oryza sativa
cccccgccccggggaggaggctgcgccggggcgtcgggttccggtcgctgaagatggtcagcgtctccatggacgagccgctccccgcggagcccgtcggcgtcgcgtacggccgcctcgccaacggcctcgcctactacgtccgctccaaccccaagccccgcatgcgcgccgccctctccctcgccgtcaaggtcgggtcagtactccctcgctcgctgcccccaacgatttcgcgagtttgctttctgatttcgcgtcgtgtgcgggcttgacgcacgcgcgcgcgcgcgcgcaggtcggtggtggaggaggaggacgagcgcggggtggcgcacatcgtcgagcacctcgccttcagcgccacgtcgcgctacaccaaccacgacatcgtcaagttcctcgagagcatcggggccgagttcggcgcctgccagaacgcgctcacctcctccgacgagaccatctacgagctgcttgtccccgtcgacaaacccggcctgctctcccaggccatatcagtcctggccgagttcagctctgaggtgagaatgtgcttcccgcttgttcacggcaatggctgtgccgtttgttcatggtttgacactggtgcgactgatgcttggtaatggtggtgaaaggttcgtgtgtcggcggaggatttggagaaagagaggggtgctgtattggaggagtataggggtggacgtaatgctactgggaggatgcaggattcccattgggcattgttgttcgaaggctccaaggtattggtcaaagtcctcgtataattgttacatcaatctcctatatgcatgaaaaaaagttatgttatgtaacttatgttcaagtctagctcaagtaatttactcctcttatgctcggttttattggtggggtaataagttgtggcttatatcttcctatcagtgttgttgtatttggaactgcaagtatctaaatggtattgcttgttaatgtcctttgtctcagtatgcagaacgcctgcctataggtactgagaaggtgatacggactgttcctcatgagactgttaggcacttttaccataagtggtaccatctaagcaacatggctgtctttgctgtaggggacttcccagatacacaggtttgtatttgctctaacttagcatgctcaaatcacaatctatctgtatgttgactttcttttgtgcatcattatttactgcaggctgttgttgaaatgataaaggagcactttggccagaaagccccaccttcatgtcctccaccagttataccagattttccagtaccatcgcatgttgaacctcggttttcatgctttgtggaatctgaagctgcaggggttggtactttatagtgcttcaaatgtgttgaatatattttgctagtgactgaatgttttcattaatacacttcttttttctgtttctcctataccccaaaacagtcagctgttgttgttagctgcaagatgcctgctgatagaattaaaacggtgacggattatcgggattctctggcagagtcaatgtttcattgtgctttgaaccaaaggctgttcaaaatatctcgcaggaatgatcctccatacttctcttgctcttcagctgcagatgctcttgtacgaccagtgaaggcatatattatgacatccagttgtcgcgaaaggggaacagtcgaggctcttgagtctatgctgcttgaggtactttaaaactttggtctctgaaggaaaaatgagaaaacgattttctagtcaatactcgtactacatttatgcaaaggtcaggttcctcaaggttacatttatttaaggagaaacatgactttgttatagcataatgacagcagatctagagtgccaccagttgattcaatgtagtacaatgaaatgtgaaattccatcacaacaatatgcaagtgcatcactcttacttgattcacatatatcttggtgtactcaatgattagcgcatcttgcgaaagcatacattttgttattgttgggaaacaaccattttctcaatcttgagatttattgggatttcaattccaagagattcagacaagttttccttttcctgtgaaagaaaaggttgctagggttcggctccatggattttctgaacgtgagatatccattgcacgtgctttaatgatgtcagatatcgagtctgcatatttggaacgtgatcagatgcagtcaacaacccttcgggat

SEQ ID NO: 90380 - DNA, 712 bp, Oryza sativa
aattcctgcagccctacagtgaaaaatagatgataataaagttaaacggaaggaaaaccatggaaagggttacttgtccattagtctttcctaagagggagttggttcagctgagagatgttgacattagttacagttgagcctatgttaattaagtatattctttccttgtgcctccaaattgtggtggaccaatcctgccttttcttattcacaacaagttgccaaaagacgtcaagatggacgaaaatttgggcattctgtccttttcaatgatgtactagctgctagtgaaatctttggtgccaaaatcttatcgtcacactgtaacatttctttagaaaggtaaccgaagaaattatagctagcatcaataattctcctgaagaatgaacatgcacggttaccttcgggaccccagcatagacatcgccaccctggggatggttgatgatgacaccaggcctcggattctccgggttgtgcgcgatgtcatcgtacatgaagacgatgatgttctcgtccttgagcccgcccctcttcatgatctggtaggcatggcagacatccgcctgcaagtttcaaaaccccaagaaacacaggacatatgttactcaagtatcaaccatgcccaatttcaagaaccatcatgctattgccagcagtaaattaccagtaattacagcaatagtaaactcaaatcatgcagaaa

SEQ ID NO: 90381 - DNA, 675 bp, Oryza sativa
caatacggactgtgtctcttttagctcggctaactctggtaaaaggctactctggcgagccttatgaactgctcctgtaccaccaaagatcagaatttttgcttggagactagcccgtaattgtctggcaactcagctgaaccggttgaagaggaagatggtgagggatggtaaatgcagcctgtgtggtgtggaagatgaggatggttttcatgccgttgtttcttgtactcgatctacagccctgcgtactgagcttcgctgtgtctgaaatttgccggatgagcaacagttgtgaaatgatggtccagactggcttctgattctgcttgatagactaagccctgaagagcgagcaaagctcctccttgtcctgtggagctcctggttcttaaggaatgacagcttgtttggttcaggttcatcgactgtccatggctctgtcttgttcttgcagagcctgtgggaatccattagtaccacaaaggtcaatcctgttactgatataaaagggaaaggcccccagatgggtactaaatctgctactacggttgcccggagtagtcccagtgatttggtgcgctgggaagcaccgccgcaaggatgggctaaaattaatgttgatggagctttcgtgcagcaaatcggagaagcaggtactggaattgtcatccg

SEQ ID NO: 90382 - DNA, 693 bp, Oryza sativa
  unsure (1)..(693): unsure at all n locations
ttcctgcagcccgaacctgtggtccgcccgcatcaagctgaaccccgataagtgtgtgtttggtgtacctgcgggcaagcttctcgggttcttggtctctgcccgaggcattgaggtcaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtattagtgcagcgttggttgtggagcgcgatgaagacaatcctcatttcgtgcacccccattctgtgctaacttggcccgggagcgagcggggaggagaggcccccgagtcagacggtggcctacggcccctgacgaccggagtcagccctctgcccgcttgtcagacggtgctaggtgcccccgaccctcaggagggcccccaagccactgcgggaaggccgcacttaacgccctttgaccccgaggctaaccctgtgctgactcgacccgggaaagagcanggagaa

SEQ ID NO: 90383 - DNA, 688 bp, Oryza sativa
tcttcaaaccatgtgcttctcaccataccgtacattcttagagccccattgctttgcactaataagccaaagcaaaagccaaaatttgatttttcaaacttaattttgaagttgattttaagatattttaaacatagtttctttttcagatggcttttaagtcgatatgaacacatatataaaagttttacctacaaattaatttttgttccctaataagccattttagcttattaagaaatatgggcaaacgatgaggacctaatcctacaatataaatatatgcatatagacatgcaggaaatgccatgtttttaagcaaaaaagagcacctaatgaaaatttcccttggccttgaggagaaactaatatatttccaggatgaggatcgccatgaacaaaaccatgtacaaaaatcatttcgccaaacagttcaattaatgctttagctacctgaatgataagcatagaaaggtaccaaaaacagagaaaaatcaattagctagtcagtgaataaaattttaatatcaagtataacaagcaaaattagaataaattaatatccttctttgttcagaacttcagattctgcaatctccttaggtaatacataaacaagtaccaattatacttccgacaagaatacacttgtacaatctgtgttatataaaaatatgtggaccaaata

SEQ ID NO: 90384 - DNA, 1738 bp, Oryza sativa
aatgtatacatgcttgatgatggaatgagatggaaagaacttccacctatgccaaagccagattcacatatagagtttgctttgggtgaatgttaacaattctcattattgctgggggaaccactgaaaagcacccaataaccaaaaaaaaggttttagttggtgaagtgtttctgttcaacttgaacacactggtacacacctttccttgctccttattttagataaaacacttaaaagtgataagaaatgatggattatgacatgaaaggtatgaaacattacctatcaactgcctgttgtttgtttcatctcgcagtggtcgcgcagatggctccccgcggggccgaaccctaaccccggctgctagggcccctccagatcactagaggttgtggacgacgacctgtacagtatacaatcaggtgattgatcgatccacctgattgttaatgatttcgtgtaagcagttgtaaacttgaaaattttgttacttttttaagaaaataattggtggtgtcaactagcaatgcagtcggttttcaatttttcttctgtatttaccagggagcaagctgttagctgttttgtgaatcacttctaatttactgtttattaatgcttgttctgtgatatatggatgctggatgcgctgagaatggaatggtacttggtacttgtcgttgtgagtgtgcgcccattgggaatgaaccctgtgctctattgggacaattttttacaaaaccgcccgcttcctcatcagtaatttcgcgaataaccccccgagcttccttaccttctcttgcatctggactcatgccgctcgtcgtccccaaaggaagcttcatctccatctccgtccggcaagacgatggtagctccaaatcaatgctatctgccaatcgactactgcttgctagacggaggccctatatagcacatacataaagctgcaatatactaatttatacgcgaataatccttaatacatcgagtatcatggattcaacatcagcagctctgaaaattgagattcttgtagcataactgatccctcccaagtcccaggtccctcaaactcgctgagagtgaatcactatattacaatcagaaaactcagttcaatctgccaatgtctgagaaccaaaaaaaatcagaaaatccaacaaaacaatttctcagagaaattgggggttctaccaagagagacacaaagctagcaagaaagattgagtcctgcctttgtgcaggtttagtcaaaaacattgaagtcccccgcaagagtgacggatttttttatggttggatttgaggactcaaggtgcatggacaggaggaaaatggataaaacggaacttgactcgtcgactagcctctccactccgtctccagtctccatggagcatggttttcgggggattagatccgccgtcgcccactggttgagagacgaggtttcggggacgattaggagcgccagcagcctcagggggttatttgcgaaatcaccagtgaaaaagcaggcggttttgtgaaaaaaatttccccattggttctaaaccttccgattaagatcctagggtgggtgcacagtcactgagtgcatgagtgccttaagatgtaccagagagcttaaccattcaaaagcaaagcaaagcaaacataaagcacttcaaaacagcacttcaaaacagagtgcaactagtctcttcttaggccagaggttctcataatatat

SEQ ID NO: 90385 - DNA, 1840 bp, Oryza sativa
tatggagtccttgcctcctgactttctcaccatacttcgaacagagtaagcaatatttttgtcagtgcataagcatgttacactgctttcgtctttacccatttttgctgcttacacttgtgatatttacttcagtggactactgaggtcaattttaggtaatctaggtgcaccacgccatgtgcgacttcttacctatgcaaaatgcgctttgtacggccttgaagaacagcccaaatcacagtcaggtgtgtttcagttaacttcatttatcgaaaatagtttagaccttatatcttagcttcaatataagtctgattctgatatctccaatatcctgagctgttctattgcatttaggctcaatcaagcgtacattcttgcaagtcaaaataaacattagctatcttcgtctgaggatacttatcggtaatttacaatggtgccactttacagtcctttttatctatccagtttgtatacatactgatctgctaattgacgtgaaaattggttatactcacatgttgatcctgaaaaattcctttgtatccttttttttcagaattagcagggtttttaatgcaaattaatgatcttaggcataagatcatgagcagattcagacgtatcctccagaacactagctgagctttctcttctgatgttacagacctcttaactcttaagtaatgttcaagtcgaccgaacaggacaggaaagagcccatcgatacttaagcatttctagagtatagttttagcatcaatcaaactgtacaattaaaacttagaacctgggatcctgatgctgatgaattgtaatcacacctcaattatatgtaaacacaaaatttgggctccgactaatactgatttgctatgaatgaagtcttcggtttcatgacaaattttcggatgacaaacaagatggaagaaaattgtcatcatactgtgtatgccatgcatggtcatctgtgtcattaactcattatgctgagtgatcctacaaaacttgcggcttagcacaagatgctgacaatgaccaagctccaaccttgcttcaaagtcatcaactttactcaagtcaaataattttattagatacagaacacagtccgtgcaggctttttcagtcaaagaataaatgggtaaagtactatagaatatgaatacatgctcatcttttgctgttctttttcttcttatttcaaagaatccaataatatctgaatgactgaaatgattttccacatttttacagttttgacaagtacgcatcaggctttgttgggaaaaggtcataagcatgtacctttcgatagtcctcccagtgaatattacgggaaagtacttagcatatttgccaacaccaaactgttcacctaactccagaattttttgagaatccaacaatatcaacgctttccacagctgacaatagtccaatctgaacttttggtctaattctttataaattccatgatcaagcagcactgcaaaaatatggatcacttaaccaactaaaaattatttaaagctcactttataaaatagaatctaatgactggaatatattaagtgtctactctcttcaaaccatgtgcttctcaccataccgtacattctcagagccccattgctttgcacaaataagccaaagcaaaagccaaaatttaaattttcaaacttaattttgaagttgattttaagatattttaaacataatttctttttcagtattggcttttaagtcgctatgaacacatatataaaagttttacctacaaattaatttttgttccttaataagccattttagcttattaagaaatatgggg

SEQ ID NO: 90386 - DNA, 2824 bp, Oryza sativa
gtttccggaccgagaagggcaagggaatcgtggctcctattgagtcggtggcgcccaagtggccgccggagagcgccgacctcgaccatgctcgccatcgctggagccgcatgagcgaggaggagcggcaagccttcctcacggtgagttttcaagatatgaagtcgcatttcctttcaagatcaggaacgtcgcggtggcagacgagacgtgcgctctcaggtgctgaggagctcgtcaacgggtgtgggtcgttttcgttcggctttgccctttctgcttcgtcatctttgtggatgctacggagttcatgtcgcacatcgacagcttccacattgcgggttgcaagaaagaattgcggtcatcaatgcctgaaagagtaactggctgtgagatggagcttctcaaatcatggagatgggagccgatgccaagcgatggagatgatttggcagagagggcattgatcttgagcaagcttaagagcattgtttcttggctcattgataaggatgccgtttctctcagccttctgtacatcatgtacaagttcatcatgagccgggtcaggccagtaaaaccttctgtggatccatgtgcggctcctgcgggattggacagttgagttctgcgcccctcaaggaactgcttgatttgcttaagtggcttccacatacccatacagactataaacaagagaaccagaaggattcgcttggtttggctacatggatggaagagtcaggcaccttgttttttgattatcggaagaatgcttcaagaaaaactgatgattctagccagccagatgaattttttgactggctattctgcgaatctttgcttgaggatcgctgtgaatcatggcttggcatgcgggaaaaatgtgttaatcttggacctgccatctttaaaaagataactgaagaattggataaactgaagctgaaatgcagctcatgtgaagaactaaaacaaaaaggaggtgtatatttccttcctaaggccatccttgagagtgatattgacatcgagccttatttttatgatggggtatcgccttcctttttactgcattctgtttgctcttcagttttgtaaacagcatcttgaacttgttgatcaatgcttaaatcctacttgctgtatttgcagattggctctgtacagactgaaatgctattaattgatgctgaggtggattaccagaagaaaaggcttttggaagcctgtaaagtggattatcttgcagccattttacctattgcaaagtcttacctttgggtcagtacagttcttctatcaccaactgatgaactcctatgcactttttctgtaactttttcttcagtgtgctatttattgttgacaggccaaattgaataataacccccctgagaaggttttacctcttcctccaccaaatggtcttcaactacaagctcctttgaatgtgattctccgggtaacttgtgtttgcctcattcatttttctatatttagctattgcctattggtttagttttctctaatttctgctgactatctgcagtctttgtggcacataaggcgattccatgatactctccagaagattccacgtgaatgtcgtgatgttacagttggagactttcaaattgagaaggaattgcttgaaatctttgattcttgggatcttgtgaaagacggcaaaccatgtgaaccaagtggttcgacgagatttgcagattttacaagttctctgataaaaaaggtccgttccattcactatttgtttccaacctatttaattgcaatctgtgacctccagcaaaagatgacacatacttttgtaaccagagtgaaccatctccatgtctcaacagtagactcttagttatgtcagataagctgtagatatgtataaagtagataaggtcctactcactatccattgttctgactccatagtccccttgagcaacacttttagccattttgtgcacctcaatctgaagttctttggagcagattagattaaaatcctttttgtccggatagaatatggcaggttaaattctgcaaattattctgtgactaatttgatccttgaataacctttatactgtccttagactagaccaggttcagttctacttccatttctgcagataggctcatagctaatgagaaaatgttttttgttttttgcagagtggaaaaatgactgcatccaaaattgtgaaaagcctttttcagaggctgcactcgtcacatactcctttgcattttgagttcaggggtgaaacttcggaactgcaaacaccaaccgagccaagtttagtgggttgtatatgcctagtgcatgatctctttgggttacacctttatgaaaataaattcaactgtctgaatatggtgcacaccaaatttgcgtactctattgaattgggcgctggaggagaaactaaggtgcacacttcacagtgtattttttttccttccttttttttatatatttagttccattagttagtaaactaacatctcttcactttttcagttcaagtctttcagcgaactcttggtagctagagagtccaggaatggaagtgttgggcagaaggttgcccagtactctcttttatgtccaccacgtttgttcatgaccggtagggttgccttctcaactgaactgacatttcaatgtaaattgtttgaatatgtttcatctatttaggagaaaaagtaaggtcagtggatgaaatcatttgatcggtatggcatatgatgttttttttttctgaaaagtgaaaactaattcaatcgttgaatataaaatata

SEQ ID NO: 90387 - DNA, 1045 bp, Oryza sativa
agtaacatataaatattagctggttctctctatgatcttcccacggtattaaacaaatacgatacccttggaatactctcgggtgaaatgatataatggtatatccgtatgcttgagaatggaatctgtaaccatatgtttctgcgctattgctgagaattatattctagtaatatcgttaagaaataccaacaatggccttaatttttctcagggttggcttcgattcctcgtccggagactagaaaaccgagtagctttcctgagggtactccaaatgtgcaattctccggctttagcttcagctgatgtcgtcggagattgttgaacatttcctctaggtcatccatcagtgtgtctcccgtctttgtcttgacgacaacatcgtcgatgtatgcctcaacgttttgtccgatctgatcaccaagagctccctggatctcgcgctaatatgtattgcccgcgctgatcaatctgaacgacatcttggaatagcagaatacaccggagggcgtgattaatgttgtcttttctcgtcctctttagccatactgatctggtggtagccggagtaagcatcgaggaaactcaacaactcgcaaccgtctgttgagtccaccagttggtctattcaggctagaggaaagtgatccttagggaacaccttgttgagatcggtgaagtccacacacattctccacttttccattggctttgcacaccatgactgggttagcgagccactctggatggagaacttctttgatgaagccagctttgagaagtttgtcgagctcttctcgtatggcctgtttccgatcgggtgcgaatctccgcagtttttgcttaattggcttggcatcgggtcgcaccatgagtttgtgctcaatcacctccctggggactcccggtatgtctgaccgttgccaagcgaacacgtctgcattgtcttagaggaatgtgatgagcttgattcctatttgctgcctagcattgccccgatcttgacggtcttgtcaaggtagaagctggttagagggacgat

SEQ ID NO: 90388 - DNA, 1629 bp, Oryza sativa
ttgttccaccaatttgattttgcctccaaaacataggaaaatttccattccagcaataaatagttatcacagagtggtgatctttttggttttaaacattttacagaaataattgtgttcctttgacaagttgtggcataactctaagatcacccagcaaaagatattacatatttgggttctgcttcagtgccatatataagatatactatcttagcaggggtatgttacaaataacctgttttgaggtggtatttctacaaatgtaatgttatttgatgcacaaattaaaaaaaaaattctggaagttttcaattgatgcaccagcattataagcagaatgagagtagagagcgcacaaaataagatgaattatgcaatgcaaggtaggacagagtgatgttaaattgaattaagacaatatgacgcaataaccttaccttgtccacatgctctagacttactgcttcaggaattattcctgtcctcagcttgatctccacataaccactacttccttgtagtgcaaagcactctccaggctggccaaaacttggctccagcattttcttagcttgttcaagcaaactattacgactaggcataaagctcttagctttcctgaaagcttccgaatgcttaaccactttacccccaccagatgctaatgcataatccaccattccaaggccatctgctgcatgcctctctatctccatctcaactatctccttggcaaataacctaatatcatccaagcttatgtcgccaacagtaccatccaaacccttctttttcttcaactgttccacaatctcatcaaattcttttttagaaacaaaacccatgtccctaagctcagcaagtgatttatctaatttgtcagtcttgccttctagtgccttcatcttaatctccagcttattacccttgtcttcgaattgcttcgtgatgtccctccttgttttgtcaatctcatttcctagcttcttgtctaaaatatccagctgtacctgaagcatcttggttgtcttcttgaacccttccactttggacagcctgctctccatatccagtgttgtaaatgataaatcaccattttgccatctccagaacagctgccccatccaagcgacagccgaaatgagaaggcaaagtttcatcaacacacttagagcgatttcccacttggccttttcttgcttagcaccactcttcttttgacggtcagcagcagctgcagaggcaattgcatcttttcttgcctccaatggatactttgatttgccaagaactgactctccacggatagtatgactaagatccttcttgtcagtgatcttatcaactgatgaggtaccattgaatccaccatcagcaaggagctcaggtgaggctttcttccttgcaacaactaccgtccgccgcctaacatcttggctggaatgtgagtccatactcaacgcgtggttcccatttgtatttgcggttggaaccgcagcagttgagactgacattgttgtcccctcaaggtacaaacgggagaactatgatgatataagctggaagcaatgatgcacctgaaattgaaaccatagcgaatactacacattcttcccgcaaaaaaaa

SEQ ID NO: 90389 - DNA, 3348 bp, Oryza sativa
ggtgaaggcaaataaagagaaacgcttccagatctagaagagaagattagggttaaggcagagatggatgggaaaggggatgtgcgtaggtacctcaccgccaccggcggcggaagcagtgggaccgctgctcgcgggttgtagatcggcgcaggcgacgggcggccgccggccgggcgaggagacgggagtcgaggcggcgaggcccaagggccaagggaacgggatttacgctgttactatactggagtagtactcttttttcttctcctctctttttacacgattcacgcgagggagaggaaacgggaaggaaggggagagacggcctgacaaggtgggttggccccacatgtaagataccaggggacatagggggtgtttagatacccaaaattttacgccatgtcacattgaacgcttgagcacttattaaatataggcgaaaaaaaactaattacacatattgcgactaatttatgagacaaatcttttaagcctaattgctctatgatttaacaatgtggtgcaacattaaacatttgccatggcggattaatgaggcttaataaattcgtctcgcggtttactgtcggattttttaattagttttttttattattctatgtttaatacatcaaatttgtgtccgtatatccaatgtaacatgccaaaatttttcacccctggatataaacacagccataggcttgtttagttgggaaaaaaaatttggccttgcagattccgtctagaaactacgagacgaatttattaaacctaattaatccgtcattagtaaatgtttactgtagcatcacattatcaagtagcatcatattatcaaatcatggcacaattaggcttaaaagatttgtctcgtaatttacacgcaatctgtgtaattggtttttttgtctatatttaatactccatacatgtgtacaaacattcgatgtgatagcgtgaaaagtttttgtgtggtaactaaacatgcccatattcagagtccacgaaatcgattggattttgaaaaaaaaaacgatgtttcgacgttgctcgacagtagctctcctctaaaattttgatggttctatgaaaatttaaatttgaatagataaaaacgaaaaaataaaagaaatcctataaatagtatggtattattagaacctgttggtatgtaacttttttaaaaaaaatgaatttcgctgatgtaaacattctccaaaaaatgttaaaaaaactatggaggtgttcgtatgctagaagctagaataaaaccccagtattaactttagaccttgtgtattggactataaacttgtaatattagactataatttatatggtaggcattccatttggccaatggttaatgagtgatgccaagatatatattgaattgtgcatgatatgtcatatgtgatctaaattattgtcttttatgaatatgtgtatatgtcaatgtgaagttatcaaatttataagaaagggaatgccaaaatttttagatttttttcaaaattttagcatttttgttctagtattttctacgtttttaggaaacaaaataaaattgaaatttctcgttgatttctcgacaaaatcgacctgttttccttacaaaccaattggtgtttttactttgcttgcacttccaattgccgatcggaatttcaaagtttccatttgaaatttttgataaagttgatcagttttcaacacaagactaaccgaaatgggaatttgaattcaatttttcccaacaaaatttgtttagaatctatcgattttctatcagattccacgaaaatcgatgtgcctccagtgtcaggcatggaaggtagtatcagaattgcaaacaccggatatattcagttaaagccaatgaataaataaaaacctttgaaaacaagacctgaaagttttgtaaagaaagaaaaataattagaagaaagaagaaaaatagcatcataatagccgtttgcaaatatttaaataattcaaatttaaatatctaaaatctagttacgtactcattttaatttcaaatcgagtgaaacttgaattaaaattcatccatgagctaagcgtagcataattggttaggtttttttttaatagaaagtcctatactttaacgtatttatggctaatatagtataggctgtatagctatacaagtcatcccactaagtgaaatggaaaaaatatactttgactccctcaactatggtccgagtatgattcatgacctccaaccataaaaccgggtatattgactcctccaactattaaaaccgatgcaaggtggttttgaaagcggttttggctgacgtagcgctcacgtggcattgttgacctagtcttcgtcccgtgtgtcatcgacgtgtcgcttatctggcacttgtaataaaaaaaaattgtgggaccgacatgtcattcacacaaaaaagaaaatagtgggacccacggacatgtgggcccacatgtcatcctcacctctcccccctctctctttcatcttttccactcctctcaccttccaacagtaaagcggggcgacacgacagcgacgacgcacgggggaggagctcgccggctgtccacgctcgggggaggagcccgccggccgtcccgcgagctcgccggccatccgtgcgcagggggaggagctcgccggccatccgagcgcgggggaggagcccgccggccgtccgcttgccgggtgaggagctcgcgggcgtccgtgcgcgggggaggagctcgccggccgtcctcctgccgggtgaagagctcgccggccgtccacgcacgggggaggagcccgctggccgtcccgcgagctcgccggcgtccgcgcgcgggggaggagctcgcctgtcgtccgcgcgccggggaggagctcgccagcgtcggcgcgcgggtgtggagctcgcttgccgtccgcgcgccgggggaggagctcgccggccgtctgcgcgcctggggtggagctcgccggccgtccgcgcgcgtggggtggagctcgctggccattcgcctgccgggggaggagctagccgtgctttaatttaggcatacgtatatctcgatcgatcgatgcatatgcatgcttgcatatgctttcactgttctggatatggtttcagtctttcagataagctaagtagctcgccgaccgtccacgcgccaccgccttcttcctcctccctcccctgactacggcttcggggaggagctcatgcttcgtgcttccgccggctgatggaaggtgagagaggaaaaaatgtgagagagagaagggggaggtaaggatgaaatgtggggtccacatgtgggtgggtt

SEQ ID NO: 90390 - DNA, 2138 bp, Oryza sativa
gaccagtggatccccctgtttaactggatgtacacagaaggtgtaaagagaaaaaaaatgaccagttagcaagccacgcagggcttgtggtcgagaatgacaactgcacatgaatgttagagtttacccttatttacttgcagcctgtgccgttttgttggtaatgacaattgcaccttgagctgtgacttttgattacaggtttttactttgtctcttgcttgatctgaggatgcaacctgcgttgtcttaaatctgatgctcgatgttgtattgcaatcaggagttctatatttctgtttcatataatgaacgaaactggcactccagcagcttgtggttttgtttgccaagtactgaaaccgaaggattcgagatgaagaaaatctctttgaatgacgatgagtaacaagctctttgaatcaatatgcatcatttgagaaaaacaagctcaatgacgatgagtaacagatcagacgaaacaaaatttagtctacctgattccctacagttttatccctgggtctgaatcttctatactgacaggaaatgatgaatacatatatgatacatgagaatccattagctctctaatccttttaatctttgttaaaacagctctccatggtctccacgaacttgggcgtgatacgatcaccagcagccagcttgtaatactcaaactttgcttcttcacactccaacgcagccttcttgcaagccctgatacttcctgaatgaagcaaatgatattgatgattagctatgctcccaggtccccatgggctatggctttgcaaacatttagcttggagaatgcaacaaacaagaataatggcggaaaagtagagcctcgatcatgctagagttaaaatgctggaaaacacaagtagttttgacaaactgtagtgttcatgccatcgtaaattaagagaatgcatttagcaatgctggtagcatatgaacttcaccttacactgaaaatcaggaatggcctgaattcagaaaatcaggactagattcatgtctcacatgttgccacaatccattctccacccactactaatcaaaatttgtactaagatgtgcagacaaagtttttgttgaaatatctaaaagcccactaattcactaattcaaggcacacactaggaataagtggtttatggtgcgaaaacacatgtgaacgaatttggcaatgatattctctaattccacttcaaaaaaactctatactgacacagtgagatgagaatatgaaattgttgctgaaatattgaatttctttttgttacaatggtcattggtagcaattgaacaacagaaccatgtggaagaaccaaatggcatgaaacaatcagctgtagacactacaaacaatacaaatgtggttcagtcacccataatccactcgctgttcaaatccattttgatacagagatgcgcatatgaagttgttgctatagtagtacaatacaatgtgcaattcaaaatcttctttaagttggtagaatcaaagaaaggaaccaggatcacatcatatttaagttgcatgaattcaggtctgacagacaatagggtggagtaaataaagcaacacagaatggtcagatagacagttttatagctgggaattgatttcgcaaactcaggtagcagatcagacggtgaaataaacttattccagaaataaaactaagactaagactactttcttcgaccatgtatataggaagtgatctactcaccactcacatcccgcagattgaatgaaactgggattttcccaatgctcctcaccatggtgatagcagcccacactttctggtgatcttcacgggaaactcggatcacgcaaagcttcgttatcggatttacatacttcactatagatgaatagagctcataaatacctctaaataaagaaaaaaaatgcaagcatctatgacgttgtcggaaaactgtaaggaggttttcgatgtaacaagcaccaaccttgcaacgacccaagacaagctgctaggccacactccccaaagttgatctggatgctgtctctgatagctttggtactattgagctgggtgagaatgagagggtcggactggtccttgcctgccgtatcgatgaatgcctcc

SEQ ID NO: 90391 - DNA, 1204 bp, Oryza sativa
ggtgggcttcgtctcccagccgcgacctcgcgctgtccgctgcaggcggccgccccatccggatgctcacgcctatgcggcggtgggggcgggggcgaagggggggtgaggctaggggtgtcggggtggagaggaagaggctcgtggtgttcgtgtccggtgggggatccaacttccgggcgatccacgatgccgctctgggtggggacgtgaatggcgttgtggttgcgttggttaccgataaaccaggtgatgacgatgacaacgacgatgctttgcttccttgagctctttgggtggcaatttgggtggaattgttgggatttattgggtattttgatgtggcttgcaggctgtggaggagcagagcatgcgaggggtaatggcataccggtcgttgtgttccctaagttgaagtctgctccagagggggtatctactgatgagctgttgaatggtctgaggttggttgcgttgatctcaggcttgggcattcgattttctagctttatagttcatctgttaggtgttaaataagtccatttgcagaaaaaaatgatcgacacaaggcaacatatgagattcttcacacttgcttttagtcttgtttgcaaaatgcatacattgttgtgtgctgacaaaaaaaaatctaatacatttgtcttgtgtgctgacaaaaaaattctaatcaatttgtctgtttttaagtatggagtaccatggttcgaagctgtcaaatgaagatgaattgatcagtacttcaaagattttagtgtttacttactgaatgtgtgtcactaccctgttggagcgtgttcttcatttgtatggcgtgtccactcagttggtcagattagcttctactgttggagtgttttgttatttcctggctgatatgctttaatgtcccactgttgattttttttaccaatagccactccatctttacttctttactgcgtgtttgtagttcccaattcacttaaatcctcttctataagactggcttgtctacttccgatattttttgttgtcacatgcaacaggtctcaagattctcagcccatccttatttcttctgtgaaacagggaactcagggtagacttcattctacttgctggctacctgaagcttataccggttgagctagttcaggcatatccaaaatccattttgaatattcacccttcactactcccggca

SEQ ID NO: 90392 - DNA, 5485 bp, Oryza sativa
ccggccggcgccttggcaagacctaaggtgcagcctgaaatgtctctatatatgtacctcactcctcaggaatgggtattatatttgcatacacgcactcggcacttttagttggagatggagaaggtgccagcaaccaagagagaggcgaaactgtgcgtggtacttgccgcgttgctgctgctgctgggcgcccccggcgtagcaacggcagatgctgtagccacatcggggagtggccgtggcggctgcacgcggagcagcggcaacatcagcatcgagtacccgttcggcatggagcccggctgctactacgtggtcggcttcaacctcacctgcgacactcgtaccacccacccaggctgttcctcggtgggtgctcgatatctccatccccaatggaacagtgcgcatcaacagcatcagaatgaggcgcctcgagaataatggccgtggcgcgaatcggacatggggtggcggcctcccaaaggcgggccattcttcctgtcggagtcggagagcagcctagtgttgatgggttgcgactcccaggtccttgtccgggagctgggaggggacaacacattggttgcctcttgtagtgccatctgcctattgtcatggccctcacaacaggaggacgcttcttaggaatttcagggaaaggtgcatgctcgagcattggttgttgtcaaataaacatcgttttaggctactcgtcctatctcatccagattcacgggatggatcaattggggatggatctgcttgcggatatctacatggtcgaccaaggattcaactatactaccgatacattctattctaattccaccgagtatcctcctcgagcattgccagccttgctgaagtgggtaatcattactctgacaagtaattgtcctagaaatttatctgccccaagtgtcgcagtgcccatagctcttgccaagacacggatgctaaggcacgggggtatcgatgcgagtgctcttatggttatcaaggcaatccatacatcatgtatgatggatgcataggtatttacattgtatatgttatgaacataggtccttaattaaactttgcattcacatggatcattgatttatataagaatcatattgaaaatcatgtgcagtcaaccatcaagtgattttatttttcatacatacttttacacaaatgaactatcagatttataggccttgtttagtttccaattttttttcaaaaacgtcacattgaatctttagacacatgcatagagcattattaaatatagatgaaaaagaaactaattgcacagttatgatggaaattacgagacgaatcttttgagcctaattagtccatgattagccataagtgctacagtaacctacatgtgctaatgacagattaattaggctcaaaagattcatctcgcggtttccagacgagttatgaaattatttttttcattcgtgtctgaaaaccctttctgacatccaatcaaacatccgatgtgacacccaaaaattttcttttcgcgaactaaacaaggccacaattaccaacatacaaaagaaatttctagaagtgaccgatgatgccagaagtggtcccatatacgtggatattttttaaaaaagggtaaattttgggcatttccttacatattttcttcaaagtatggttctatgatcgttttgcaaagatacctatagttctaatcacaattatattttccatcctagacttcttcattatctaaaaagaagatttttcccctctactgaccattacaattttgcatgtctagatatcgatgagtgtaattctcccaatatatagccatgtttcggcgaatgcaataacacacaaggaggatataactattggtgcctagatggcttaaagagcaacgctactcagccaaaaggatgcgatggtatgtagataattatatgagtgtttcaacttaacgacatgtataacaaaacaagtacttgcttagattgatacataatcgactatactagctaatcggtaaccctaatatattcgcacaaacaatttattttacatacttttgcacccacttttatttaaaagttttataaatttgttttaagcactcaagaacaaaacaatttaatttattaatagttcaaaaaaattaaaatttatatttttaaaattttatatataatccacactaccagagaaccgcacaactagataatttatcccttgatttctcaacattgttttagatctccttcctaggtgtgtaccttcaggtgtaagttttattgtttgtgtagacattgatgagtgtgcggtaacatgtagccacatcaaggagtggccgtggcggctgcatgaggagttgcggcaacatcagcatcgagtacccgttcggcgtggagcccggctgctaccatgcagtcggtttcaacctgacctgcaaccactcgtaccagctgcccaggctgttcctcgacgatggcacggtgcaggtgctcaacatctccatccccaatggaaccgtgcgaatcaacagcggccgaatcaatctcgaggacaatggccttggaagcacaaacgggacatgggggcggtggccccccaattggcgggccgttctttctgtcggagtcggagagcagactggtgttgatgggctgcaactcctaggtcgttgtctgggagctaagaggaaactaattggttgcctcttgcagtgtcatctgcccatcattgccctcacaaggacgcttcttaggaattttcaggacaagtgcgtgctcgggcattgcttgttgtcaaacaaacatcattttaggcaaaaatacacttgggtcatttcattgtcaatgtcaagatggagcaaatggggatccctttaaaaaggggatgcatcacatccaagaattctttgacatgtgacaattcactcaagagcagatatcttaccatatttatgtatttgtgtctttgcatggttatacagactcagtatatatacgagtctatggtagtttgatcatcattccaaaatttatagcttaggtctttcttagtctaacatatctcaaaactttatccaatagatttgtctcttcatggatcttccttttcagggttaagcatagctctaataatttctggtggatcaattgttcttattctggtatacttgctactcccctagtagcacggtcaagcaacgcagggttaaaaaactgaaagagaagttctttaagcaaaatcatggattgctattgcagcagctaatatcaaaaaacacaaattttggtgagcgaatgataattaccttagaggagctccagaaggccacaaacaattttgatagatctcgtcaggtcggagatggagggcatggagtcatgtttaaggggattctggacctaaacgttgtggccataaaaaaaatcaaagattatagttcaaagagaaatcggagaattcataaatgaagtcgcaatactttctcaaatcaaccatagaaacgtggtgaagctcctagggtgttgccttgagatagaagtcccattgttggtttatgaattcatttcacatgggaccctttaacatcatcttcatatcgatggtccaatctcactgtcatgggatgatcgattaagaatttcacttgaggttgctagagctttgtcctatctacactcagcttcttcaatgccaatttatcagagatattaagtcctccaatctacttcttgatgatagtttaacagcaaaggtatcggattttggggaatagatcgatctgaaataactacagttgttcagggaacaattggttgcttagatcccatgtactattatactggctgattaactgacaagaacgatgtttttagttttggagttcttcttgtggagttgcttactcaaaagaaacctgttgctgatacatttgatggagatagccttgtttcacattttgtttcactgttattagagggaaaccttattgacataataaatcctcaagtcaaggaggaggaaggtggagaagtccatgaagtagctgcactagcggcactgtgtactaaattgaaaggagaagagtggccttcaacgagagaagtacagatggcactggaaaacatattatcaaaaaagggccccttccataagggaaatagggaatcaagtagacccagtaaaaattaaatatcagctctctacatgtcaattgaaggagttgccacagaagcaagtagacaatctatggaagaggaaatgctattgtttcctcgataattatgctctggcttcagctaggacactagcaagcttgcaattgacccaataacttatgtactgacgtatatttctcttgttctgttataagtaattcctaagatattttgctttgagacaataatgcataagaaaattgcaagtcataactcaagaaattgcaatcggtttgggcttattgagtttgctttacataaccgactacttagcttcgtcctgtttcgttatctaattaatgtgattgatttactgaatcatggtgttgagggatattaggaattacagctgagcattacagtgtcactgttctaatgcaataatgcaactgcattgttctctccagtcatggacctcatggttgtgtatagtcacggatggtgactctaaaatgtagccgtcttaaatcgggaacgctaaaatgtaggtatccacaaccgcaatctgcacatataggaaagaaatgcagcttgacggtatattaaccacccgcccatcttcctctgaacatagagcgaattgagaggggaaaccaacacaagaaacaaccttagttgattcaagaatcatataacaacccaaactcaatacaaaaatgtagtatttaaaaaacaaaatggaggaagagttggcaggaaccttctgtccgagagggttctctaagaatggctgtcatttcgaccatccccttcttctatccctctcgcatactgaaattttgcaagagaacttttaaaatctctaagaaaacttcagttgcatgaaacattaacagaccaaacaagaatggaatatatgggaagcatggcaatcaaattacacattgaaaacctgtgtgatctgaccagtttttattccctctttgatcggcttggcctaaggccctgttcaatctctcgtgttggagatggatttttgttgcacgcaaaacgagaaacctcaaacctcattagcacatgatcaattaagtattaactattataaatttgaaaaattgatttatttgcttttttaaaaaaaacaacttttatatagaaacttttttgaaaagaacacaccatttaacaatttgaaaagcgtgctaacggaaaacgaagaagttgaagaatagaacagaaccaccccccccccccaaaaaaaaaaaaaagaaagaacaacacttgtgtatgcagcaaccagtatgcttccgcaa

SEQ ID NO: 90393 - DNA, 1863 bp, Oryza sativa
ggagggaggagaggaggaaggtgaagaaggagaagaggcggattaggaggttgatggagacggaggcggcgggcgaagtgggtgaggcggcggcggaggaggaggaggaggaacatgaggcggaaacggagggtgaggaagaggcggcggcggaggagcaagttccggccaaggtggttgagaaacgcaagcccaagtcggagcccaaggtgaagaaccagaagcagctgcaagtagctgaccatgcagttggatctgacgatcccgtcttgtcggaggagaggtgagtaatcggtgcttcaaaagattgtgtccttttcgtattccaattcattgtttgtattgccgcttgtatgtcatggcgattggtattgatggtgagatgccgttcttgtcaaaagataagagaaaatagcatagcgcatgtcggtctgatgtgaatgtgagcatgcaaacagtctaataggagtggtgttaattacagttattaataataaattgtttttgtgaaaatatagcatgacatgctgatttgctgtggttgtttgcgtagaaatggtctaataggcaatgtaaaaatctagtggttgttcctagattaccattattttgatttgtcatggcttgaagtataggttgttccacaattcagaataaattatgtgaccgtttgggttggttatgatcaaacaagtctgtttataaaagtatattctttaagaagcccaaccattttttaactctgacatggagctgtaaaatgattgctttggagtttagaaaggtggtttctttgtagcggaatcttcatcgaattgataagaagtgcgatggagctatttaactgcttgctgtctgtcggacttattgagattagctctgtaatggtattgcattcttgtttcagcgagaaaaatgcgaagaaggtgtatgttgggggcatcccatactattcctccgaggatgacataagaagtttctttgaagcatgtggcagcatcacatcagtggattgcatgacatttcccgagagcgggaaattcaggggcattgccattctcacgtttaaggtcagcctcaaaaccttgtttgcttccttttagcccattgtttatgttctaggaaggatgtcaactcacaaatttaacggataacttaagataattgttgatccagtaaatgtctgaatgtgcatagttttgatggtactggaagagtttgcttcaactaactacattccaatgcagtctcgcttgttttcagcactgttatagtcttgtagaaattaatgatttagtttcagaataatgtaagaaattcctctctgtggtcttgtagtaactaatatggtaacaatgcatctcgttgtcacctcatagtattgttttgaccaagtttgccgcttggtttaatttcatacaatggatcaaaaccatctagatgcaagcactgggtgctcctttaatctgttactactgccaatcatgcacatggcttgttggctgtggcaacatgctttttgccatttttccttaaacggtaatttaaacctgaccgatttttcttgttcagactgatgctgccgcacaaagggcattggctcttgatggtgcagatatgtaagcacatctgcttctgaactttacttcttccttttttgttttcaccataagcgataaccttcttgttgactacacaggggaggattttttttgaaaattcaaccatacaaatctgtccgtgaaaaggaagattttgcaccaaagatgatagagggatacaatagggtttatgttggaaacctggcatgggacataacagaggatgacttgaagaagttcttttctgattgcaaaatctcat

SEQ ID NO: 90394 - DNA, 1639 bp, Oryza sativa
cagcatgaggccttttgttccttgcaaataacgcaagactttctataccaatttccagtgctctgggcctggattactctgaaatctaccaagtaacccggtaacaaatgccaagtcaggttgtgtgcacacttgcgcatactgtaggcttcttacaactgatgcatatggctttgttttcatttcattgagctcatactgatttctaggacattgcgccccatacttttcgcctttcactataggagcaggtgtagcactgcatctgtacatgttgaatttcttcaacaccttttctatatatgccttttgagaaagtcccaatgcatactatgttctatctcggtgaatctctatgcccaaaacatatgaagcctcaccgaggtctttcatgtcaaactttgaggacaagaatttctttgtttcctgcagtagactgacatcactactagccagtagaatgtcatctacatacataattaggaaaatgaatctcccattcttaactttgaatcaatacagttgtcctcgatattctcttgaaaacccaaatttctttattgtcccatcaaacttcaagtaccactgtctcgaagcttgttctaatccataaatggatctctttagatgacatcccatatttttgtttcctttcatgacgaaacctttcagttgtgccatgtatacttttcctccaaatctccatttagaaatgtcgtttttacatccaactgatgtaattctaaatcataatgtgccaccagtgccattataattctgaaggaaactttacaagagactgaagaaaatgtctcattgtaatcaatcccttctcttttgcgtgaagccttttgccacaagtcgcactttaaacttttctatattccctctggagtcatatttggctttgtagacccatttacagcctactgttttggctcctttaggaatttcttctaaatcccagacaccatttaatttcattgatttcatttcatctttcatggcttccaaccattcagatgagcgagcgcttctcatggcttcttcatatgaggtgggatcatcctccatatgcgactcttctatattataaacttgatagtcatcacggataaccgatcttctgactctttcaggccttctaggggtctcctattctggcacattatctgtttgaggctgttgcagctcctcctctggtgtggcaataatttctgttgaatcctgtaaaacaagttcctcactttcattcattgttgccacaggagagataacaacaggtgttggtactgcaacatcatgcattgcaagcacaacattaacaggtagagagaagaaggctcttgaatcgactgagagggctcagacacccacctctcatcaagatcaatttctcgaactaccgagctccccctaatcatttcgtcttccaagaagacggcatgtctcgtttctacaaactttgtataactgtttggacagtagaaacaataaccctttgatctttcaggatagccaataaaatggcagctgactgttttggggtccaacttcccaatatttgggttaaatactttaacctctgcaggactcccccacacacggaggatccatagctcatacggtgttttgggca

SEQ ID NO: 90395 - DNA, 2207 bp, Oryza sativa
catatcatcgacgagcaatcttttccattagaagtaccatcatatccaaaactatggaagggttcatattcaaaattggagcgctacactgtggaagatgcacgtgatattgtcaggtatcaagtttatcatttgcctttcgcattctctgtatcttctttatattctattgccaagttctttcagttcacttataaaaggtgttctctgatttcacgtctgaaacttcccgactctaaagctatgctaggaaaagaggtatgcttatttccaattacatatattttctttcatctagctgggtgtagtatcgttctattttagttggaagtttgggactctcagccgcaggggattgtatgatactcatgcaattacatgtttattgaactctttgtcacagtttccctagttgttgtttgtctagaatgttattgctctacaaggaatgtgttctgattattatttacatctgttaggtatccatgtcatggctgaaattgacgtgcctggccatgcagaatcatggtgagtttgcacgtacaatttcctattctgttagatttctgcttgtgcatcagtgaggtttgtcccagttgcttttcacgtgcaacagaattatcttatgtgcaaatcaacaaataatcacatgctgtttctttgtgtcgcttagagttgcaatattatgtgattaatccaagctcttagctctagcatttcagccgttatgttacagtaattcaagtgtcactacgttccatttgatccagtgatttaattgagtacattgtatatttgtgtacataaccaagcaactgggattcagttactaccttatatgctgtagcaagcatttcagatttggttttgccctgttgttttgctctgttgtgcttattatatgaagttgacttgttatctactcagagatacttatgcaaatattaatttctgcaggggaaagggatatccaaagctctggccttctcctaagtgcagagaaccgttagatgttactagcaatttcacatttgaagttatttctggaattttgtctggttagttcctctttccttcttaagaaaaaactggctcaatttagggattggttgttactcagagacacatgccttcatattttcatttatagtcaaactcaaatattttttgttttcatggagagtggatgcaaaatcactatagtaatgaattgtgacatgtgaaataggtaaggcactatcaaaatgggtgtacttaccccttagtgctttatctactagcgctgcaccaaaatggactgatcaattcaaattttggccatgtttgattactcatcactgtaaactcaaaacacaaagggattcacatgattagtccttctgcaggacagccagtaattctatattcctatattaggttcagcattttttcggtcactttagcatgcaactgtttgacaactgggtgtctgaatcactacagcagagcaagatgtgcaaaattattagccagagtaggaccatccttctgtacaatatcttcccactaaatattcattataatgttacatgataagcagcgagccaacgacagagagtgcaagttatacagcattctgtctttcctgcaatttaaccaaattaacttcttgcccttttcagatatgagaaaaatctttccatttgggctcttccacttgggtggtgatgaagtatatacaggttagcctgcttctcttgtttaataggaggcacttcattaataagagtgtaagatgctgggatgttgcaaacttttggatttgagtgtgagccaactatcttccattaaactgatatgttagaagctagatcttttatttctaggaagaaaatcttgtctctaatactccctccagtcaaatatatttgatgttgggacttgggagagctaagtcaaatgtatttgacattgggtgagctaaacttaggtctcccaacatcagatatatttgacttgagtgagtaatacttttgccaaacaaggctcgctgtgttgtaagttacaactacaatttatgtccgctttcctttaatgttagtttaaactgtaagctatatattattatccagaatatttattcgtaatctgtgcctacttcataccaaatccagtagagtatcttgtaaccgataaatacattatgttcattgatgtgactggtgaca

SEQ ID NO: 90396 - DNA, 3012 bp, Oryza sativa
catcctgcgcaagaacgggatcacccacgtgctcaattgtgtcggcttcgtttgtcctgagtacttcaagtcggacctcgtctaccggacgctttggcttcaggacagcccgacggaggacatcaccagcatcttgtatgatgtgtttgattactttgaggacgtcagggagcagggtgggcgtgtcttcgtacattgttgccagggggtatcaaggtctacatcgctggtgatagcgtacttgatgtggagggaagggcagagctttgacgatgcgttccagcttgtgaaagctgcccgggggatcgcaaatccaaatatggggttcgcttgccagctactccagtgccagaagcgggttcatgcgattccgctatctccaaactcggttctgcggatgtaccggatggcacctcactcaccttatgcgccgctgcatttagtacccaaaatgctgaacgaaccctcacctgctgccctggactctaggggtgcattcatcgttcatgtgctctcatcgatctatgtttgggttggaatgaagtgtgatcaagtaatggagaaggatgcaagagcagcggcgttccaggtggtgaggtatgagaaggtgcaggggcatatcaaagttgtcagggaaggaagtgaggtaccagaattttgggacgccttttcaagtgcacctgttaattcagacagcaatacaaagattagcaaggatcagattgattcagcatccaagactggcccggggaaccgtagggtggaatcttatgatgctgattttgagcttgtatacaaagcaatcactgggggtgttgtgccagcattctcttcttcaggtgctggtgatgagacccatcttccagcaagagaaagtacctggagttcactaaggcgcaagttcatctctaggtcgttagctcgagtctattcagattctgctttaatcagggacttggatccgcgggtggaccgagtacaacacctggctgcagaggcatcaacatcaccacctttcctatctccgagctctttgtcatcagattcaagcatcagttcaaagtatagttcagactcaccctcactgtcaccttcaactagctcgccaacatcacttggtctttcgcccgcttcatctaatttttcccacactttggtgccatcatctaggtccccccttcaccaatcatctaacgaggaaccttcaaaatctggcctggggtcaatacgctctccctccaagacctcttctatagcagaaagaagaggagggttttcatctctgaagttaccatcattccaaaaggatctagtattaccaccaagggtaccgaccagccttcgcagagaagaggaagtcacagataagagtaataataatagtgtaaaacagcttactggtgtgtgttgcccagagaaatgcactggcaatacttcaacagtgcacactaaaactggaataactgagcgtactgacagtatctcagaggcttgcggtaatttacaactattagtctaccgttggcccagcaaggaaaagctaactactttcactcgcaaggatcttgacccaaaatcagttttgatttttgttactcctgaagacagcagaagtgaagcagttaaaacggtacacatttgggtaggaggtgaatatgagagcagcaaatgtgttgacactgttgattggcagcaagttgttggtgatttttttcatctaaaggagctcggcaatactcttcctgttaaggtgcctacacttatactatacaatatctattttgtttactctactttgcttttaaaggttcagtgctagttgaattttatgctctgtaagaggttagagaatactaaattctaactttacgaagctagttgaattttatataccgaggatactaaattctagctttactaccatctcagatagttttccaccactgccgaaactttgctagcagccacccattatttatcattgctttgagctcactgcgcacactagtctgccttgaactctttgccttttgcgcgttgcagttatggaccaaatattttagtggaatacagaaatacagaatcatatgttatgctattactgtgtagaaatattgcaaataggtgaaccattttgtggctcattgagaattatatattcagaacattttcaatttgcatagactccaaatatgtttaagtccgataattagttactggacatggactttttttctttcatttatggaccatgacttcacaatcttctcctagattattggaccatcttaggaagggaaaatggaaacatgaaagcttgactttttttttcgccggtatgtagagtgcctagtgcggtagtgccagacaactttatcagatattttatcctctggattatattatgtcatgattcatgaccatatacctctagttttgtagtatatgcccatatgaacctaacaggcatagccatgcgtatactacaaaactgatgcgcatatgaacctagcaggcataaccacgcattggttgactcttctagcgagaagcacatggtgaatccttccatatcatcttacaaatggaatctataatttctgttttctatgaggcttcacattccattccatcttcttgtgaaataatattatgtatgaactggcatggtccgtaaacttactgtagaaaaaaaaagactaatacttctcttgattatttttcatatcggtttactgtagtagcacatggaagtatggaacttaggttgatgtttcatttattgggccacaccacaattctgtgcacttctggcattcactataaatcctcataaatttggcatgaattgtgtgaaccactgaaccttgcctagaattaccttctcttacttctacttggctggtggtttctcctgtccttacaaatgtcacgaataccaatcagcatctgtggatttatgttataaagaaatgttacaaattccacacctaagtgcaatacttcttcatg

SEQ ID NO: 90397 - DNA, 537 bp, Oryza sativa
atatatgtcctgtggagtgtggttgccctgaccaaaatgaggttaccatgcacttgtacctgcaccagtttgttgctggagcaaatcacccaaaccgcaatgaagaatttgtgatagcctcgagctatcctaatggattcggtacaacactcgttgatgactggtatttaacagctacaaccaatcccaatgataatatcgttgcacgtgtacaaggcatgcatgtccaggctggccaaagcaatgctaacatgtggtacacttcccacaacattgtgttccaggatgacaggttgaaatttatgctagcataactagatgtataatttaaatttccctgctatagtgttgagtaccttattgacttaattaattgttcaattgtatgcattgtcacttctataatcttctctgatatatatgaagctttatattttttatcaaaacaggtttaagggatccacacttcaggtgatggggattattgctgcaagcagtggtgagtggtctgttattggtggaactggagaattttca

SEQ ID NO: 90398 - DNA, 655 bp, Oryza sativa
cggggctgtcccccgctcgaacccggtgacgacggtcgtcctctgtccggatccagtggcggcgggcgtccctcgcctgacctcgcacggatccaccggcggcggtgggaggagagcagcgggcggcaggccaccttgcagtcctctcctcctcttcctcctcccgcttcttcctgcgcgctgccgtcatcgtggttgtcctccaccagctcgctgcttggccgctgccgtctgccgatggacgtcgactctgacccggccgccaagggcaagcccacccagatagacctcgaggaccaggtacgccgcagccgctcgactcgtccccacgggaattcttccttcagttttctattgtgactgcctaagcttggagagcatcttaatttctgttgaaacacttcagggaagcatttagctctcagagaattcatgagacttccatctataatcctaccaaacttctggctggttcgttagttctatgtgatctggatttggtttgtgtaacactaacatccattgatattctgaaattttcaggcttctatgcatctacaggtttctgtaattgataggttaacaagcttttctaatttatttattttttggtgattgctgcttttgctggatcaagcatcatgagtgaatagtc

SEQ ID NO: 90399 - DNA, 609 bp, Oryza sativa
ggatcccccggcatcgagcttgcagctttcagcaggggaagattcagttcaggctgcaaacaaacaaaaaatatcaaatcttctgcaaattcagtctcactgaacatccaaacgtgtaagagaaaatacaaagttcgagcatttgcctgcaagtggcttggttgggactgatcagcaatagctgcatagctgaatgataaacagcaacacaaaacttttagtacattacaacatatatacacaatcaagtgtaacaagatcactgagagctaaattagtttctgaaacaagagagattactaacgcgataagcgcatcctccactgtcgcggctaagatccctggcatcccgacggtccagttaagaggaagaagcctgagatcagaaatagcccaggtcaggtgtgtctgaacaatgcacatccattgcagctatggctactttggctagtgattgatcttgtagaatgaaaagtacatatatgtggagcatgacgaacccatccttggagaaacgccctgccgtcggcttcaagcccaccacaccgcagagcgcggctggcatgcgaacagatcctgattaaaatgcacaaagaaaacaataactca

SEQ ID NO: 90400 - DNA, 1410 bp, Oryza sativa
gaaggagaagtcgaggagggcggcagcgcagcattacctagaatccaagcccgccggcgccgccggtgttaggatcaattctggcggcgacgaccacacgcggcctattaggcctgcacatttatatattgtttcctgcagatgcagttggtagtaagacaagtgctagaaatttgtcaagttaggtgccaacacctgaacttgagttcccctgcaatgaacaaggtttggtcgttgaagaactgaaatgattgacagaacagatcatcaaagggaaactggagcatcatgccatgtttgtacatggctgcaaatatgttctgttggggataactaccctaacttgaatttattttcctttcttgatgaatcctactctctcatgtcccaaacacaactttgatgtcctaaattataatgctatcaggaaagcaagtgcttttcgagccaaacctactcatagaatttccatgtatcacccatttataaacaccaatcctaaaaagttttagatgcttggctagcacatctgtccaagacaacatgggtttatggctgtacaacaaagcaccagaaaaaaaaaatcaaccattgctggttggttggccgatacagatttcagtaggtagaatgctagaatataaaagaaagagccccaaattccatggcagagagccacacaaatcaacgcacgtgcaccacggaggagtggtccttctcctggagcttggagatgacgaacatgtacaggtcgcgcacgcggcgaggcgctggtagggcacgccggccgcggtcaccgcttctgcttccttcgcgtcgagggacgtccgatgtgtgcaagcagagcgaaacgattttccccttcaatcaacgctagcagcgccaccgccgcctgccgggagtagcgataacccttttttttaggagtagcgatcggacttgatgcgagcgatcgagacagagaaatatcccatgccaaaattacccctaatctgtattaagagattactaatctaccctttaaaataaagggtcgagattaattctacttgtagtagaatactttaagtagagagcaccggatagtggactattgagtgctctgttttagattaaactttacactaccagatgacaataattaagatgagaggttgattcgcatgtttttgttttgcagtacaagaacaccaccgaagcggccgtggacgcgacgcgcatcatcctgcagcaatgcgagcgatcaaagacggtgaagcggatcatccacacggcctccgtcaccgccgcctcgccgctccgggaggacggcggcggcggtggctacaaggacttcatcaatgactgctgctggactcctctcaacttctcccaccgttacagcaatgccctgctggatgtaatcatcta

SEQ ID NO: 90401 - DNA, 4622 bp, Oryza sativa
tcttattacccaaaaaagagaatgccttccgtgtaggtgatttcagaccgataagcctaattcatttcttcgggaaactgctctccaaactactagctaacagattggccccgagactacaacagatggtatcagcaaaccaaagtgcgttcataaaaggcaagaacattcaagacaacttcctctttgtcaacaacatggtaaaagagcttcactcctcgaaaacgccggcgattttgctcaaactagatatagccaaggccttcgactcggtcagttgggcctacctcgtagatcgactaaaagcgctaggctttggtcatagatggattgactggatcatttctatcctggcgagctcttcctccaaggtgattttaaatggcagggcaggactcagcttcatgcatggtaggggccttcgacaaggcgaccccctatctccgatgcttttcattctggcaattgaccccctacaaaaactcctcgccgcggcacaggaagaagacctccttcaacctctacaccgacgaatagcaaggtttaatgtcgccttgtatgctgacgatgcagtggtcttcacacggccagacaaacaggaacttcacacggtgcacagcattctacaacatttcggccaagccacagggatgatcacaaatctaacaaaaagtgaagtctactccattagatgtgagaaccttgatctacaggacatcctagcccctttcccagcacaacaaaagaccttcccctgcacttaccttgggcttcctctgcacatcagaaaactccggaaaatggatgtacaacccttaatagacaggttctcagcgcgactaccaaaatggaaaggaaaattgctaaataagacaggtcgctcagtcctcatcaaatccactctgtcggctctaccaacctatcatctcacggttttccctcttaagaagtgggcagcgaagaaaatggacaagatccgcagaggatttctttggacaggcgccgatcaggctaatggtgggcactgcctagtgaactggaaaaaggtatgcaaaccaaaaaatttgggcggactaggtataactaacttggagttttttagccgatccttgcgtcttaggtggctctggtatgactggaaagcagatgggaaactgaaagttcaagtgccattgatttggttttgatgattaataacaaatccaattatgtgagactaatatttttataagcatttttttgcctagtctcatgtggatatgaaagtggagtgttggtggacctaaatcacaaggatgaaatgcatggagatcaagctatatgtatcactctttctcttcatatacatattgatatgtttgtatataatatttccacgtgattggcatatgcatgtgagactaatgttttgtttgagtattatctcttatttagtctatttacattgagaacgtggagatgatgaaggtatgtttttattttaatatctatatttgagaaatgtcttctattcttgtataggataagctctcaatgtttaatattttgttatgcatactcttgcttcacacaaatattttgtatgcatacatttagggggagcaaatcctatactttagttatgcatgtaattgattaaagttattcaccttcatttaattgggatctttacatttgaacatatatttgagtatatgacacttgtggtgttgattaatactcatcatttattcatatccttttatacatgcgatcggttggtcaacataaggaggttgacaaccggatcattgggactaataagtttattgagttgaatgaaagaaataggtcccaaggattacaaaagtgttgatgcttaagtgatatcattacacctaacaataccaagaatgacaaagtgaggatattgaagatgtgtgatacgaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccatgagggactatttgaagctacaagtaaccgcatcaatcatttgaagaatatatggtgaaacggtatcggcattggtctccctcaagacaatgaaagaaagataaaaaaaaaggcattcctaatagtataattatcttcttatgtacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttcgttgacttgggtagtcctctgagtgagctttccatagagtctaagttcataaaaaaacggactcccgagcgaaaagttatagtcgttttactctgtgcttttcggaaagtccgaaaaattaccggaaactccgataatttttcggacaacttcgaaaatttccggacattccgaaaatggctgcgaatctgagatttgcttctgtaagttttcgaacttgtccgaaaatgcttttcggaaactccgaaaattacagtcttggcctccaacggctagtttttgaggggctcgggtatataaactcctccacccctcctttgagttgctgctgctcttggggagtattagacacatccaaagccaaatagcatccccatttccctacctttgtggtgcctctttgtgagggggatttgagaaggggagagagttggattgagagagtgaggagttgagagctagtgagcttcactccatcctttgtggtgcctctttgtgagaaggatttgagaagggaaaagagttggattgagtgattgagaagttgagagctagtgagcttcactccatactttaagcactcgagttcatagcaagcaaatcttcgattgtgtttgttactcttggggactaaggtctcctagacggctaggcgttgccggtgagcacccaaggttgtggtgtgccacggaaagtttgtgaaggcttcgatttcgcctccgcaagggaagaaatcaagagtgaaaccgaggagtgcatttgtgcaacctcgtgagaaaagggttgaaataggcccggcccttgtggctcctcaacggagacgtaggatccgtggattcgaacttcgggaaacaaatcgcgcgtctcccctcttggtttgcccgttcttgcattctctcatattgtgcttgagcttgtttttacccgatctacttgcatgcttatttgatttagttggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctaatgtgctatgaagttgtgataatttttaggaacacctattcaccccccctctaggcgacattaaggtcctttcagaaaccatggcaaggctccaccctaccatgcgatgaaacggacaagcaactcttcagggcctctacaatcatcacactaggcaatgggggcaagacaaagttctggcacgacagatggcttgatggccaatcccccaaagatctatctccttccctatacaagcttgctatgtggaaaaacaaaacagtggcccaagaactagaaaaccacaagtggttacggccactccgaaggatgaactcgacgaccgaggttcgagaatttatcctgctctagcacttgatacaacaggtacaactggatgaagacagggaggacgatctaatgtggaaatggaatgcgaatggaatctactcagccaactcggcctacaaaattcaattcactggaagcattcaggacaatcgtgctaacttcatttggtgagcaaaaacagaaaataaatgcaagttctttggatggctcatggtccaaaagaaaattctgacgtctgacaaactccaaatccgaggttgggacaacagtccaacttgctccctctgtgggacagaaccagaaacagcgacacatctcttcatggattgccccttcgcgaaacaggtatagacaaacatttggttgaaactaggactcaacatgcctaggtcttcttccttcaatggaaacatgatggattggtgggaagcttgccggagagaaatgatcaaagagcagagaagaaattttgatggcctcttcatctacacgacatgggggatttggctacaaagaaatgctataatttttaacaatgactatggtacagtgtcacatgtggttgacttcatcatcaacatgtgcaaagccttcgatgaagcgcaaatcgcttagatgataaaacgccgacttttgctgttagtggctttgcactttctcaaagtgctgtaacctcctccagtgtaaaatctgaagacacctcttggaggtgtccatgtacgtgaaactatttctttctcctctaatgaataggtagagctcctgccattatcccctcaaa

SEQ ID NO: 90402 - DNA, 2086 bp, Oryza sativa
accctacttgtatttcatttttctaataaccaagctacgacgtaaaatctatgtcagaaaaaaaaaaccaccatcataatagtcgacggaattgttttacatgattataatagttggaggaatcgttatacccaatgttatggttaagaaatatgaatcaaattgcgaccaagttgagcgagtcggactctttccttttccctcctctttgtggcacgtattccagccccggggagcaggagcccgttggtggagcagatgcgatccacggaccacggatggatgcatgggactccgggtaattcagctcgaggcggcggggatgatgtcatgatatatattaccagagatggatcaagatcattggatcggactgttcagcagacaaggacgtagtagcacattagttacgcacgacacacttgagcaataataatactccagttcattgcccatcggtgtttcgaatagacaactgaacagctgaacaatgaatcaagagcacaatcaatagggaaactgttttaacatctcgagtggatgtggacatccacccatttattacatgtcatctaaacgtttatgaaaaaaaataaaaaaatacaaacaagatagatcaatatgtaatatatcaatccacaaacatgcaaattaaaatttaacttctacaaattgtaacacaaataacaaacataactcaaattaatatatatatatatataattaaatttgttgtttttgttacaacttgtagaagttgaatttgaacttgcatgtttgtgaggtgatatattacatattgatctatcttgttaatttttttgaaaattttttgtaactatctagttggcgtacaataaacagaacgtccactagagctactaaaatacatctcccaatcaatagtccaaatgtccaatagtaccgttattgaaatagaacacagccctacacatttggtcctggccaacaacacgtggctggtaggtctcaaagcataagtgagtatgttgccaacttggcattagtcctcacatattttttcattcggtaacaacaaattcattggcatgcgtcttatacggcatagataaacaatgtaaacaatttctatttgaaaaaaaaaagataaggtgctatacattaaagcaagcggaagactgcacaacggtatatcgttccaacgaaatagctaatgtatactaacattagcaaaacatcagcacaatatcgtagatactagatagatatcggatctgatacctcctaccagacatgatgccatataagtaccagatttggtacttaggtaccacgatgacatcggctattcattataaaggtatataccgttatgtagaatttctttaaagtaatcccatcctcttagtgtattccacgctatgatccagtgtctcatccacttcatatttgtacttgaaccccaaatccacaagtttgtttgtatccactttcaccctcacgccttcccctaccaccctacgtaatcacacgagcaaacacaatacatgttatattacttaaaaaggatcaaggagatcaatttaataatcatcaatcgagattctaaatacatactctttgagcttcatctcgatctccgggtacttagcagcaaagtgatcgacgtagtcctgcatattggggtacccggcggcgaagaggaagcggccggcgatggacggctgctccatgcagaagatgtgcgcctcgcagacgtcgtcgacgtgcaccagcggcacggagcccagcgaggcctttttgaacttgaggacgccatgggagagctcacggccggtgagcggcgacacgatcaccgggatgcatgctcagcgtgtggtagggctggatgctatcgccgccgacgagcgcgcacgccaaggtcaccacctcgaatgccggcctctccgactcgttgtaacgcagcagctccttctcggagagggtcttggatgagagatacgcctacaaacgaatcaaagtagaattcgtcgccacacagtgtccaaagtcgttttagattttactagtagttcatagaaaaacataccagcattttttaaaa

SEQ ID NO: 90403 - DNA, 4547 bp, Oryza sativa
gccgcttctgtggttcgtgctccatacttcatactcacatagatgatagatcacatgccatagaccatattcatattttggttccatgttgcagcttgacaactaatattttccttctcagaacacgaaatgtgatgcgatcatttggccaagtgaccagtcccatcttttacatgattgttgttcatatctgtggttctgagagatatcttgaaacaatagcagagtcatcagttcacacgttgcataccataatggacttgagctcaccatcagctgctccactgattgctatgccgttgtccctgacatccatcaagtatgacagtgaatcctgcgttactatctcacctgggatcagcaccgggatacctggtggataagggcagataagctcaccacaaatctcaccaaggctatcctcgatggacactctcctcttctttaaaaagaaggcctcccttggtgtcaacttgatggagaacttgtccagtgggctactagcaggattctcttttctggaactggacccattttcagagaagtatttttctgacagatgctttacagaatgtacaagcctctgaacatcatgccttctggtccctaagttgactgcaaatgtcacggcctgtgtaccgaccagctcagatacaatttgatgctcctcagctaaaaaatcatctgcttcatatccagataattgcagatctgaagcacttaatgtgatacgcaagggatcaatagcaggaaaatcagaaagaaagcttgataagtccaaaacagatattcctgggataatcctcagctgatgttttgtttctaaagccatagatactggttcatcaaaagattctgcattctcactcagctgagcccttgcggcatccaaagaagagagtagaaggtaacttgggcttgagctctggagcaattggaggcattggcttactttatctgcatccacaagatctccagccatgtgaagcattgaggactgtgtaagcgagcacagaaccttgtgtgtggattgcacaaccaagtcggcaccttgctcagttgcgctgcttggaaaatttctgtgaaacctgaaatgggcaccatgcgcctcgtcaactataacaggaatgccttgcaggtggcaaacattgacaattccttgtatattgctgcatatgccatgataggttggtgatgtaacaagaacagcacctaccttctttctgtcctcctccagttccttaaccactttatccacctgcgatggggtaatacccccagcaatgtcccacccggaattgtactcaggtactatatatttgggcacagcaccagacaaaaccagtgcagagatcactgaaatatgacaatttcgaggtatgatgaggtagtcaccaggggaacaggtagccatcactgaggcctggattccacatgtacttccattgaccaggaaccatgttttaaatgatccaaatagttcagctgctcgcttctgagcatctaaaatcacacctttaggggagaagagatcatcaagctcaggtagctcaggtaagtcatgcaaaaatgtccttgagccaataagttctgacaatgaaggaggagaagctttccctctattatgtccaggaaagtgaaagcaagaaacatcttgatttgcagttgatttcagtgcctgaatcagaggggcagtaccagctttgacaactgctgaaggttcagcatgtgaaccattagtagtagacgttcttggagtgtcccatgaagtggcacattgtactacaacatgccgcatgattgattcctacgggataacagatgcgcgtcattgcatataatagaaggaccaagaatgccatgcacttcattaatcagtgatcaaaagctgcaaagtagatagtttaacttactaaccatggcctgtgttggtaaagcagacgaaaaaaaaacaaaggcagcagccttcagacaagttaaagcttatataaaacaatgtgtatggtacaaaggagcttggctgcattgtgtgagaaattcatggaaggaagacaacaaaatcttcacatgttgcacagctaagtaatgcacatgagcatatatacattaagtgtgcttggaagggagtggtaatagactcatagcttcagcagagaacctgattttattggaatgcttggggccattttataaagcacaggttactgccgactggatcctttctaattcataaatagccattctagcaataacgaaataaataataatagatctatgggttcatcgttattagagctccgagctcatgagcaattctacaaacagcttgtgagcactccactccactacgttacccaaatacggggatacgaatacggatacacgatatgaggatacaacacgttcttaaaaacaccgatatggggatacgtctatttatatttaaaataataaaaagatatagagcgaatacatgaattttaattattaattatgtacttaataactacaagactgtgaatagagatagatagtcatatggcatgatatcaattgatcaatacaccagtagtcaaaaaatgatcaatacaccaaaatcttttagtactatctcagatcagcctataatctgtctgctatctcaggagatgaggctaaccatgaagctcctatggatattgtgctcccatgcctggtcactagtgaatctacagactgcagccacatagccgcaagcagtatccagtagtatgtatgtgctagagatgcactgccacttaagcattcaatttcagaactaactcatcgcccatcggatctaggagaagagataacacttgtactaagatgagaagggaaaacccacaagaaaatcaatcaagacttaaatggggaagaaccagatatggcgtactaatggcgttgggcctcgcggccggtgattcctgaagacgttgcgcccggtggaggagatgaaacaaccggcgactggcggagtccctatgctcagcggcagcgacgctgcgacccttggttggcgatggtggcgccgccggcggctagcggaggccctgcgcctcggggagggatgcgacggtgggtaggatgctcgaactgcgtcgggatgggaacaatagcaggcggcgctccctctcccgtgcgtgggtttggattcgattgcagggaggagtaagaggattgagctgaccttgtgtgtgctggaggcggcgccgttgcccttgttcttgggcacgccagccacggtggagcaaggggagtaggcggccaagctcaccatcccggcaccacctcctcctctccggcgaccgccgccgccgccgccgagctgaacgggctgcaggctgcagaggaggagacgcgggagataagaagatgacaaggagattagatgggaggcgactaatcggcaattatgtttgggcctcaatagctaatgaagcccagcccaacaagctggcccgactaatggtccttctgcaactattttacatgccaaacctgtgtttgtcaggtatacattttattcagaaataacgtgttttcttctttgcggattttgcatgtccaggttcagcgaaattcaggtacatcttgttcaggcttaatctatttccacacacagattttgcagtaaaacctgcatccaatttgagacaccaccagacagtaaacttcagattctgctataaatctgagaatgaagaacaagcacagtcctattttgcaaggctttcttccatcttgtaataattccaaaatttctacaactaaattacaaagtacaatttaagcttcattcattcttcagatgtcttacaagaacacgtatacaacagcagagatgccggtcgctgcatggaatttacctgacaaatctgagtacaactagctagcaaagcactataaaatgtgcccgcgtaatttggctcttcttctgatagaaattaatcaatagtaagctattctatttctactggatttgatcaggcacttgtcaggctcccgaacaatgtaaatctcatccccgacactaccgtacagatcctggttcctgtgccatctccacaacgcatgcgtctcgttcttcacctgcaaaatccaaagatttttcatctcatctcatcaatggtgacatttctacttcatgaagcatctgaagagttttttttttttacctcaagaatgccatggccgaagctgctctcccggtaggcgctgtagtcgggctgccggtcccagcagaagctgccggcggcggggccggaggtgaagttgaagccgcagaagccgccgcccatgaaggggtccggcgtggacagcgggtcagggcagcgccccggctcgtcggcgtagctggtggccatcttctcgcggttgccgccgtcgccgacggagatgtgcacggggccgcacgggtccagcgtgtagttgaacacccggttcgaacgctcgtaagcatgcacctgagtgacacccacagttcatcagagaattcagagaagaagcaaaatgttcagaatatgttc

SEQ ID NO: 90404 - DNA, 744 bp, Oryza sativa
ctcctcaatctcatggttcccttccaccaccatcatcggaatcctcgacgtcactggctccatgtaccttcagttagacatcacaaatcaatttatgaacaatcgctaaatgttaagagtttcagaaaaaaaaggttcagtgctaaatgttaagagtttcagaacaaagatccagtgctaaatgttcagagtttcaggaaaaaaaaagattcagtgctaaatgtgcagagtttcagaaaaaaaagattcagtgcaaaatgtgcagagtttcagaaaaagattcagtggtaagtgttcagagttttaggaaaaagattcaatgctaaatgtaaaaaaaaaaagattcagtttttgggttagtgactgatcactaccttccccagtaatcccagcgcggctgatacgtctcatggatgggcgtggagttggcgaaggagcaggagtagcagtctgtgccggtgccattggtgaggtacaggttggcgtagctgacgtcgccgaggaggaggaccaggtcgggctggttgctcaccatgtgctcgacggtggaggtggtgttgtacgtcagtccaaggtccccgacgatggcgatcttccccgggtagctcctcggcccgacggccggcatcgtgcggaacgcgtggatgtcgctcatcgccgccgggatcgccgggtcgccgcactggtagaagtactctgtccctggctcaagccctgcagatcgcacacttgtttgagcaaaga

SEQ ID NO: 90405 - DNA, 627 bp, Oryza sativa
agcagccaacacatcaagagaggaggtcgagaaacttcaaatggagaaccggttattccgtgaaaaggaggagaaatcttccagtgaaatcaagaagctccaccaggagattgctaagctaaacgagagtatgaagaagctgaaatcggagtctgaagatcacgagaggaaggtgttggaagcggaggcccatgtgaacgccctacagaagcagtcggaggagcttctcctggagtacgacaggttgctggaagacaaccagattctacaatctcagcttcactacaaaggctgaaacagttaacctggggcatgcaactcaaagtgctcgttaccaagactcgtagacttaccaaatgtcagtgcagagcgaaggtattggtgaatgtgatgcttggaatccttgctctaacttgtggtgttgggttgatgtactagtgtgtgcatttgtagttttgaggagtataaaagccagggatgatatatggtgaaatggttatgaatctggtatcagttcatgtcgccatgcagggttgttgatctgaaaactgaattgaacttgtgggctgcggccatgcctctattcaggccttgatctgaaaatctgaaaaggaggaaagtttccta

SEQ ID NO: 90406 - DNA, 1314 bp, Oryza sativa
tgccttaattactttatttgtgactagatgatttattggttaatagcacttagggtaggaactctagttgtgagtacagtgtgtgtacatgagtccttgtatgaacaggctgacaaagtgacagtccacctttattagttgcctgggtatagtactctgtagatccaacaaatcctccaatgcataaatccatatcaattccaaatgggtacatcatactgaccctaaggcataaacatgaaacgtgtaataggtttgtcatctcttattattctacattgacagtttgcatattagtatcatgattcctaacttgtactagtaaataaaattactaacctaagaatgatactatgtaccaaaatgaccaaataaaagcaaaaggtactacagttactgaaaatgtgattttctttcttaagctgttgcttgatataacctccatgtgacttctgaaatatgcttgcagtacaatactcactcaacttactagttcgtacaatgtgatcacatactgacatagtgacacttgccattctagttcttgaatacttccttcgcgtttgccacaatgtggtttatcagattaatagagcaaaaaagcatggaaacagaagtgatgagactgatattctaaatggccaccaaacagtagactatagttaaagaacaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacct

SEQ ID NO: 90407 - DNA, 1283 bp, Oryza sativa
actgatagatgtgcacttcctcagatatgtgggctgttggtgcaattttggctgagcttttcacactgtctccacttttccctggtggaaggtatgtatgatactgttgtttgggtaccatgattatgttgcctctgtagttggtaatatccataatttactgtattcatgtattgatgcatatatgctgtctgcttacgcatgttttgatttgagcagtcaacagatcacccttttgatttctgttgaagtgaactcttgtttcttcttttggtgattagttgtgttctttttattttgtggatagttggcctgggaattttggggatttcatgccactatctctgagttgcatttattaattccaaggctgtaaaattattgttgttctgaatactgtaacaacaatattttttccctcatgttagtatttttagctcttatgatgcctatgttgttttcttatacgattaagcctatacttctccatactttttcttaagcccagttcatcttgcacagagtagacctagaccatttgtacttatatttccttgtttatggtgattctgctttgcttttaattattttatttgcttacagcgagactgatcagctatacaaaatatgtgctgtgcttgggacaccggatcatactgtctggccagagggaatgaacctgcctcgttcaagcagctttaattttttccaggtgaaattacttctgtctacaaccattaggataagttgcctttgacactgatttccttttcttttgcttgttcaaaagatcccaccaagaaatctatgggagcttattcctaatgctactttggaagctatcgacttgattcaggttagttatgacacatgagtcttgtttcttacatgtttgatttatatattgttatatgaaccccatgtttttttgtccagttgcttatgtaagtactaacatcaagttaattaatataacatcttacttatatattatattgttttaagtaatttaccatgacaattcacaataaattgcactaattactagtttgtaaatagtgtaaggtatgggtttgtaacatgttgatgatatagcttttgttgcttgatgttatttgtctgagaataatgctctatattaacatggtagtatttgtcattctgacagcaactttgttcctgggatccacgaagaaggccaactgctgagcaatcactacagcatccgttctttaatgcacctaatttacacattgagttattcatgggaactatacttcgct

SEQ ID NO: 90408 - DNA, 860 bp, Oryza sativa
agagcagaagcattccaagtgctgaggagaaaaccagttcaggtggttttccttcttgatgatctgtttcaatgctctttagccaattttatacgttttctgttatctgctgaaagtattaggagtagactgcattttgtcaagtcagagcattgcatgacatcactggtctaacttggttttgttcattttcagggttatgatatcagtttcctgataacaaactaccactgtgaggacatgcacaagcataagctcatagatttcattgttcagtttatggaggtaaggaaaaatgttttccttggctttcccatttgctacagtttgtgactttatactcatatcacatattctgatttgtgctgtaggacatcgacaaggagatcagtgagctaaagctttcggtaaatacacgtggtcggttagtggcaactgaattcctgaagcagttcatatgacacattcttggcgatctttggaaaacataaaaccctagcattgttagctatgctgtcttggcctttggcgagcaaatctggaaggatctttccaccactttgttttccttttgtaaatgcgttgacaaggatatgtgaattcttgatccaactagacctcattggcagctaaaatctgcccaggcaagagagatgaggggaaacaaagtcatggtcagtaggttgagatagattttttggccttttggttcaagaatcctgtactgtgccggccaagttttattggaatgtggaatgtcaaaattggggctgattctgattctgatatgtcaaaattggaatgtgaaaatcagagacgcttgttgtctctgattctgatttcagttccatggcaggctg

SEQ ID NO: 90409 - DNA, 586 bp, Oryza sativa
caataatacatggttcgaacatgggctggctatatatagctcctggagtttagtcgtgacagagaagttgcatgggccatacatgattctgtcacgcgtcgttattactacggcaagcctagttgccatcccagtatctaaacaggagccgtcacgagttacaggcccgaagcctaaacgtgcacggtgatcttgttcgccttctcctcgttgctgtcgagcttgatgcccttgtaccacacggcgcacgcgacgtacacggcgaggtcgaccagcgagagcgcggcgaggaggaagtagaacctgtcgaggtggccggagttgaggttcccggggatccacccgggccgcctgtcgccggcggtgaggctggtgaccacgctcaccagcatgatgctcacgtagttccccagcgagatggacgccatgcacagcgagctcccgaagctcttcacgccgtcgggggcctgcccgttgaagaactccagctgccccacgtacatgaacacctccgacgccccgatcagcgcgtactgcggcacctgccacagcacgctcagggagctcggatggtccggcgcgccca

SEQ ID NO: 90410 - DNA, 1141 bp, Oryza sativa
agtggatccccccgattatctgcaaaatggtctcctgacatcaaggatgtacgttcaaaccttgatcctatgctaattgccaattttgtgaggtaactgataacttatactgagggtgttctccaaatattagttctctaattttaatcttccaaattatgattctttgaacatatttagagtatgcaatgaaccaggtatagtttcttctcttcttagcatattttattgcatagtgttcttcttacgaacctgaagggacacattatacttctgaagatctatcacagtaataccagcaataatgtgccattcttagtgtatttcattacatagtgttgttttaacgaacctgcaggggctcatttaagcttctccaaatctatcacagtaataataccagcaatggctttggcacataattgccgatccagaaagtacatggaatggcttttggtgtttattagttaaatgatgaaaaactaaaaaagacatttaggaaacatgcagtttatgacaacagagtagtattgtctggtctcattactcatatgaaggaaaggcttcccatacactgtactttcactctactagtttattgcgttgtagtttttcttatttttcattttattgcctgccaaggtagttggatgcaaccatagttgggcatatttttagcactttagtattttaattttagcgccttttctgttccttggtttcaagttcaaagatatcagctagtcttgccttctgtgcattatgaatgtctatgtactgcactcaacaggagaaccaatgaactgaagtctgatctagacatacctgttgaaattatcaacaagtttgaggaattctgggcagcttccagagctactccactgaaaggtgcttatgttccaatgtcagcttattttccttttgttgctgtctagatcttggcctgaatcctgtgagctaatattgaagcaattacaatgtactacattgtcttattgacttacatttgaccaaaaaccctgatcctgttcccaaatgtaatactccctccattccaaattgatcatcatataatatttttaagaatattctaaaatgatcatcatatttgtgttcattcattaagtttatttgttatttg

SEQ ID NO: 90411 - DNA, 1667 bp, Oryza sativa
tgcattctttcgttcttttgggtacacaggaagaaattccatcttgaaggcatttgtcctcaaatttatgggttattcacagtgaagcttgcaggtacagaactatttgccagtattctaaatcattgcgagtaattcacttgtgtttagctttctctgaaaatccagttggagattgtttctgaaaagctatttaactcttttttggagtatctataacaactgctatagttggtattgtttcatgatctgtttaattttcagttgctcttaccttaattggcggggtgcagcatgttgatgcttcaggaacaaaggttcgtggagaaccacatatgcttcttgtcggtgatccaggtactaatatccataacatttgttatatacttaaatcaaaaccatcctttctgtacataagttgaactagtgtttaacctttttccagaaaacaacatattcagttaatatgctttcactgtaatagctacacagtggactaccgattaccgctaggctagcttagtccatatcttcggccagaccttctctaagctcctggaaaactagcttgacccatagctggacgccatcatctagcttgtccgtacatggactcaatcctctcctgctgaagcacctgcgtgaaaaagtgcatccaagatgatttcctgtataccaaaatgttactcgtgcactgcacaaattccaacactgcctcttgtatatggcagaaatgttcaattcagtccagtggggatagatacaacaactaggcttagggccaaagtggagagaatagatatccatcctttttggttcatcaacctcgaacgtgctgctcaatgatgttccagggagcaatttcactatcaaagaggggttgggaaagggggtcctctgtcccaatgcattttaccttggtaattgacccgttacaagaaatcctacagcaccacacagaaaggcatcctctaccctatcctatcaagaacagactgaacgaaacatcgctataggtaggtccaagctactattcagtgtgttctagaatgtttgctcaatccactggactggtgacagacttaaagaaaaggttaggcatattcatttagactagaactaacttgtagtcagatttatgcatctatatttgaaaaaaaaaagaagtagagtaggtcagcttgaccagccccacttgcatcttccttcccagggacgcacaaataacttcttttggattcataaaagtacagaactactgcttgacatccacaagcttcataaagtgcatttggtgttcctaatagagacactacaaacagactatatgaaatatatattatctctaactgaattgtgttctattaaattttaggcactggcaaatcccagtttctgaaatttgctgctaaattgagcaaccgttcagtgatcacaactggtcttggaagcaccagtgctggtttaactgtcacagcagtcaaggatggaggtacctatgtttcacatctccattctctggcagcattatatatcgtgttttgtatttcctcgatttcaaaatctgaaactagtaaatgatttttcatagcaagtttcttgcataataactgaaacgccattttatatttgataataggggagtggatgcttgaggctggcgctct

SEQ ID NO: 90412 - DNA, 2841 bp, Oryza sativa
  unsure (1)..(2841): unsure at all n locations
tagtgtagaattagttgataatacttgtaacgatactcgatttctttcacaatatcaatttaatcagctagaccaaatacataaaagcctaacgcaatatgaatgttagtttaatctcacaaccagccggatcgtttcttttattcttatacttataagccgaaagtgtaaaatgattttgtggttttcttcaccatagtttcttttataatatatttgttgtttaatcgccaaggacacggatatgcatacagaagttttacccataatctttttataattaaccgtgagaataagtatgagcagtatgagtagaatgttaaggctcaacttcttgttatagatttttttaattgtagagtgagactttaattttacttttttaaaaaagagtagaacagaaacctctcgtacgaaactggcaataacactgctacttattaccggcttaatcgagactcgggaggaaacaagaaagaaaaaaaaacataaagcaaaagggcctcaaatcctcaatgcttcgtgccttcgtccctaacgctgctagtccccatcgtggcccgccgtgtctcagtgtcgttggagtgaccatggccgctgaatccggttggttgaaggatgccggatctactggcttagagacatgatcgacggatcctatgcatcggagctttacctgtcaccttggtgctggaagggaggcaacagcagttgaggaagacggcgccgacgagaacaaggagaagaggaaatgtcgatctcttccctcgatcatccaaatcgacgagaacaaggagaagagccctttctttatctggatatgcccaaacttgaggtcatggtcattgctaatgtnggatggcgtggacgtgcttgacctaaatgcatgccgaagggtgtcggccatgtgcatcttagttatggatagaccggaagtattttcaaaataattgtatcaccttgatataattgactaagttcaataaaactttcattatctaaacagacgagtgccggctggttacagcctatgcgctcacagctggtatggctcgacgccctccgtgtcacgaacactcctcaatctggcatatgccagctctagtagtcgtcggattgggtagaatcgagaggatttgggggtagttaggaggaagaagaagaacagagacagggaagtagttgtattgtttgatttctcattgcataactctggcctgaatggcacccaaagtatttaaatgtgtcgacctgtgtacagttgaaccaccactagcccgacatgggatccacacatgcacccaggtcatcacaagatagtgtcgtgctcacatgagctgaaccagtcacatgagaaacagggtacagaaacagagtacataacagagtacccccaaatgcaaacaccccgcttgctccatcaggtgagaggatcttgctcgttggctatanctctcgtggatccaaanaatgtcacgacaaacgtcttcnttgtccctggtttgcggcaactaacatcanctcgccgnttatattttgtcttatccatatttttccccgacctgcaatccttttcactcattgtatccgttttctcgtgttatttttgtacggagtttggaatgctctggatttttcctttattttatctggagtcttcgcactcgtgcacaggaatggaacggcgctccaccttaacacgggaatagaacgtgctcttctggacacttggcacgttttatcaatatgtaaacttgcttttaggtttggccacgtggcacaatgagctgatagaatttgcaccctgaattcggtcttttagatagatagattgtttaggtaactgaactcttgaacaggacttgtctgggatgttatacatgttcaaacgaacttcaacccacttttctttttgaaaagaaactccaacccacttcgtagtacatgctatggtaacgtctgcacgtttaatccgcacgtctttgcacaagtcgagcagggtagcgggctaagctaatctttgggctgggctatatgctggccagaggtgacaggttaattagtaatacagagttggaacaggccatcaccggtgcaattgtagagtagggatgactgtctttatttgtgatatgcaatgtaattattttaaactaactagtatggacaaatgatagtgaaactcaattggcatgatgctaattcagctggatgtcaattcagctagctataatttgattttgtagtctagctaggatgtcaattcagctggagtgtctgaggattgagatgactgtcaagcgaggaaactaaggccatcgagattattgtatcattcacttgcatgtagggatgaaaatggagcggatacggacggataatgctcataccgtattcgttttcatagtttttgcctcgtacgaaaatgaatacggattatctcgaatacgaataagaatcgaatataatcggacatgaatacggaaacaattttttctcggaacacgaaaaccaactcaacttataatagaaacaaatatcaacctatataattacctcgttttatataaaatgtagtataatttataaatattttaaaaaatttaaataatgttaatattgtgggttagtgttaagagatgagctactattaaaatctaaaaaggtatattgaaggttatagatttataaagaaatgaagtatttctcatgacttcggcggttatccgaatagcactgttcacgggatatccgaattattatacgtatccgaaggaaaccccgataccatattcgtatccgtatccgggaggaaatatccatattcatatccatatccaa

SEQ ID NO: 90413 - DNA, 506 bp, Oryza sativa
caaggccccaagcaacctggtaacgacatcgacgtgtacctaagaccactggtcgaggatcttaaacagttgtggaggaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttacc

SEQ ID NO: 90414 - DNA, 2066 bp, Oryza sativa
ctgcaccccggcttgttgagcaggatgaggctacgactgcatttagaacccatcaggggcactatgagttcaaggtgatgccattcggccttaccaacgctccagccaccttccaacgacttatgaacactatattttctgcagtgataagaaagtttgtgttagtctttgtagatgacatactgatctatagtaagtcgcttgaggagcatgttgatcatctgagaacagtttttcagttgctgcagcaacatggtctctttgtaaaagctaataagtgctcctttgcccaacaacatttggactactcaggtcacatcattggagttcatggggcatcaactgatccagagaaggttatgactgtacaacattggcccactcccaggaatctaaaacagttgaggggatttcatggcctagcaggctactatcggaaattcattaaggggtatggtgttcttactaaaccattgacagggctactgaagaaggaagtcaaatacaaatggaagcgataggagcagacagcttttgatgcagtcaaaatggcattgactaaatcactagttctagctttaccagacttttctaagcaatttgtggtggaaactgatgccagtgacaaaggaattggagcaggggcatccaattgctttcattagcaaggcattgggtgttaaatcacaaatgctttccacttatgaaaaggaatgcatagcaattttgttggctgttaacaagtggaggtcttacctgcaacatgctgagtttgtcatacagactgatcacaagagtttcaactgggtacaagtatgcaacagaaggcctttctgaagctcatgggacttcaatatgtgattaagtataaaaagggggctgaaaatcaggtggctgatgctttgtcaagaaggggagaagaggaatgtgtggcaatcactgtcagcaccccaaggtggatggagcttgtggtagaagaataccagaatcacccatagaccaaacaattattggtatctttgagtttgaaccctgaaggggaggatgggtttcagttagtgaatggtgtaattcgattccatggcaaaatttggttggggcatcatcctgaagcacagcaagctgttcttttagctctgcataacagtggagtggggggacatttaggcattactgctacatatcaccgaattaagggtttgtttgcctggcctgggctgaggaaggaggttcagacctatgtgtccaatgtgaaatctgccagcaagactcctggattgctccagcccttaccagtaccactgcaagcttggcacacggttacaatggacttcgtagaaggattacctaaatctggggtgtatgacacaattatggtagtggtggacaagttttcaaaatttgctaagttcattcctttaactcatcctttcactgcatacacagtagccttggctttcattcaacatgtttatgatgtgtttggcatgccccaagtgattatctctgatagggataggatattcactagcgctctatggcaagaattgtttcggttggctgatgtgaagttaaacatgagctcctcttatcatccccaaaccgattgtcaaatggagtgactcaaccaatgtttggaagcatttcttcggtgtactgtgcatgctacaccaagcaaatggtctggatggctatcacaagctcagcattggtacaacacttcatttcacagtgtgttgggcaaatctccttatgaagtactatttgcaaggaagccaacccattttggcttagtggacacaggtagtatcactgtgcctgatattcagatttggttacaagagcgtgcacagatgaatgaggtgttgcaccagcagcttactcgagcacagcaaaggatgaaacactaggctgataaaagaagatcataacgtcaatttgcagtgggagactctgtctacctcaagttacagccatttgctcaaatgtctgtggcacaacgttcatgtcagaagttaagttttcgctattttggtccttttactattttggaacaaattgggaaa

SEQ ID NO: 90415 - DNA, 873 bp, Oryza sativa
atgacgcatctgctttgtcacccttggtgaaagagatccgtattctcgggcctatgtacctacacaacatgtttcctttcgagaggtacatgggtgttctgaagaagtatgttcgtaaccgtgctcgtccagaggcaagcatcgccaagggtatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctagcgaggggaccgtctgggtcgatcgcgacattccagggatatgagatcaatgggtacacattctacacgagagcccaagacatgaagagcacgaaccacaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcagacgaaccttttgtccttgccaatgatgtaacgcaagtctttttcgtgaaggacatgtctagcaaaggaaa

SEQ ID NO: 90416 - DNA, 1953 bp, Oryza sativa
gcaactcataatagagacgtcgagggcgtccagctggtatacttcgtagattcccttgaaattgatccagagaatatcatctccttgcaagaagtccgggtccctgatcctcgctcctatcatctctctaccggtggcgctcatctccacgtacagttgatggaacttgtacatttgtgtgggtagggactgcaccagctcgggcttgacaagcggtttaccgagttcgtacatgtatttcaattccgcattttctattggttcaactcctagcaattgatccgtagttagaccggtgtcaataataaattcttctatcgtcatgtcttccccggtcaccaacggctcgatctcctggtttggttgctctccaagctaagggactggtttggactttctagaagatgctttcttcagcgttcgctctggggtctataggaatcttcttttctggacttcgaggcttgaattggctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcggaggagtaggtgtaggagcacgaggaggagtcgagcaggatcctgaggaggagtcgatgctggagcctgaggtggagacggagctagcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaacaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacttgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatatccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagctatcagctgggttgagcgttccaccgtgagcatagtaccagaacttcgatcgttccggccaattggctgttgccggttcgatacccctctcaatcaagctagcctccatctcctcccactttggcatcgcgacgctatagcctcctgacctcaagtggtgatggtacttcttcttggcggtattttctttgtttctttccatcatcgcctgcccttgttcacctgtcttatatgcaacgaactcatcccagtgatcccttagctttgggaatgtgtcgaagttcggtgtctgccccttcaggatatacttctgg

SEQ ID NO: 90417 - DNA, 1408 bp, Oryza sativa
aggaagcgaagttgatcgtgctaaaatcgatgtgatagatcagcttcctcctctcgtgaacatcaaaggaatccacagcttcttgggtcatgccggcttttatagaaggttcattaaggacttttctataattgccagacctctgacaaatttgctagccaaggatgcgccttttgagttcgatgacgcgtgcctaaaatcttttgaaattctcaaaaaggcacttgtttttgctccaatcattcaacctcctgattggaccctacccttcgagattatgtgtgatgcaagtgactttgctgttgctgcggtcttgggctaaaccaaggataaaaggacacatgcaatctgttatgctagcaaaattctaaccagagcccagttgaattacgcaactacagaaaaagagctgctcacggttgtttttgctatcgacaagtttagatcttacttagtaggagccaaggtgataatttatactgatcatgctgctttgaaatacctgctcactaagaaagatgctaaacctcgtctcttaagaaggattttgctgctccaagaatttgacttagaaattaaagataaaaagggagtagaaaattctgtagcagatcatttgtccaagctgcagatcactaacatgtaggaacagccaatcaatgatttcttaagaaatgatatgctgatgacggttcgcgactccaacccgtggtatgccaatatagtgaactacatggtatctaagtacataccaccaggggaaaatcaacgaaaactaaagtatgaaagtcgccgtcacatatgggatgagccatacctatatcgggtgttctccgatggcctactacgaagatgtgtgccaactgaagaaggacttaagatcatagaacgatgccatgcctcaccctatggtggccattacggtgcattccgcacccaggccaagatttggcaaaatggtttcttctagccaacaatgtacgaagattcaaaagaattcatcagaaggtgcacaagctgccagaggcaaggaggaatcactactcgcgatgcaatgccccttacatacaatttacaagtcgagatattcgatgtttggggtatagacttcatgggacctttccctaagtctcgcaactgcgagtacattctggtggcagtcgactatgtctccaagtgggttgaggctatgccgtgcagcgccgcggaagcgaggcatgccaagaagatgttcacagaattcatcttcccaagatttggtacccctagaatggtcataagtgacggaggttctcacttcattgacaaaaccttccgagacctcctacgagaaatgggagccaaacacaatgtggccactccttaccacccacagaccagtggacaagcagaaacatcaaacaaacaa

SEQ ID NO: 90418 - DNA, 2899 bp, Oryza sativa
tgtgtgccaaatatatgtcgatgacattatatttggttgtactaacaagtcttttagtgaagagtttagtaggatgatgaccaaacgttttgagatgtccatgataggtgaattgaagttcttccttggccttcaaatcaagcaactcaaggaaggaaccttcatttgccaaacaaagtatttgaaggacatgctcaagaaatttgggatggagaatgccaagctaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgccagatttcaagccgctccgaaagagtgttaccttgtggccgtgaagagaattcttagatatttggtgcacacacctaatcttggtctttggtatactaagggagcgaggtttgatctcattggctatgccgatgcggattatgccgggtgcaaagtggataggaaaagcacatcgggtacttgccaattcttgggtaggtctcttgtttcttggtcttccaagaagcaaaaatctgtcgccctatccaccgccgaagcggaatacatttcggcggggagttgttgtgttcaacttctttggatgaagcaaaccttgagagactatggcctaaatgtgtccaaaatcacactcctatgtgacaatgagagcgccattaagatagccaataaccccgtccaacattcccgaaccaaacacatagatattcgccatcatttcttgagaaaccattcaacaagagacgacatagacatccaacatgtgagaaccgacaaacaattggcggatatctttaccaagcttttagatgaagctaggttttgtgagttgagaattgaactaaatatcttggattctcggaatgtggcttgatctattgcatgcatgtttgtttgctagaataggtttgcataccactttgtgacaaaatggacattcaactcatggatggacactagtcatatttgtggagatcttgaatctatgtgtatggggatctcatttttcaatgaattttgttcctaacacaatttgaaatagattcacacattccctctctcgagggtgaattatcttatctcatggtaattccctctcttttgatccctcggatagatcatttgatttgtggctattgttttgtatgcttgtgtgtgctagccgcaacttcaaatggagcctttagtgctcgaccatccctccattcctttaatcctttcaaaactccttgtgaaaagtgtttttgacaaaaaaaattcccggtgctagtcccctgcaaaattcctttagaaagtttgcaaaactgtttcttcaaaattcccagcgaaatccctttgaaaaactgttttccaggaattttcggactttccgaaaaattttcggacattccgaaaatctcctgtcctgtcgctcttcattcaaagctatcccaggatttttcggacattccaaaaaatcttcggatatatccgaaaatctacagaagcgtgcgcaacctactggatcctttcggacttatccgaaaattttcggaaatatctgaaaatatcggggtctttatatttcaccccgtggactcctttctccctcctttcaactctttttcaccacgggcttgactccctcctccgctccccaccggtgaccacctcctctccgacgacctcccgcggctcccctcctctccatcctcgtgggagcgcatttggggcactacttgggacctacattgttgatcttcaccgcgttcttcaagtgttcttcgcgttcttgaggtatccaccctaaaatcaaatccttcgattcctcaagtcttatcttgcgatttcctttggtggagttcttcccctagtgcactaggacctgcagattcattttcccaagtttttgttggcggatttgtgcggcatccggatgatagggttcggaaaattgttttcggatatatccgaaaatctctggccgacccctatcacctcggttttgcacgattcttgccttcacttacttggttcttgcttctttggcttccattcactgatcccttgtctatatcttgtttgaaggatgcctccccgcaagcgaacttcccgcaaatccaagcgccaaagggaccgctctcccaccccatcctctcatgatgattcggacagtgattggtccgggagagaggatgcggctcctcagtatgcgtgggtggctcgaggcggcactctccctcctcggcggtccactcaagctcttggtggtggtggtgatggtgagggctcctctcgtcaaccgcaaacgccgccgcaccaacccaatgtccctattgctcctcttcacattcatacccccgagagggatccggcggtgattcgccaagtgtatgattggaggcggaagactgaagttgttgctcctcgctgagatgaggatccgcgcccccttcgccgcaccgccacggattcgcggttttggactctctttcaacaagacttttatgagtctgtgatcaagtccaaagctcatcccaccaatcccatgcaatggatcaactgggagtagctgcaggcgcatgatgatccggtgctcaactttgtgattgccaattgtgagtgcatgggaattcgctctttcatgactttacagcaggattggtgcaacgaagtcatcgctcaattctatgccaccgttttctttgatccatatcatgccatgcaatggatgacccaaggatcctggtctttctgtctcctatccgcgattggctgagatttgggggtttgatgtgcatgacttgctaaacctttctgatctgca

SEQ ID NO: 90419 - DNA, 1917 bp, Oryza sativa
atctgcaatcaagtaaaaggaaatttctgcgtcagttcagtttgttgtgtgtgcgagacgaggatggtctgtgccgcggtccttctgtgtcttggcttgaacaagggctcgtgcccaggtcctagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttttgggccccgtttggcgattttagccggcccgggccaccgagggcagggtcgagcacgagcgtgctaattcaagccaagattcttcagaaggaaacgatggcacagacacagtcctcaggaaatcgaaaatgcttttattgaaatacggaagagaaaaaaggtaagtatatgcatgtggtagcccccggccaaccctgcacgcccgggggggggggtgcggggttggcccgagcccgagacatgacacccgacccccactaggggtagaagcgacgaaggtgttcgatgttccacgggttaggcagctctgtgccgtcgcccgtggccagccgaacggagcccagccgggggacgccgatcactcgatacggaccctcccacattggtgagagcttgctcagtccagcacgcgtttggacgcggcgtaggatgaggtcgtcgacgcagagtgatcgggcccggacgtggcgctgatggtagcgccgcaggctctgctggtagcgcgcggctcagagggccgcgcgccgccttcgctcttccaaatagtcgaggttgtctcggcgaagctgatctatcagcctcgcaatacatggtgacccgaggggacctcagggtgagctcagatgggaggaccgcttccgcgccgtagacgaggaagaaatgcgtttccccggttgctctgcttggcgtggttcggttcgcccagagcaccgctggcagctcctcgatccacgagtcgccgtgcttcttgaggacgttgaaggtcttggttttgaggcccttgaggatttccgcgttggcgcgcttcacttggccattgcttctggggtgggcgggggaggcgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagccccctgacagcaaacggccacgaaagaggtatggtctgcagggcctgggccggctgatgggtttgcctggcgtggaactggcacgccctgcaccgtcggaccaggtcgaccgcatcgttgagagccatcggccaatagaaaccctggcgaaaggccttgccaaccaaggtgcgtgaggcggagtgggctccgcactcgccttcatggacatcggcgagaagctcaacgccttgttcccgaggaatgcacttcaggaggactccgttagccacgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagcctta

SEQ ID NO: 90420 - DNA, 1894 bp, Oryza sativa
cgcgggcagcccgacataccggtgatgttcaggcgcttacgctcaagccgttcgtgcagtgggaggaaactagtcaaagcccatccgcggaagtgaacatggcgatgacgtcgctaggtttgtatcttgcacttcttcactccttgtgttcggattgacttgattagctgtgttctcggaggagaagaatagcttgacttagtcttttcccatagtcttttccctgtcgggcagatttcgagaacatgttggctgaccgagatcgtcgaatccaatattggaggacgaaactcgaggtggccgaactcaaaaaaaccatggtggaggtgaagaaggaccaggccgtggaagctcttcgaggtcgcaaggtgtggttcaactcgtacctcaagagctgctgcgcggtgatggtgagggtttgcaaggagctatgatcccgaggagatcccaagaagtcggcggccagttatatctcgtggttgaatggagccagtgcacaacttgaagggattggccagcacatcgacgatgccttgaaggaggagtgtcgtcgggcgagccgctacgccggaggtcatgtgctggcctgcatccgagatcaccgtccgcagctgcaactcgagttccttcgtgaggggttctcgcgttcccggaggacacccgcggagatcgacggtcttgcacagtcaatggcgctgcttgccgagaaggttttccgctccatggattggtgttggccgtcctggtagtttttgtatcctgtagaaaaatatctcaaggaagcatgtaatatactttgaagtatttatgacttgtaagaaatacttgtaaaatagaaaagggatctatctaactaagttttcttactctgggtatgttgcgtatgagtgttttctcactttgcgacttcgatcagtcacttgagctatacactctccctagccccagccttgtcatcggagaatcgttctcggaggataaggctcttagatccttgacctgccttggttgaaaaaagcattgaccctagctcccagccgtgaagttggaaaactcaatttccgattacacggcttggttaatacgcacggcctgaactcttacatgaccagatcttacatggtcatttgtctctacatgatctgacaaggccttatccgctctgggcgtccccagccgaagttcccttagattcctcagaggctttgccaggacggcgtaaagggacatgaggataggttttaactctaggtgtcgtcgtggtaacggatcgtcgggaaggaacactctgacaatattctttacctgaaatcaactttattgaaatcgtgagatgccttacaaatttggagactattgatttatacataaaatttacgtaattgatcaatgttccaggaatttgctaactcgcgaccatcgtcgtctgcaatcttgaatgcacatggccacaagacttgcgtgatcgtgtatggtccttcccacttgggtgagagcttattacgccctgcttgactttgaacccatcggaggacgtaatcgccgatcgaaagtgtgagtgctctgatgcgcttctcgtggtatcggcgaagggcctgctggtagctggctgctctgacggtaactctttctcgatgttcctcgagtagattcacatcgtcacttcgctgctcctcctgttccttgtcggagtacttctgtactcgtgtgctttgatgttgtagctccgtggggagcatagcctctgagccatacacgaggaagaagggtgtctccttattggatgttgtcggtgtggtacgcacggcccatagaacagaggggagttcttcgacccacttcttatcgtgtgacatgagtctgtcgtagacgcgggtcttgatcccttgtagta

SEQ ID NO: 90421 - DNA, 1954 bp, Oryza sativa
taaaagagaaagggaggagaacagttctacttttccaatatttttagagggcttctatggataaccatttggcataacctagggtcaaggggctctgataccaacttgtcaggcccggaatttctatccaaaattccaaacgcttacatgtgtgtgaaccctcgtccaggaatcagccgaggcacacaataacaaattgatattagagtacaattattactctaattaataagcgaataaaatgtcattacagaggtagatagttcctctcaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccaattatagcatcatttactatgatgagaagtgtgagactaatcacgaaagacattgttagacctgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaagaatagtgagtcataagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacatataataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagttttattaaacggaatctcgtcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtctctcaacataggtcagatcctcttggtcttttatctgttcaagattagcttcttcggtaggtacccttaaacactttttcaattgcgaaacatggaacacattatggactcc

SEQ ID NO: 90422 - DNA, 1830 bp, Oryza sativa
gcactgtcgtcaccgccctcctcgtcgcagtcgagcgcgaacgcgagccgaggggccgtaccctcgaagctgtggacgatgtggtcgacggcgtcccggacctgcgcgcgcgcgccgtcctcggttccgggagggaactcttccagtgctgcccacggggagaagtcagggtccctggcctggtagcttgccagtacgagctccaccgccccccgggcgaggtccctcgaggatgacttgatcgtctcctcgagctcctcggggagccgctcgagggccccggccatctctgagaggcgctgggcgaggcccccctggttggcggcgtacttcgcgtaccgcccgccccagaggcccgcctgccgcccggagcggtctagacgggagacggcgtcccgaagcatgccgggccctacctcgctcgccaagcggagggcctcgacctccccggcggacgagtccagcgcgccctgcagctcagcgatggtgtgttcggcggctgcgaggcgggcggctaggtcgccgtggccgcgccgccccgccgctgtgcgctctcggcgtccaggctccttcgcccgcgcctcgagctcagcggcccgctgatccagtgcggccctctcggcgcgggcgccttccagattgcggcgcgcctgctcctcccgcgctgcctcgcggaggaacaggctgtccgctagccactgcgccgcggcctcggcctcctcgagagctcgcccccgctcggtgagcgcgtcctcgcggaggcggagtgtggactcctcttcggcgcaggtggcatcgtgcgccgccagtgttgcctcccgggtggcgacggcggcctcgcggtccgccaggtctctctccttcgcgaccaaggcgcgggcgcgctcctccagcaccgtggcgcgagcctcaagggcctcttcgcgctgtcgggacaccgcctcgttctccgccgcccgccgttcccgggcagcggcagcgttaaggactccctgggcagcgtcgagcttctcctctagctccgccgcccggctcccgtattggaggcggaggtcatcccgcgcctcgtcgagcacggcggtggcgatgagggcagtctcccgctcctcctccacctccctggcgatctccgccaggtcctacgacgggcctcgagctgtgaggcgtgccggcggtgtgccttgcggcccgcctccaccatggcctccaccgagcgccgcccctcctcgacgcgcgcccacgccgcgtcgagctccgcccgctcctcctgcagggcctccatctgggcacttaacccgtccagcaccgtgctgttcgcggcggccaaggcctgcaggaggggctccgcgctcagtggggcagcggaagacagaggggagagccgcctcggtatgggtgccgcgcggctcggcccgccgattgacgtgccggactcgggggcgtcccccgaagctggctcgtcccaagcgtcacccgaggggtcgggcccgagcggcgcgcccgcagcctcgtcgtggttggcctcggaaatcgtcatcgcctcgggcggagtcgggtcgggggtgtggcaggctgcctggcgtgcgcgcgccgcctctgcctcccggacggactccccggcccggcggagtctggcctcctcccgagcggcctcctcagcctggcgaacccggacggcctcctgggcagcctcctcagcttcccggaggcggtccgcggcttcccgccggtcagcttcccgcctccgggcctccgcggtcgccgtctcctcggcctcagaccggccggacttggaatggcgggggggcgcgacgggatctcactgaggca

SEQ ID NO: 90423 - DNA, 1695 bp, Oryza sativa
gtttgccaagcacctgttggaactggtagtggctgcaagaggcctggatatttagctctgtctggcttggcttgcaaacaggtttggcaggtctgcagcttggcctgaatcattttcttcatagcagtccaagcaaacatgcttttggctctcctataagtgacaggaaatcctgaatgtccaccaatgggggtagcatgcaatgcatcgattaatttctcttgcaattcagtattgtcccacccaaattctccccttgtatctgagaatgccttgtactgaagagaaatgttgcctagctgttggtgtgatggctagttctgctatcagctttgttgcatagggatcttgatcatagctgtgaacaatctcttgcatccaagaaggtacacattatgagacagtacacagttctgcagaattggcatggtccttcctggacaaagcatctgctgcagagttagttactccctttctgtaacatatatgatactgcagccccatcagtttagtataagctttctgttgccactgagtatgtaacctctgttcagtcaaatgtttgagactgtgatggtcagttaaaatgataaactctccatgctgtaaatattgtctccattgttctactgccaacataatagccatgtattctttctcatatgtcgacagcccttgagtcctgggtcccaatgccttactgagaaaagctatagggtgtttatcttgtgagaggacaaccccaatgcctaactcacttgtatcagtttccagaatgaactgtttagagaaatcaggcagagctagcactgaaaagcctgattggtttctgcaatccatttatatgggatgcccttccttaaaagttgagtgagaggtttactgatcagtccaaaggtttccttagtttcttgacagtggtaggaattgcccaattagccacatcttgtattttttggaatctgcggatactccttttggtccaattatgtgccccaaataggaaacctcttgctgtgcaaaagagcatttgctcagcttaacattccaattgttgtcagccagtaattgcagaattctcctcaaatgttccaggtgtgttatcagatctggactttaaattaatatatcatcaaagaagaccacagcaatttttcttagaactggagctaatgttgcattcatggcactcaggaatgttgctggggcccgtgttgtcacacccggagtttcccctttccatagttttaatccattaataaattatcaatagaaaatgctatgtttaaccaggagaaaaccctaattaacaacgggtctaataatcggatttgtcagggagaatttgtttttgaattctctttgctttaaaccattaacaagcctatcagcggaattttcagagcagagtaaataaccctgttaatttaaaatgcttacggatctgtaacagttacactacactctcctcttgctcttgttccccttcccttttgcgtcctgcggaaactcgattcgcttggtctcagctcttccgatccacgtgttcgcttgtaatctgctgactcctttgtcgttccggcttcgttttgttcccgcaggccgagtccttgtcgcattccttttctggctgccgtttcctttcctttctttaaatggcaccgcctttccctagtttttcttttcttttccgaa

SEQ ID NO: 90424 - DNA, 2284 bp, Oryza sativa
ggttttgtccaggagttgcgtacaatgtcctttgccataggatttgggactgcccctttttatgcccagattactcatgatcgtcacgaagagaagtgccgagtcaaagtcactttgaacagtaatagtgaagatatcccctcagtgatgttcgaagctggaggaagaaactacatccatgcatgtcaggaggtggcaaggatcgccataggagagctccgcgatcgctacagtgatcagttggccgacacggagtatcgctatcatcctccagtcgtcaatgtaagtgatgatgaaggagaagaatcgaagcgcactcattccaagattgagtggggagcaactcaagctgataagacgagccgaacgagccttcaatcaactccgatgctcggaagacctagaaagccttgtcgaaccgttgtcttagatcgttgtgttagtttgcttgttttaagtttggttgtgtgtcttgcatgtgatttacatcagtggtgggatgtaagtgcatgcgtttgtttgcttttgagtgttaggaagttggtgagtttagtggtgtgagagtcttcagtttgtaataatgaaactcacttaagatcaataaaagttaaagtaattctctgtcctaagtagtttcccccggtttctcttcttgtgccctgcccataccagatggtgaatactcgcagcaatgggaatggccccaacaaccccaataacaacaacaatggagagaatcccacacttgcccaagttcttgctcaacagacacagctaatgaacatgatgatgcagcaactccagaaccagcaaaaccaaggaaataaccatgcacctccccagaacaagttagcagaatttcttcgtgtaaggccgcctactttctctagcaccgctaatcctgttgaagctggtgattggttgcatgccatagagaagaagttggatttgcttcaatgcactgatcaggagaaggtctcatttgcatcccatcagttgcatggccctgcctctgaatggtgggatcatttccgcctgaataggactactgcggaacctatcacttggcttgaattcaccgctgctttccggaagacgcatataccatcgggagtggtgtctctcaagaagaaggaattcaggtcgctcacccagggatctcgctctgttacggagtatttgcacgagttcaatcgtttggctcgttatgctccggaagatgtgcgcaatgatgaagagcgccaggagaagttcttggaaggacttaatgatgagctttcttacccactcatgactggagattatcatgatttccagaagttagtggataaggctattcgtcaggaggacaagtacaatcgcatggagcagaagaaacgccggattgctcaattcaagacacaacaggggaataatcagaagccgcgtcttactttaggaccccagtccatgccacagggaggttcttcgtctgttgttcgtccgaagcgttagttcttcaacaacaatgctggcaacaacatccgcaatcaagctccacgtcctgttgcagctccagcacagcaacaacctgccaagagggagcaaagcagcaagcccgtggtgtgtttcaactatggagacccaggacattatgctgacaagtgtccgaagcccagacgcgtgaaggttgtccctacccagagcaactctaccgcaccagcatcaaaggctcgtgtcaatcatgtcgctgctgcagaagcacaagatgctccagatgtgattttgggtacgttccttgttaactcagttcctgcaacagtgctttacgattctggtgctacacattcattcttatctatgagttttgcaggaaatcatgggatggaagtagaagatcttagacgtcctttgatggttagtaccccaagtagtcaagcactctctttgcaacgtagcccctctgtcagaatagaaattaaaggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtgactgttcatgcattgtcttctgagtttttaaggtcaagactgaaccaaataattctggaaaagattcctatagtccgggagtatcccgatgtgttccccgatgatttgcctggtatgccgcctaaaagggatatagagttcagaatagatttggtaccaggaacaactccgatcc

SEQ ID NO: 90425 - DNA, 3643 bp, Oryza sativa
catagtgaagcgcaagaagaatggagacggggatttcaatttgccaactttttcataaaaataaaataaaattatgggatttatgagaaacttgatagggttttaatgtccacagagtgggaacaaaaatttcctctgtcttctgtggtggctcttaatagggatatttctgtcttatgtggtggctcttaatagggatatttctgatcatactcctttactgttgaatacaaattcctcatctctcagtaatactcaatagagttttaagtttgaacttggttggctattacgagatggttttgttcatatggtgaaagaaatttggtcttgtgttgacgaaggcaatactgctatggagcggtggctggcaaaaattcgtcggttgcgacaacatcttaggggttggtcaaaacatactagtggagtttataaaaagaaaagaaagaaattttagataagttagatttgctagataaaaaggctgaaacttctcttttgagtccggaagaattggatattagatggttttacaggaacagattatcatctattttgagagaggaggaaattaaatggtatcagagggctaaatcaaaagacatcttagagggtgattctaacacaaaggattttcatttagttgcgaatggtaaacataggaaaactagaatttttcagttacaggatggtgaccatttgatacatggtgatgcaaatttaaaatcgcatattactacttattataagggtctttttggtctacctaaggaatctcaacttcaattgatgagagtaaagttgctgatattcctcaagtttctcatatagagaatgaggctttaatacaggaatttactgaaacagagattaaggaggctatctttcagatggagcacaataaagccccggatcccgatggttttcctgctgaattttgtcaagttttctggagtgttattaaaaatgatttacttgacttgtttaaagagtttcataatggttctttacctttattctcgcttaactttggtaccatcattcttttacctaagtatgtagaggccatgaaaattcaacaatataggcttatatgcttacttaatgttagtttcaatttttttaccaaagttgccacaaatagaataatgtgtgttgcccaaaaggtcattagtcctactcaaactgcttttattcctgggagaaatatcatggaaggtgtggttattttgcatgagactttacatgagttatcgtaaaaataatagtggtgttatcttaaagattgactttgagaaagcttatgataaggttaaatggccctttgttcaatagactttgcggatgaagggcttctctcctaaatggtgtgagtggatagcctcttatatccaaggaggtcatattggtattaaagtcaatgatcaaattgacgataattttcaaacttataaaggctttggacaaggatgacccgttatctccaattctttttaatatagtagctaatatgttagctttgctaattaaagggctaaagagaatggttctcttaatgggggtaattcctcatcttgtggctgatggtttgtctatcttgcaatatgcatgatactatcattttcttggagcatgacttacaacaagcaaagaacttgaaattgattttatctgtatttgaaaaattatctggcctgaaaataaattttcacaaaagtgagttattttgttttaggcaggcaaaagagtgctttgatcaatattcgtctatatttggttaagctaggctcctttcatgttggatatcttggtattccaatgcattttaggaagttgagtaataatgattggatggttattgaacaaagaatagagagaaaactgagtagttggaaaggtaaacatatgtctgttggaggtagattggttttgatcaattgtgtactttcaagtttagctatgttcatgatttctttctttgagattccaaaaagggttcttcaaaagattgattattatagatcacgtttcttttggcaaggggatgaccataagaaaaaaatatagattaactagatgggatataatttgtcaacccaaagaccagggtggattgggtgttcatataagttaattaatgaggatggtgtttggcaagatttattgaagagaaagtatcttcataacccaagtggataggaaacaaggtggttttcatttttggttagggcttatgaaggtaaaaaacacattcttaaatatgggctcttggattgtgaatgatggtcaacagataagattctgggaggataaatggctaggaaatatggcctttacggataagtatctatctttatatgctattgttaggaggaagagtgcccctattgctagtgttatgggctctgtcccgctaaatgtttcttttaggagagctttagttgggcagaatctaacaatttggcatgatttgtgtgcttctattgctcatatccagttggatgatactggtgattgttttagatggaattatcatcagaatagccagttttcggtaagatcaatgtacttagctttaattagtaatggttacattgatagaaataagttcatttggaagcttaagatgccgcttaagattaagaactttatgtggtactgctcaaaggagtcgtcttaactaaggataatctaacgcgacggaattggaatgggtgtttaagatgttgtttttgcatgaaaaataagacgattcaacacttgtttatggattgccattatgcaaagtttatttggagagctgctcggttttcttttggattacaccctcctagaagcatacctcatatgtttgacggttggcttcagggtgtggataaagaaaagagaaaattgatacttgttggtacatctgccttatgttgagccctgtggtcgtgtagaaatgatagggtttttgacaaaacgccatctgtttctgtaacatcctgaaaatttacaattttctaatcctgcatcatgccacttcttatgtttttaataatttcctaaacctaggaaaatataattagtgggacctcctaaaactaacttgcataaaatccctctatggtatttaacttcttttgtgtttttcatttaaagatatatttggttaaattaaggtgtttcttgatttggttttaaattaaaaccttctttcgacaaaattcctcttattcaaatttagttgaaaacccttttcatttgtatgaattatggtccaagaaaaccctccaaaccaactctttgtaattccgattttaattggaattaattgtcgacccatcctttgattccaaacctatccttagttcccttgacaaatctcaagtatccaaattcctcctttcaatctagccgccaatttaattcccatggcttgattcctcctcggcacaagaagatatatttcatccttccatcccaaatccaaaacctcatttagcccataattaattctagatttcctaccacatattttgggctaaaattttatttattccattccctccattttcctcccacattcccaattatatatctctctcccccatttgagtgcatctatataaattcaactacattccacttccaaaaatat

SEQ ID NO: 90426 - DNA, 2894 bp, Oryza sativa
cttactcaacaaggaatctgaggaatctgatgatgaagacaactacttttccatcgagttgacaccaagtttatttacatctgctgttgataatgcataccaatctatacatgatttttcaaagcctttgatcaacatgatgaaagctgcagggtgggatcttgatgctgctgctaatgcaattgaacctgctgtggtttacacaaggagggctcacaaaaagtatgctttcgagtcatatatttgccaaagaatgtttggtggtttccaagaagagagcttttctgttaaggctgctaacattactgtttccaatgaggctttcttccatcagttccttgcagtacgagccatggatcctttggatgtcttgagccaaaatcctgattcggtttttgggaagttttgcagaagcaagtacctattacttgtgcacccaaaaatggaaggctctttctttggtaacatggatcagagaaactatgtaatgagcggtggccatccgaggacacctttctatcaagcatttctgaagttagcgaagtcgatatggttactgcacaggctggcatactcctttgatccaaaagtcaaggtctttcaagtgaagaaggggagtgacttctccgaaattcacatggaaagtgttgtcaagaacatcatcctagatgaaggtgcagagaggcctaaagttggcctaatggtgatgcctgggttcttgattgggactagtgtcatacaatctcgggtgtatctttcaggtgtcaagtctgctgattgaagctgatgcagttactcgagaagatcaaggctactttgcatcttgcctgatcaaccaatcacattagtacaaggacgattaagggtcttgtgtgtgatgctgctgtcatctctgaaagatgctatagtcagagtgtcggtgaaaaatattgtctttttaaaatttcgagtgccatgctgtttgtatgtttcttcagatagatttcttctgtaatgtaactgtcaaatgtttgtctatatatatgtttatgtgtgttttgactggcatcctaggcgtgtaaacttcctatgatgctcctttgcataatttgtaattcacggctattcaccagaatgtagtatgctctggaaactagtgtgtccatgctttgcacaatcaggctcatataattggggattggttggggtatattgaggatagaacacactgggaagaggatggatgcgcttttgatgtagagatggtgcagtcaaaatttgataccaataatatgaagggtatctaaattgccaggtgtaaatagagccatacaattttcatagatgagtacacagagaccacatgcatctgtacactagctataatgatccacatgcttcttttgagatgaatgtatcagtgctcagcagaggaggtattgtgattatgataaaacgcatagagcatacgtggcctgcatgcacgccataacatcccacacccggttgatggcaccggacacaagcaaagcttggtaatctttgaacggtacactaaccggaaaactgcttaatagcagtcaagttaatctgcatgaggagcctaaagcagcaagagaacgtgtaaattaaacaaggaaccccaaaaaaaaaaagaaaaaacggagaaaaaggggatggttaggggagttactgattgatgatttcggtagaggagatattgtgattgtaggaagacaagacctgattgcatatgctacggtgcaaccagaccagaagcattcacttttaactggggcactcacagcgaaaccaacctcacgccaagccaccattcaagatgggtttgacatgggaaaggtgataacacagatgacagattcatgacttccccaaaaaaaaatcaaatagaaacgaaatgtcgtctaactccacaaacacgagagggtttcatgtacaacatctgccatgcacgcacgctactacagtttatttgacataagctgtaaaagataggaaaatccatcacacttcacaccgaagccatggagatgcagagtatacgtatcaccagacgcttcgaaatgtagtgaaaaagcatgccacggcacagagttagctttccctagtgctgttctttagccactccaggtacttgaggttgcctccttttatgggcagcgcgatgacttcaggaacgctgcattgggaaatcaagtagtgaatctcagatcacgacaagagagaaattttaggtttacgacctgtcagtatatactgacaaacagatgaaaattgatggacagaaaagaacttactcatactcatggttggctttcacgtgttcggtcaacgcatcaagaagagactcccttgtctttatgatgagcagttcttcagcatcagtttgcacctgcaaaaagatatccgctgatcactaaatatctttttacataagggaataggcaaaacgctcattgacctaaaggagtatagtgagagtgcaaagctaaatgaacagctaaagcttgaaatcaacctatcccaaagaaggaatagaaatgtacctttccttcccaccagtaaacagattcaatacctggaaagagggacacagaaaattaaaaactaaataaaatgagtcgatgttaatgtaatgtaagatagaaagtaggccaaaaaatcatgaatcagaataaaactaatagagaggataaatatagatatctcagcttagcaattccattattttgtctctctttagatgaagtcccattatattgcaaagtgcgcgatacacaatagcatgctgccgcatgcatgtaacaacacatcatcgtgtccactccataccacattccagtgcctatgcacaaagaagagctattgccaacagctacagtattttttaataa

SEQ ID NO: 90427 - DNA, 730 bp, Oryza sativa
  unsure (1)..(730): unsure at all n locations
tcctgcagccccagaatattgcactccaaaggtttccctgatcagtggtgcgactgggttatgaaggtagttagaggtggaaaagtggccattaaagtaaatgatgaggtgggtccatattttaacactcataagggattgaggcaaggggatccactttctcccctgctgttaatttagcagcagaagcactcactctattggtgcagagggctgagaacaattccttggtagaaggcctccccattaatgagaataacaaagtgacaattctccaatatgctgatgatacaatttttatgatcaaggatgaccctgaacaagccagaaatttgaaattcattttatgtctctttgaacaactttctgggctgaaaatcaactttaacaaaagtgaagtgttttgtattgcaaggctgttgaaagacaatcaatgtatagtgagattttcacttgtaaaataggtactttgcctatgaaatatttaggtgttccaattcacaaaaaaagattgctcaacaaagactggactccaactgaaaacaagatggagcataaattgngatgttagcaagccagattttagtccattggggggagattgattcttatcaatgccagcctcagcaatgtgcccttatacatgttatctttctacaagctccctcaaggagtcagagaaaaaatagactactatagaagaagatttctgtggcaggaggatcaaggc

SEQ ID NO: 90428 - DNA, 695 bp, Oryza sativa
ttattcttagtgttaactcaccttctgttcttttttttccttcactggctcaatttatctcttctagatgggagttgctgaatcctgacgcagggattgtttaccttccgcacccaaggccaacagatggggcagtgatgtccttcagtgaactctgatggcagctatatcattcagacatagaataaagtcaccagtacattctgtggcttaagaacttcagagttcatatatactattgctaggtgcaagactgattaagaaaaagctgagaagcaacaatgcatgatatgtatcacaccaagctgagtttctttaaatgtgttattcagttgttgttccacatgttttgtatatacgtaaataaactctaccaagaattcctgtctattaataaattgtgagcttttgtgagttgaggaatttctgtctattaataaattatgagtttttgagttgaggaggagccgaagttgcttagccgggtataacaagctcatcaacgataacccctcaagtagcgcagttcaccatgggtggatgagcagtgtttgctcctctaatgtggtgtcatcttgtgttgtggcgaagttgagctgttgtgccacgtgatgagctaggcaacgataatcaacagtcttgagagcccaaggcgaaagcattacccccggtcttctggccgtggcgatgttgac

SEQ ID NO: 90429 - DNA, 1281 bp, Oryza sativa
acaaggaaccagaacagttacagagtacctgcacgagttcaaccgcctcgcgcgatacgcccctgaggacgtgcgtaccgatgccgagaggcaggagaaatttctgtctggccttgatgatgaattgaccaaccagttgatctctagagactatgaggattttgagaagcttgtggacaaggctatcagtcaggaagagcagtgcaacaaaatgaaccgaaaaagaaaggcatctcatttcagaactctctaggggaacagtcagaagcctcgcttcatgacgggatatcagggtggaccttccaccatgattatccggcaacattgtccctaccacccggacaatttcaacagcatcaacaacaatggcagtcacagaaatagtgagcagcacagcctcaaccctactccaagtccactaatgattccagctcagtcagttcagtcagctctgccagctcagccagaacagcccaagaagtttggagaaaacccgaactctacttcaattgtcacgagcccggacacatggttggtaagtgcggaagcaagacgtgctggactcaagtttgttcaggcccgtgtcaatcatgtgtctacagaggaggcgtagtcagcaccagaggttatattgggcacatttcccgtgaactcgacaccggcagtaatattgtttgcaactcattccttcatttccaagtgttttgctagtgcacatgggttatctttagtgaagcttaagataccaatgcgagttcatactcctggaggtggcatgaccacaactcactactatccatccgtgacagttgaaattcaagggttgatttttccagccaacctcattcttctcgaatccaaggatctagatgttattcttggaatggattggctaacaaggcacagaggagtgattgattgcgctagccgcaccatcaagttgaccagtgcgaaaggagaagtggtaaccttctagtctccaataccgcagaagccagggatcagtctgaaccaggccactggtgaagaacaagaggtagcagtggagaaaaccactaagaagttggaggatattcccatagctagagattatccagaggttttcccggaggatctaacatcaatgccaccaaaaagggatatcgagttccggatcgatttagcacccggaactgcaccgatccgcaagaagccttatagaatgggagccaacgagttggcggaagtcaagaagcaagttgatgaacagttacaaaagggatacatcctcccgagcacgtc

SEQ ID NO: 90430 - DNA, 1701 bp, Oryza sativa
ttttaggcggcataccaggtaaatcatctgggaacacatcgggatactcccggactataggaatctcttccaaagttatttggttcagtcttgaccttaaggactcagaagacaatgcatgaacagttacaactcgaccatcattgctggtgagagttacttttctgttggcacagtctatcacacctttatatctggctaaccagtccatccctaggatgacatcaaggtctttggattctaacaggataagattggccagaaatggtactccttgaatttctattctgacagagaggctacgttgcaaagagagtgcttgattacttggggtactaaccatcaaaggacgtctaagatcttctacttccatcccatgatttcccgcaaaactcatagataagaatgaatgtgtagcaccagaatcgaaaagcactgttgcaggaactaagttaacaagaaacgtacccaaaatcacatctggagcatcttgagcttctgcagcagcgacatgattaacacgggcctttggcgctggtgcggtagagttgctctgagcagggacaaccttcacgcgtcggggcttcggacacttgtcagcgtaatgtcctgggtctccacagttgaaacacaccacgggctttctgccttgctccctcttggcaggttgttgctgtgtcgaggctgcaacagggcgtagagcttgattgcggatgttgttgccagcattgttgttgaagaactgacgctgcggacgaacaacagacgaagaacctccctgtggcatggactggggtcctaaagtaagacgcggcctctgactattcccctgttgtgtcttgaattgagcaatccgacgtttcttctgctcgatgcgattgtacttgtcctcctggcgaatagccttatccactaacttctagaaatcaggataatccccagtcatgagtgggtaagaaagctcatcattaagtcctgccaagaacttttcctggcgctcttcatcagtgcgtacatcttccggagcataacgagcaagacgattgaactcgtgcagatactccgtaacagagcgagatccctgagtgagcgacctgaattccttcttcttgagagacaccactcccgatggtatatgcgtcttccggaaagcagcggtgaattcaagccaagtgataggttcagcagtagtcctattcagacggaagtgatcccaccattcagaggcagggccatgcaactgatgggatgcaaatgagaccttctcctgatcagtgcattgaagcaaatccaacttcttctctatggcatggagccaatcaccagcttcaacaggattagtggtgctagagaaaataggcggcctcacacgaagaaattctgctaacttgttttggggaggcgcatagttatttccctggttttgctggttctgaagttgctgcatcatcatgttcattaactgagtctgttgagcaagaacttgggcaagtgtgggattctctccattgttattgttattgttgttgttggggccattcccgttgctgcgagtgagcaccatctggcatggacagggcacaagaagagaaaccgggggaaactacttaggacagagaattactttaacttttattgatcttaactgagtttcattattacaaaactgaagactctcacaccactaaactgtcacgcccg

SEQ ID NO: 90431 - DNA, 695 bp, Oryza sativa
cagtatatgtggatatttttaacatgtagatcttgattttagaaaaatttagcaacttgaaccactcgaaacggatctacagttatttagttatgattttccgaagatttaatctattagaaaaacgggaaaaagaaaaaaccgatgatgacatgatgacatcaccaaaggtggccggctaggatggcaagctcgccggagattggatgatcggctgcgaatttggaggacatgtacgcgtagaggacgacgagacgaacccaacggtactcaccctcgagccaaacgacaaacgacgacggccggcgacgaaggggcggcgacggcggctcgggataaccggcgacggcgagctacggcggccggcgacgaaggaggaggtgcggccgagcttctcgtcgctcccacgcacctaatggcggtggcggcaagcggcggcgacggcggagacggctgcgcggcggcgccggagatggccggcgacggcggcgaggctaagcagcggcggcgcggcggctaggaggcagggagaggacgggagttggggcaaacgaaagaggaggactagggggtcctagttatagccttggattgaagagatcggactcctcctacaagaaatcgatccgggaaatcaaaaactcggttttggagataaactcaaaaacgagttcgattcggataaaatactcaac

SEQ ID NO: 90432 - DNA, 786 bp, Oryza sativa
ctgcagtggtaagtccctgaagggtccgttgggatggccatgcccgacgccaccttcacatggtgagaggttatttattattaatcaatatatataagcagcaacttgcggaatggacaagtctaaaatctataaactacgagattacctttattgataagttctcaaagggaatatgcagctcacatggtgtccaccgagtgatgacattaacggggcaggtggtttcgtcctgtatttgcatggcgtccatgctctgtgatcctacctgccccgttgaggcgcagctgctacgattgcctgaagggctgaccattgcaggaggaatgtacggctggggatctagggaccgatgtgtggccatgcgttcatccaccttccttgccacctcctcttgcatgctaagctcgtagctcgataccctgtactcaagatctgcaatcttcgcctcggtatctctcttgctcctcattcgactcctgtacgtgtggatgtcctccttgaatccaatcttccaaggaatcacccctttccctcgtgtttgtcctggatgcttgggagtctgcagggcgagtgacagctcgtccttctctctgtcgggtcggaacgtgccctgagaagaggcttccactgcgtccgttagtcgacttgcagcctcgcgtatctgatcgctgaagaccagggagccatcaactgggttgagcgttccaccgtgagcatagtaccagaacttcgattgatccggcatttagcggtggccggttcgatacccctctcaagcaagct

SEQ ID NO: 90433 - DNA, 670 bp, Oryza sativa
ttttgagttgatatttccaccttcatttttcaatataatgacgcatctgctttatcaccttgtgaaagagatccgtattctcgggcatgtgtacctacacaacatgtttcctttcgagaggtacatgggcgttctgaagaagtatgtttgtaaccgtgctcgtccagaggcaagcatcgccaagggttatggaacagaggaggtcatcgaattttgcatagaatttatcgaagaccttcgcccaatcggggtacgtgaatcacgccatgaagggagactacggggaaagggaactctcggaagaaaagcaataatgacggtagacaacaatttattccgtaaagcccatttcactgttctgcaacactcttcattggtagctccttacatcgaggagcacttggctcaatgggtacacattctacacgagagcccaagacatgaagagcacgaaccaaaacagcgttgttcgtgtcgatgccatgggacacgatggaacaactggcacgtattacgatgccatcgaggatatatgggaacttgactatggtcctctcaaggttcctctgttctagtgccaatgggttaggttgactggtggaggcgtaatgattgatgacagtggtatgacaactgttgaccttaacaaggttggatactcggacgaacc

SEQ ID NO: 90434 - DNA, 654 bp, Oryza sativa
caataaacctgtaaattttggaacattttgcagcaacaaatacactgacgaagaaagcagtgctggagtgtaagtgggctgacccaccaactcacttattcgccaaataagtgggtaaccagttgatcgatccacttaattagcttataagtgagttcacgggtcaatccgcttacacgcctgtgcatatatgatagtctgcaattttatttttttttttgaagattttgcagcaatgaatacactgaagaagaaagcagtgcacatatgctggtctgcaattgttttctgaagattttgcattagcaacgacactgaacatattttggtcagaagaattttcagcttaccaatcttggtacgttccgatgagccctcgctcgtagatcacgccgagcgtgttggcaacggcggccgtcggcacgacgttcatcacccagacaggatcgtcgacgagcgccgccgcgaagccgccgaggccggcgttcatgtccagcagattccggtaccggcctttctcggccagcccgccgctgacgcccttgtagcgatcgactcgtctcctccacatctcagaatccttgataaaggtgtccaccgtgacgctgcttccaaggctgccgccggcgatcctcggcggcggcgatgtaagcc

SEQ ID NO: 90435 - DNA, 637 bp, Oryza sativa
gtcaacttggtggcttccaaatcaaattaagcacaagtttgattttgcaggggtgaaatttgaggtggtggagttacaaagcacgtactgtacttgctccaggggatgaggcagcgggagcagtgcgccatgtcgaaggcgcgagccgggtaaggaaggcgcttggtggccatgatgccgagcatggccgggacgccgcgctccagggcgaagagcacctgcgcctcgtgcgtgtccttgggcgcgaacgacatcgtcagcacgtcgcgcgacagcaggtacgctccccagctcgcgacctgcacatgtggttcgttcacacttcagagttcagagtagtagacagtgcacattagcatcagattgatttgtcaattgtcatagcaaagaagacacggatattaggaaatgacctaatatcaaataattagaagaggtgaagctctgaacccagtcgtctagcccaccaccctgtggagctagccggaaaacccctgggcatttctcatcaattgtcatagccaacagcttgactcatgcatgagtgtttcccgagtaaggatgatttgtctgatgaaaaaactttgtttacgagaaatcttatttgacgcgttttatacaaccgggctgcaggaat

SEQ ID NO: 90436 - DNA, 1191 bp, Oryza sativa
cgttcataacagagctacaccagggggaagcatcattgaaggtaacacgaccgcggaagccattgagtcttatatcgattacatggccgagactgatcctatcaaagtttcctacgtctcaccaccaccgttggtatgcggtgtcagcacaactgacagaaaaagaattgttcccaatcaagtttcctacgcgcaggctcatttcgcagtgctgcaacatatggctgaagtaaccccatactttgaggagcatttagcgaaggtccgacaggacaatattggtcgatcagatatttggatcaacagagaacatggtgctcgcttcaacgaatggatcaaggatcgtgtagcacagtcgaccgatggcccaagtgagatattacaaaggttggcaaggggtccatcttgggatgttgacacatggcaagggtacgatatcaatggatacacattttacaccatcacacaagatgagaaaagcacagtgcaaaacaatggagtccgtatagatgcatatcaggatcaggctcgatcgagcacatactacggccgcatagagcagatatgggcgctgaaatatctgaaattcaaagtccctttgtttcgttgcagttgggtgacaaggtcgacaaggaaggcttcacattagtggacctggccaaggttggatacgcagacgaaccattcgtattagcaaagcaggtcgaacagattttctacataaaagacctcgcaaacaagaagatgcacgtcgttagggatggcaagcgaagaattgtgggggtggacaacgtcgtcgatgaagaagaatacgaccagaatcttcatgttagacctcagatcgaccttgatgatgatcccgaagacgaagtggcttacgttcgttcggaccattcggaaggcatatcactgtgaatgatgtatttaatttgtattggagccttaatgaatgaattgcatatgtttcatgccattccagttaaaactctttgaagaaatggatttgttaattatgtggttttaaaaaattatactggttattttaaactatatgtgagatagcctattgttaattatatgaatttaaaaaagtaatatgaattttaaactatatgtgaaaaaggcatttgtcaattagatgattttaaaaaaattaataggatttttaaactatatgtgagaaaggcaatt

SEQ ID NO: 90437 - DNA, 1057 bp, Oryza sativa
tgcttggcatccataatgtgttctacgtctctcagttgaagaaatgtttgagagttcctgaggaacaggcaagtccggatcacatcgaaatccaagaagacttgacgtatgtggagaagccgactcgtatcctcgaaactagtgagagaaggtccaggaacaaggcaatcagattctgcaaagttcagtggagccaccactcagaggaagaggccacttggaaaagagaagatgagttgaatgccgcccatccgcaccttttcgccagctcttccgaatctcggggttaagattccgtttaaggggggtaggtttgtcacgccctgaagttttccccttcttctttctttaaaaattgggttaaataaatcgtccgaagaagttgttctaattaacctagagttaaatccctaattaataaatgcaattcataattggagtcggcgtggtagaatttttcttgagttccccatgctgcaatacattaacaggatttttagtggaattttcagagccctataagtaattttaaccaattaaaattcattaaccgcaatatttaatcccaggaaaatccttttcctttttctcttttcttttcctccctttttcctttgttgggccatcggcccaaccttccttcctcccgcgcgctctctcccaccttgccgggccggcccattgcccctctcctccctccgggtcaccgataggtggggcccaactgtcggccccgtcttcttcctctggccgcctgcgcccggccggcaaccgccgctcccacgtcgccgtctgtgtctcccgcgcccactccgcgtccacgcgccgcgcccacatcgtcgtccgccgctcctccgcttttcccgcttgcgcgcacgcccgcaaatgggcgggattcgatttgaatcacatcccctctctctctctccactcccccacatcgccggccaaatcggccacctccccggccacgtccgcccctcccccgcccataaaaaccctcccccgggccccctctctcgtttcccactctcgccgccctttctcgtgcttccta

SEQ ID NO: 90438 - DNA, 953 bp, Oryza sativa
ttcttcgtctaacgcgtcctaactataccctaggtcgaactgaatgctgagagacaggcctcccaagaggtctgctcgcaaaaacgcgaggatgacatcctcacaaaagcgttgggaaacggagaacaccggggacgaacaaggggcattggttccaatgttccatggaagtttgggtttccccaatatgcgtggcattacaagaagcacaagctttccaaggcgcagaaagctgcacgcattaaggcccaaattcgggaggagcttaaagaagagcttagagaagagttcaccgccgagctgttaggtatggaggctcggatggaggcacgcatcagggataggtcgatcgatgccactcccggtcccatagtacaagtgagacccacgcagaggcgtagcagctgcgcatcaactgaggctccggcagaacagcctaaaggccccgccgcggtggaccacataccggtaaaaacaacttaataacgcatatattgtattagcaccacaatacattgcaacatatactaaggacactaatgaatctatcgcaggaaccgacatcgtgtaccctagtcgattgggtgacaccaggatttgcaattcctgccatagagggtcaagcattcaagcctacaccggagacccgagtgtatggggcgcagctgcaagccggcaatgccaaagttcaggtggacttagtgaagcccgattgggttggctacactatcccacactcacctaatgacgagattctgatccttggggctgcacgtgggactttattcaatggcccaagcacagcattgagatcaatataactccaaggctagcgccaagttctcgtccgccgccgacgcatccccatcaaactgttgtatctctccctcctgccgttgaacaaagagatgaagatctccaatgtcacgcccaaaaatttaagaaccagaatt

SEQ ID NO: 90439 - DNA, 1639 bp, Oryza sativa
tacttgaaaagttaaaagagcaccaactatatgccaatttcagcaagtgtgacttctggcttaaagaagttcagtttctcggtcacgtcgtgaatgctcgaggagtagctgtggatccagcaaatgtggagtcagttaccaagtggaccccaccaaggacagtcactcagattcggagttttctgggacttgcgggctattaccgccggtttattgagaacttctctaaaattgccaagccaatgacccagctattgaagaaggaagaaaagtttatttggtctgctgaatgcaataggagttttgaagaactcaaatgacgattggtgtctgcaccagtgttaattctgcctgatcagacgaaagatttccaggtttattgtgatgcatctcgccaggggctaggatgtgtgttgatgcaagatagcagagtggttacttatgcttcacggcagttgtgtcctcatgaaggcaactacccgacccacaatctggaattggccacagttgttcatgctttaaagatctggcggcactatctcatcggtaaccgttgtgaggcatatatagatcacaaaagtctaaagtacatcttcactcaacctgatttgaatctccgacaacgaagatggttggagctaataaaagattatcatatggaatacactaccatcccggcaaggctaatgtggttgcagatgccttgagcaagaagagctactgcaatgttgcatgggtagagaaattatgttgtgaggttcaacgtgatttggaacacctgaaccttagtatagttgagcacggaatcgtggctgccctagagacacaacccacactggtggagcaggttcgcatagctcaggcaagcgatcctgagatagcagaactcaaaaagaacatgagggttggaaaggcccgaggttttgttgaggacgaacaaggaacaatctagatgggagaaagattatgtgtacctgaaaacaaggagtaaaagacctgatactgacagaagctcatcaaactcagtattccattcatcctggcagtaccaaaatgtaccaagacctcaaaaaaaagttctggtgggtcagcatgagaagggaaatagctgaatttgtcgcactctgtgacgtttgccagcgagtaaaagcagagcaccaaaggccagcaggtttgctacagccccttcagattccagaatggaaatgggaagaaatcggaatggatttcattacgggtttgcctaggacatcatcagggcacgattctatttgggtagtcgttgatcggctcaccaaagtggctcacttcattccggtgcatactacctactcagggaagaagttagcagaactttacttggcaagagtcatgtgtctacatggtgtacctaagaagatcgtgtctgatcgagaaagtcaattcacttcaaagttctggcagaaattgcaagaggaattgggaacccgtttgaacttcagcacagcctaccatccgcagactgatggccagactgagcgagttaattaaatattggaggatatgttgagagcctgtgcacttgattttggtggagcatgggacaaaagcttgccgtatgctgagttcttttacaacaacagttaccaggctagtctgc

SEQ ID NO: 90440 - DNA, 691 bp, Oryza sativa
tcgcttacatatgtgtttctaaaatagaagttaatgcattaacattatttaaattacaaagattaatgacaattacttcgaaaaattattttgtctgtaataaattaagtggataaatcgtaataagcaaatatatgacttaaaattaataaaaattccaataatcatatatacttagcatatgaatgatattattaaattggtaaaaactctaattaagatttgtatgtacatactgcatgatttaaaattaataaaaattgtaatcatcatatatacttagcgtaggaattatattaaattaaatgttaaaaactctaattaacatatgtaaatgccacatgcatgatttaaaccttttaaaaattcgaatagtcatatataagtagcctatgaaagatagtaaattaaattgtgaaaaactctaattaacatctgtaaatgccacatgaatgatttaatacttttaaaaattctctagttaattataattagcatatgaatgatattcaattaaatgtagcatatgaatgatagtaaattatgccatacatcaattgatttatatggataatcaatacatccaaaatagtttatatcgtgtacacaataattacggcattacatcggcggtgacggttgaccgcacatactttctcctcactattgttccctccttgtgatcgctgcg

SEQ ID NO: 90441 - DNA, 3475 bp, Oryza sativa
  unsure (1)..(3475): unsure at all n locations
ctcatccggtggtccaaaatctgcaagatttggggatacaatttctgtgggcaggaggttagcaaatctatatatttttttttcagggctacatgcagaaggtctagtaccgacataaaggcagaacacactgttaccggtgttacaaaccttcaatgaatccatatatccagccaggtgacaaagatcatcgagatcatcaagactagtggtggcacctgtagacggggctgcacgggcggagttggggttgggagtagggcgcaccgcgcacgagcggcgcactgaccacgaaggcaacctgcattgtccttgacgaggagtttgtggccgacgttcctgttgctgccctgcagaatcctcttgtacagcggtgggcagctccccgactccgccgcctccgtctcctgcaggctcaggtcctccacgcggcggatgcgcaagccgatcgtggcgccagcgctgccataatcctccgttttatattataagactttctaacattgtctacattcatatatatatatatatatatatttggtaggaagctaaacacttaattttactaaataatagtatggtttaaaatagcatcaatcttaataggaccataaatcagttggcaagctagaaaatagataatgaactatagtatgtcttgctgcaatccacagagacattctgctactcatatgctcttaagtgataattaattagttgctataattagttgttgatatataatggagtaccgtctatcataggagtatggaggcgtacttgaattagttggcaataatcaatatccgaccgcgtcggcaggccgaacgctgcaggctctcgcagcatgtgaagctccaggacaactggacaagactcacaagagtgaccaccggcagagctcgcgtcgcgcacttctgcatgattgcattgcatccggagatcgattttgctaaacatctcccgcgtgatttttttcctggcatttagatgaccatatgccccgaggcccgacagcccggcccaaagcacagccatttggcctggcccaagcatggcatggtccgactggtgtcgggcctgtgctggtatgacctgacagttgggccgtgtctgggccgatgccttggcacggtggccggcatgacacggcacgatcgaagaaaaatagtagacagacctaaaatatagacttaattaaccatataaggcaaggtccaaagaaaagaggaatacgaaaaaggcttttttttcagccatatatacacatcccaaagaattgagggatgcaaaatagacttattatgtggagaagcacgatgggttgtcgtgcctttgggccggcacgtcacgacccgagtcttattgggccgtgcctgggccatgtgtgcagcccgtgggctagcacaacatggcccgacgtgtaggtcgggctgtgccggcccgactgacctcggcccaggcggccatttggccatctatagtatacggtgtgagggcacaaaccctttgtccacatcggctaggggcggcggctgccctcgtcgcccatcggttgctcgtcgtccgtcgctgcgcttgtgaccaactcgtatatacgtgactcgcgctcaccggtgctcctccaggcctcccggtggctagagtaagcgagcaactaactcagagagaaagagaggggagagaaaggagagggaagtggagaaagaaaatgagatgatataagaatcacttacatgttggtcccatgttgtgatgttgatgccacgttagccaggggcgaagccaagatttatggttagaggggtgtgggcagggcgaacaagtgataaatcagagtaagcaatactgatgataaaacaagacatcatgtattctgccctaaaaaagcttgaatttagctttttagttgtatcgttggatgtttgatagtttgaaacttgagacaccatgctcgacagcgagatgcaatgggaggacggagagacgtgtgaagccgaagcaatgaagacgaggagttgatttgcgttgtctctccgtctctttcttattaattaattttctaaccatatttattcatcatggactaattaacatgctaatgcgctagttagtatagaggggggttggatagggtgttggctctccagcaccccgcgtagctgtgcccatgaggttagcgaaaaccactctagaaacaggtgagggagtcattttgcacggtttcaatggttagagggatcaatataccctattttttggttgagggtacaaatcaaatccgaactatattcgaaggatcaaattgcatttttttcccactaattagctcggcctatcataatggcaaaagggcttggcccatacgctttttactccaggccccgggccacagcctagctaaggtgtacgggtcaggatcggatccactcctgcacatagcgacactagtgcgctgtagcttccgtttaggctctacggtggattaagtttttgccacgcccagaaattcacaaaccagaatttctaagctgaatgtgcattaaacccctatccagaaccagccagggtacacaaacgacaattgttgacatacagatccacgttttacaaaaatataaaaagattacaaatacagtggaaaaagtgaaagcgagctaagcctgaagacttgactcctgcagcgaggcgactccactccacaggcatccttgacggcagcgacaaaaccaacttcttcaagatggctccaactgggaagaacttcaactntggtgtggagaagagagagtaagactgagtactaccaactgtactcagcaagtcataccggaagaggaggtataatgcaagatataaccaaaggaggctacaggtttatttgcataaagcaggcatttaaaagtagtagtcaaaagcagtaaaacagttgtagtaattaatcaatattaaccaatcactatccaacgctacaccacgttgcaataggcccaactaaccacctgaactacaccagttcattagctaacaaggtgagactaatcacggtgaatctggtcaaccgcccataaccgcgggcacggctattcgaatagttttactctgatcagaggtgtacaactgtacccacaagacacagccccatgacacgttcccgtgcaccgacatgctaccacgacataccggaaagaggccgtgacaggacccttcgcataatcccctctaaccgatcgcaccacacctcagggttcgccccgtccccagcaggcaatgggtagcccccctctcgtgccatggtgaatccgaaagccgatcaaccgaacaccccgaccgacccaactccatcatgcctatcctaacctgagtacgtcggctagaggaaagctacactacaagctcagtcgtagtccacgctgacttgtggtaagtacgataaattcttccagggcatcccgcgaaccggtccttaattgct

SEQ ID NO: 90442 - DNA, 2263 bp, Oryza sativa
tccgaaatctgagatttttgcattcattgaagcatctagcagaatgttgttgaccttaatgtctctatgaacgatgcatgtattctgttttgctaatctgtggaggtagagaagcccctggctatgctatcaattacacggaggcgtgtagaccaatctagcagccgggattttctttcgggatctgcaagtttaatcttttcaaataatatctgaacatataactaataaaatatcgggaaaatatggatagattttagaaatcactcagtttaagtgttttcaataattaagatatatacacgcgcgctgacaaattaaaggcaaaatagtcattttagaaaaaaaatcaaactattaattcacggttaaccaacagaaaatgaatatataagtgatcaaaatgaatatatatgtaggtaacaaggcaaaatttagtggagtagaaaggattgagtgaaaacacatgatcttataaggatttttcttttcgtaatataagggttgggaacttgggatatatataccagaaaacacatcatccaagcttccgttctccatgtactcatagatgagtatgttttcttcgttttggatgcagaaacctagaagcctaactaggttcctgtgttgaagagttgccataagtttaatctcgttcataaattggtcaaaaccttggccagatgaagataccgcgagtctttttactgctacatcagttccgcttggtagtttaccctaaaaatatatgatggcaaaacacataaatttagtacatcagtccaaatttaagtctaaacaataataatcagatccttgcgattagcacagttactagtcatctgcgtcgtaagcgtattctatttacccatgctagccaaatgcccgtgctttactacggattaaaacaaattaatagtgaggttttttggacaattttgtacctatagatgttatattgtacaggtgaaatatgatagaatcatatatatgtagatgtgttattttataacataaaagtacatgggtagctagtagaaagcatgatgggtagatggtaaataaaaaaatactatacttggtgaggccaccaccattgccttattttaagggtgtgtttagttcacaccaaactttcccctaactcccaactttccatcacatcacatcatatccaaaactttcctacacacataaattctcaactttttttttcaaactaccaactttccacaaacttctccccaatttcagaaactaaacacagcctaagaagagtatagatgagactatatccggacagtttagcatttgaccacatgataatttgtactccctgctgtcatataaatatataacattaatttaacataattcttttcacaccttcaaattatacaactttgttcacaagttatatacagtaagtatataaaatatggtaagtttatgatattatgacaatattgatgctgggagtactaaataaacttaatgccacccaatgtcaaatattgttgagtggattcgggtaaaaaagaacatattgtcgaatggagggatcagtgctagctatttactgcaaaagattcagaaaagggagtatataataggtcaattggatgtttatagataagacatgtcgttacatctaatcaaattaccttgtaaacatggccaaaacctccttttccgatttcatttgagaaatcacgtgtagcttcttttatctgttgtaaagtatagcgtgaaaagagcggtccaatctcgtctatgatctcagtctcaagttttgctagtttcttttgccgttctgactcttgaattactacatgtacaggtcgaaatcacagggaaatattaattaaacgtaaaaaatcagaacctgcttaagaattagatcggtattataattaaggccatcgcaacaacttaatcacaccttctcttagtcttttgagcaatgcaagtataatcaaggagaaaattagaataacgaaggctactactccaaggacgattccgacgatcttccctgcgctcaatgaacctgcaaatgcaagcaatgtgatagaattatagcatgtaggtgcaaattaatcaccctctctattttatattacaagcaattttaacttttttcccagtcaagttttcccagttttataaaataaatatagtaatattttcactacaaaacaaatatattatttgttgtaaatgtttttctattaatttttctataaatttgttcaaatct

SEQ ID NO: 90443 - DNA, 684 bp, Oryza sativa
ttgatgcacgtggttggtgaagattccatatggcatacgatggaggtattgtgtgcgtatgggatgtggagtcgaatttggaaggagtccaaatttggtatgattggttatataaagtttgtttcttgtactagagggtttcctatggggattaggacttctagtatgagtttggttcgtggctttaggctgcctacctcatgtataaatagagggggagcgtgaggcttcctggtatcgcttttaagagcaattgagttgctagtttagttagggtttcgagtttagtcgagattttgtaaggagtgctgttgttgcactttgtaaacacagagagaatcaataaagttgtcatctactttaagagttcttcgatttgtgtttcaccgggtttcagcggtctaaccgacgactcactggcggtcagaccggcggcatacgggcggtcagactggcggcggcgacagcgagcggcagctgatctcggcggtcagaccggagatctaatctcggtcaaaccgatggcaaccaggcgatcagactgacaggacaacttcggttagaccacgatccgtcgaatttgagggtaacttttatttccgctaaaagttttcggtttttgggtatacctaccattcaccctcctctggttggcttagttcttgtgtttcgatcctacattta

SEQ ID NO: 90444 - DNA, 2045 bp, Oryza sativa
gggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgacgaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacatcctcttgcatgttgagttcgtagctcgatacccggaactctaggtctgcaatcttcgcctcggtatctctcttgctcctcatccgactcctgtacgtgtggatgtcctccttgaaaacaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgctcagcctcttttatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtcta

SEQ ID NO: 90445 - DNA, 3414 bp, Oryza sativa
ccatcttccgagaccgtaaagcctgccgccctgcagcgcctggcacgatgcgtaaggagcccatggcctcccggtgcaactccggctcctactaccgtgaggtactggacggcatcgaccctcgcttttctcacctcaccggcggtgccatcgtgaattctctgaccattggggtctcctggccacccagccatgacctatggaatcaccccttgtccgcctccatctccagctgccatgactgcttgcttgtgctctactttggcaactaccgtcccgggatctcttcgccagggtgttactttgtgctcaacacctgggccaactcggtcgctatcgtcccgcctctgcgcgccacctgcgtcatcaccatgtcgcactgcggcattgggaccggggtcgccatcctacgccataacgactactacgactatgtcctcgttgagctcttcccccatcaggacagccggacccacctcgcctccaacaaagccactcttttcttgtggtggtctcctagctctagcccgctcgccgatggccagtggatacggaaagaggtgctgctccccatccctgcaacttccaatcaagataaggacgacgcgacacggccgcccacctactcctttcgtgaaaacatggtgttcgctgtttcgaccacctcgcttttgctgggttgatcttaggacaggaatcttggtttgcgatattgacaagctcaacaccagcactgacgacgaggatgatcgcttgttgttccgcttcatcccattgcctgaggaatgcgtgatgaagcctggccttctatctcgggagaggccagcggaggagcaccgcaccatgatctgtatggacccggagaccatcctgttcgtctccatggatagctacatccaaggcctccccattggcgatacagtgctcatgacatggactctcaagttcccactcacgaaccactggacctgggagaagcactctgcgccatccttgtgcgtgggagacctcctaaatgatcttccagtcttaaaagaatccaagaatgacgggaagacgcagcacattgccaactgcccggttagtagcattgacaggcaaaaccatcttatcactagcctcactattaccaagtatgagaggaagcatgagaacgggcaatggggagtcgtggaattgtacgaggtcagcattgacatggaccgtagaacggtcttggagttgtcttctctcgaaagtcgccattcaaatatatttgcagctgactttagttgctgcttacaacaggtacccctctttgatatgtccatttaaagtgtatattattttgatacgggcaactcttggaaagtaaatttagcctttaatttctcttacattgtattgttggttggtagaaaatcatcattgtggaagcactttgaaaaaaaaatgataatggtactatgtaagcatgcttataatttgcttacgaagtttacattttcaaactgaacacgactcgtaaaagtggacaggcggtggacaggtcccgaatttcttgtactgctgtagttcactagttaaaagtttgatgtttgatctaaattagacaaatttgttgaactacttgctaatggggaaaaaccaaccggtgcagtgagcatagaactaggaaaatttgtcctcgatttgaaaatgttggtgatgggaatgatgaaagcatatccacagttcatctgcttggacgaccaatattttcgattagtagttcttctactcaaaattaatattaggagtaatattttatcaatctgatctattagtttgtgcgggtatagtaaatttaaattcctaaacatcaaatgagaagccgagccttaaaattaaagagcaccacagatttgctggcacaattaataagcaaacacctctttttttgtgttttctttagcatcagggtgatctccacatcgtcgaccgcattaacagtttgatcttccccttttttccccttctatttctgatattgcccgaactttttctcttttatgaattttctttcttcgagacaatgtcgtgggaaagcttacagcggagtcgctcaacattgaagtcgcctaacgaggaagaagtggttgataaggatgatgaatattgggagtgggtgttccccgatgaagtgggtgaggatgaatatcaacatggcccagacctgtcatgttaattttgcgccaagatggaatcagaatatcaactctttatggttagaacttggaactttcaaaaggtagtgggtttgaaatgtgcgccggattatcttgagatctaggtttattatattagttatgttacaaggaaatcccctcttttgtgaggaggaaactctctatctcgagaacttttcttttcctttttttacataaaaattttgtacagaaacaagtctgtcatctcagctaataaaaaaaagatattgaaaatgaagtgagtttcaagtggattttaattgaagaacggtacttttcaaataaccgccaaaacatgtttagtccctgtattagtaggtcagatcagtatttcataaattatccgttaaaatctactatgtcaaagctccagccatctttaaaagtttatgattcaagttgtcagcctaccccaggtgggttggaatttaaaacctgtttggttaaaaccaggtggggttggaatttactacgctgaacaacatctgcctgaccggatgcatgccggagatacgcctgcacctgcctgacctgagcttgttcggcgacttcatcattagcctggctcagatgcacgaaatgggtggccggagctaaggcgtcttgctaatcacgattacagcaacaatcgcgcgcgattactcaccacgggcacgaaccgctgcaccagtacgcgcgtgaggctctagctcgtcgaccaccaccacccagtgtcccagtcccaagcaagagaccacagatgatttgaggaatagaccgaggattagaaaaggattgcattatgttgatgggggattaacggagttaatcacttctttacctaaacacacgtcttttttactactgattttgtcaggcacgtttagtccaggccttcaatcgaacataagcaaactcaggatatgcctcatctggcaaaaagcataaaaaaatcagaagtctcaggcacaacttttgcgcaggcatatcaaaccggaaaagtccacttggaatcccttaactagcggccaaatcttattaagattcctaaaccatagtatcggatatcttgaaccaaaaaataaaaaataaaatagacggttttgaagaacggtttcatgacatggagcatacatggcagtgtttacttgtcttcgtcccacatgacgtttatgtgatactagtaatagtgcagggctgcaggaat

SEQ ID NO: 90446 - DNA, 4729 bp, Oryza sativa
  unsure (1)..(4729): unsure at all n locations
gtgggaaatgctagaatgacttacattgtaaaacggagggagtactagttagtatacacagtgaaaatggtaagtaagtaacaagtactaggtaatatgcttattacctagttataaggaataaataaataatttctctcatcttttctcatggctagtgactgtggggtctagcttaccgtccacttttattctttcactaactattatgattacaacaataactaatacctattgacatagagcttacccttattcataaaataggtagtaaatattggtgatttccttataaaaccatatattaacactatgattctgtgatctgaatgtgatcagaagattataggatggacctggtcgcgctagcgagtggacacgttcatctacggctatccattatgttaatctgttccccacgaagtaagaacaatatcaagcgccttgtttagagncatgtttaatagaataagccaactactaggctccgaattcattctataactaatgtaatagtcaatttcatacaataattacctactatactattaatatttggtcccacctgtcatatacacattacgtcttagagtccgtgctgcagctggctacacatctgtagcatgctgctcttctctctcttcttttatttttttaatatataagtttattgctggcttatagtctactattgtatctgctcttagttgggggaaatttttgggtttggtagtcacatcgaatatacagacacatatttgaaatattaaacgtagtttaataacaaaataaattcagattccgccagaaaactgcgagacgaatttattaagcctaattaatctgtcattagtaaatatttactgtcgcactacattgtcgaatcatgtcgcaattaggcttaaaagattcatctcgcaatttacatgcaatctgtgcaataagtttaatgactacatttaatactccatacatgtgtccaaacattcgatgtgacagcgtgaaaatttttgttttggaactaaacagggcctaactagatttttttttgaaaggagggcaaaagctttgcctcgtatattaatagaggagcaggaaaacaagagaaaatatgtacagggtcagccaaaagccaacccgcaaacggaaaaagttgtctcccaaaattccaaactcctgtagctttgttgctctggctttaacccaggctctcccttcctcttttatttttgctataactgaggcaggggtggaggctgtgctccgaaagattcttgcattacgctccccccaaatctcccaggacacaagcatcagcagagttcgcagaggggctcgtggagtattaggggattcagcaataaggttccaccaaagtttgacggaggggcagtcattccatttactcaattggaggtcagtttgtgtccattgttggatttcggcccagattctcttagtgactctacatttggccagtaggtgcagggctgactcatccgttacacagcacagggggtagatcttttgattttgccagcctcttttccccaatctatccgccgtccaaagtctgttctgggtagcaagccaagagaagaatttgcattttggcggcgcccatgctttccagattgattggtagaagcagatcttgccgctcccatgaattgcagcctatatgccgatcttgttgagtatttcccattcgccgttagattccaacgaatgctatcttgttcttcattcaacggggcattcttctaaccatggaccatagatggacaaactggcgtaagtgctccgcttctgtaatgcggaggatgtcgatatcttggatccaattattattctatatggcgtcatgcaccgttctattcttccgtttagaggctaagaaaatgttgggtgcaattttctggggcatctgattttccagccatctcgaatcccagaatcgcgccgttttgccgttgccaactgttatggttgttgccgccgagaagagttctttatcttgaaggctacaaggaactgacatccccacccacggtttgtcaggggctacccattcgttccaaagccatcttaggcgtaaggcggacgtgaaacgctgtagatccattactcccaggccacctagatcttttggccgacatacccttttccagttgactttgcatttgccgtcggaaatactttcacccccagcccagaggaacttcctcctgattttgtcaatgtccttgagggtatcatcgggtagtttcagagatgttaagtggtagattggttgtgccgtgaggactgacttcgttaagcagatcctagcagcagatgacattagcctcccttgccagggggctagtctggactggcacttgtctatcagcggctgaatgtggacctttttcaatctacctaccactaggggtagcccgaggtatttcattgggaagttgtcaaagctgccgggaagatgctcgtgacatcagtaaggtcaatgttcccacaacgaatgggggcaatctggcttttgctcatgtttgttcgaagacctgaaactcctccgaaagctcgcaatatttctgttagattcgtcatatcttgtacactagggtttacaaagatggccgcatcatcagcataaagggaggttctgaatcttggtgctctgccgcgcaaagtagaaagtagcccaaggtttgttgctttctccagtaggtgatggaaagggtcaatggccagaataaagagcaagggcgacagaggatctccttgtctgagtcctctaccatgctttattggaattcctgggcaaccattaagaagagcccttgacgttgaggagattagcagatttgtgatccagtttgtccatctggttgtgaatcctcttcgttgaagaaggtcaatgaggtagtcccatctaaccgaatcaaaagccttggagatgtctaatttgagcagcaacgctggtgttcttgtttggtggaattttcttgccagattccgaacgtacataaagttatcgtgaatgctcctttttttaatgaaagcactctgagcctggcttatcaaggagcccatgtggggttggaggcgaagagcaagaacttttgagattagctttccgatgccatgaatgaggctgattggcctgaagtcgcctatgccttcagctccttccttttttgggacaagcaccacattagccgagttcagaatctgaaggttgttgcttcgcaattggtcgaaggagtgaattactaacatgatgtcctctttgatcgtgccccatcaagctttatagaaggctcctgtgaaatcatccggcccaggtgctttatccccaggcaattgttttaaggcagcaagcacctcctcttcggtgatgggcccgttaatcattgccaagtctacaggtggcaactgcagggcatcccaatcgaagtctaccaggcatggtggcgggcgcgctagaaaagcttcgaagtgatctttaatgatggcgctttttcctcatgcttgaatttccaaatattccccacgcggagccgttgaataaatttttttctccttcgccattcattttaaggtggaaatatttcgtgtttgcatcgccttctttgagattggtgatccttgaagcttgccttttgcgagctctttcaattatagacagtcccatgactctgtccttgaggccccgtcttaggttgagctcagcttgactgagttgtcttgactcttgtgctatatctaactgaaggatgacctcgagggccatgtggaggtgcatctttccttgggagatgagatttctgctccaagctttcagtctaccagctgttgcgcccagcttgtggtagagtctgtgatgaacttcatgatatggagggctcacagcccatgcttgagcaacgatctcctggaaacctggaaggtgaatccagtagttctgaaaacggaaggttctagcgcgcggcgcgtctccttgtcccgataataagagggggcgtgatctgagagcgaagtcgagagcacatggaggaggtgcttctcaaaggcggtatcctaatttgggctacaaaagaaacgatcaagtttgaccagagtcgggttatcttgctcattgctccaggtatatcgacgattttgtagtgtgatctccttgagctcgcaagcgttgagggtttctttaaatattctcaattgtcgcaggttaaggttggcattgtttttatctgaggccttgtaaattatattgaagtcccccactaggagccacttggagtcgtttctaggcttggtgtctcgcaattcttgtaaaaaggcttgtttcgctctatctcttgtgggcccgtataccacggtaaggaggaaagtggtttgacactcttttaggagaacagtggcagtgagggagaaggtgcctaggacgaagttagagaggtcgacggtgtcttcattccagagtaccagtatacctccacgtgttccaaaaggccttgtagctggcttataattgtaagaccgtaggtagctcccaccgagagatccaacaatagctacatcaatattactcatttttgtctcttgcaagtaggcgatgtggggcttccccgtttgcagcgtttctctaaccgttgctcttctacccggtctatttaacccatgaacattccatgtcatgatgtcaactataggggtatgacataattagcaa

SEQ ID NO: 90447 - DNA, 2145 bp, Oryza sativa
cagccccgcagcaaccgttcttcggcagcacatcagagaatcagctttgtcgcacgagtgggaagagggcacgaagaaggtgcggaaatgcggcaccgaagaatcgctagtgggggtagagccacggaattgctgcggaatagggatgtttccccgaatcgaagtgccgtcgctcaggacattcacgcgtgtccattcgtcacgccactacaaagctagcaaatatgaaagatacatggagatatcaatctcctggacatggagcgcagctcccagatcatgtcgccgccgccagttcctccctatagcaggcgtccgtcggccccaggtacttcgcgagcaccgcgtccgccgcctttgcatcctccctattcagaccgaacagctgctcgagggcatcgatggtgtcttgcggcagtggtgcgttgaacatggctttgaagtcagccactactttgtcggtgagagttccttcctccggcgtcaaccccattcggcggcacaggttcagctgtgccttcaaccccgacggcaggccgaccgttggttgctgggctagtcttgaactcctgtgcctgtcctgtcgtggcatgggtggaggcggcgtctgcaggttcacgtcggcacactgcaacggtggcgagggaaggattgaggggtgtggagatttgaagaggacacatggcatcgccggaggtacctgagggaagtcgactgccgaggtagagagcatcggcgtgtgtatcgccgcctcaggttgcacagtgggccccagtgttgcttgcagatcgtcgaccgggtcatttgcagcagcctgtcgcgctggttcagcttgctcggcatttgcaggatcatcaagagcgagggtgtccgtcggcgccacggggctggcagcagcaaaaggagtgacgacaccccctggcgcaacaatggttgctggcgctgacagcttgtcaatggcaatcgcaacccagccgccaggacgagctggcatagggccccttccgcagaggccactgagatggcctcttgtatgcgcgagaagaccctcgccgcgggattgtagctccccaaccagcggaccgggcttcattcccgaacccacggagcagaggcagaggggagagcgatcttggtggctggaattcccccgccatggcaaggccaggagagatgtcgttgtcgcggtcgccacccccgagatgccaggctcctcgcagatgtcgtcctgtctacggcgcccatcacgccgatcattgccgccacggtcacgagctcttggcgaacgcgtgcgctcccgtcggaagtgaacatcaggctcccgcagcccgccgcgtccttgcgcaacgtcacggccatggccgcgctcctcatcgtcatcatcatctcgccgccacccagggccgtgaccggcgccggggtggtcattgttgtatcttcccctgcgttcccggcgtctgtcagcgttgcgccgcacatcccggtcatcacggcgtccatcatggtcctctcgacgcctatcacgatccccgtcgtgctgacgccatccgccatccctggcggcagcttcccttgccgtcctgcttccttggtcgtgtggctccctcgcgagaccggcattgtcctctacgccctccgcccgcccctggcggaaagcataggtcgtcggcgttggggggtggtgagggaagttctcgaagaggcacggcggagcccgttgtccatcaagaacgcccagatgccacggagggagcgtacgtgtcgctagcctgcatgacttcggattgcggaggtccaccgccgccgccgtgtagtcgtgaatctcttcaatatggaacaacaccgggtgcttgacgccttgctgccagtgctccggtggcgtctccgagatggtgactgactcaagtagggggtcacgggtttgacgcgtgattgtcacccacacgcgcttgtcgatgcggctcgggtttggcatccaagcccatagggagatcaccctcgtgtcgccagcgtccacagggtggacgaggtccgtctccactgactccagagtgcaggtcctgctgatgatgcgctcggcgatgtccggcgcccacaggtgcattggcacgccatcgagacagagcttcactctgtacatgaggg

SEQ ID NO: 90448 - DNA, 649 bp, Oryza sativa
gtatacgggcgcacatttaaattattaaacgtaaactaataacaaaacaaattacagactccgcctgtaaactacgagacaaatcgaagcctaattagtccgttattagcaaatgtttactgtagcactacattatcaaatcatggcgtaattaggctcaaaagattcgtctcgcaatttacattcaaactgtgcagttggttttttcgtccacatttaatgctccatgcatgtgtccaaacatttgatgtgactgttgatgcgaaaaacacacactggcctaggagatctgcttaactccagtgcaggtccaaaggttactgagatgtaggcgtgccagtcagtttgaccctacaactgacaagatatgcaaatagtagatcaataagccgatcggctgacaagccgatgttgtagttccagccgatgccgataccagccgatagccgatgctagccgatagcgatagggttctgagctatcggctttatgtccaatgtatagtctgacacttgtctttaataatgatatacaggcaatcgactgatgataatatagtataacaataatataatccagtataaaccaatcggctagcaatacaatatgatagaataagcattgatccgaaggttaaagcataaatcag

SEQ ID NO: 90449 - DNA, 4330 bp, Oryza sativa
  unsure (1)..(4330): unsure at all n locations
atatatatatatatatatatatatatatatatatatatatatatatatatatatatagtttttgggaagtgtacacataggtagcgagcaaacctaattaacccccattacagcaagtacaaaattggtagccaatcttttggggtccctgcacaggggcccccacaaagtccgtgcctacctagtcttgtaacagggaggagtttgcaagcttagctggttctctcctctctcaaatctcgtcaaaacactgcttgccctaaagatggtgaccctagccagccaaaggccacaccatcatccatcaccacaaccacacacacactctctttctctctctacaatgctactaataatcataaggggattacaattaagataggtaatgagagcaactaattatataatagtagggggaggtgttcatgattatctgtactagcgatcgaaacacggtttacgcgtacgtgacgatctgatgatgatcacgcgagaggcgacctgtgtggggcgcccttcctcctgttgttcagtgacagcacgatctgggggaagaacccgccgccgccgccgctcttcttcttcctcgggacatcggccgtcgttggcgccggcgacgtgctccggccgttgttgctggagccgccgccgccgtagtactggtggtggtggtggtggagggggtcttcgaggatggagttgggtgtggtcacctggtggtcgtcgtcgtcgtcggagaggccgncgccgccgccgccgccgccgtcgacgcggaggttctcgaagcgcgggaagccggcggcgaggtctggctcgccggaggagccgccggacatgtaaaggatgttggagaggtcgccgccctgcatcatcacgtgatccacctgcatgccaatgcatgcacaatttatttaacgacacacagtggttgtagttagtagctcactctcacatctctcgtgacaaaatttttcaccggtcacattgaactcaaatgtgttgatacatacacagagtattaaatatagaaaaaaaaactaattacacagattacgtgaaaattatgagacaaatcttttaatactaattgctccatgatccaacaatgtggtactacaataaacatttgctaataacaaattaattaggcttaataaattcgtctcgcagtttacatgcacaatttataatttgttttgttattagtctacgtttgatacttcagatacatgtccgtacatctacgatgtgacacgctaaaactagtcatcctagatctaaacccaaccttattatcattagagttgtgtgtcgttaattaatatttctcaatcgatcgccaattcgccatgacagtaaaaaaattttctggaagatgtgtacagtggctatactacactactgtaccttgcaagagaggcagcagaaatggaagggctcctgcaggatcctgtcacatgtcaagcagatgttgccagagcccttgaacggcctcgactgaggccttggcttcagaaatatcacctttgcgctgttgatcgtgtatggctgaaatcaaattagaaccaacattaataattagctctacataatagtaaaactgaacagattagtttcagagtttttattgccgttcaatttacctgaacaaaggagcagtcgatgagcttgtcgagatcatccaggcgaacaacgtcgttgtacacatacctcctaacctatatacacgtataagcacttcaatgcacagtatacttatacgtacggtaccgtttaattctagtgctagtaaaagaatcttcggacccatcgtttgcaaacaaaaagtaatttgtgaatataacttttatatacgtgttttagacaatataaaagtaaagtttgaaaaataaacttcgatgaaaaaactctcaaaatcagctctaaatttaaggttaaaaatttaaattttagctgataagcataggccattattccattattccatccaaattcaaattttagatgagacccttctagaagttgtaattgttgatgaggtaaaaaaaaattccattattccatccggacgctgagccaggcagggaaaggatagactcccccggtaataattgcgagcctttgaccggcggctcgtcgtcatccacatcgtgggagggagaaacaaaccctaatttaccataccacccctacaccttccacttctctcggtcacacaacccgaggtcacaaatgtaaaaaaaaaaacacctccaaattaaccccatgacactgtaaaaaacagatagagagtgtgtgttactgcctgaacgaatgaacagtatcgtcacggcgaccttggattatacagagccggagcaacagtattggggccttgtttggtaggaggacagggtcttttaccaagcacacatatggtaaaaaaaaaaacagagacactgctacttttttttttactgcatctcgccatggcttctctgtggtctgtagcctgtagtttctgtcactgtgactactgcagctgcgatcttaacagctctggctttgctgagacgatggatggatcgtagctagtatggctagatagacacaggattgcccatccatttatcaaccaaccggcaccgtctatctttgcagggatagagatcaagatcggcatgctttgctattcatggctaaacaatccggataacccaacccatttttgtgctaatagatcaatcttgctcactgctgcagtttggatgtatttaagaattagagcttttgtagttgcaccagactctctctggaaacacacaaattttataaaagtttgacaaaaagaagtggttcattttatgtggtgatcagaagtttttactggttaattataatggagagcaggacacaagggctattgtttgtttaccgctgtcaaaaagagagatggccttttttcatcagaggtgatgactgtgtgtgctggcctttgctgctgctgctgctgctgcaaaatgtaacttttgcaggtggtgaggtgaacagaagagaagagagagcaatgcattgcatatgctttgcacaccggaatggggaagatgtaagatgggactaggcttaattataagactatggttatttcaggcgtatgggactgaggctcgcagtaacttcttgccagagagagactcatttttcacccttcttcccaatttttaaccactccacatttttacttactcatggccccccacccagcagccaaggacagaaaaaaaattagtttggccaaaaaaaatacgccaaaaatttaggggggtttacaccagtgtaaaagaataatggtgtgatttaggtgactaatcagggtgattaaccgaggggtcactttgcaaggagcacaaaacgaaggccggaaaacgacaaggggaagacgaaagatgggcacagggttctaaaagggtcgagagctatagctgcaagtggttaagtgagacaccccatgcgatgcagcttaagcccaagcaccgccgcaattaagcccaaccaaatctaaccaaattatgctagaaatactactgctactagtactcctagtggcacactagcatggtcgctgatgagaggcaattagcaatctttcctctgaaaatgacacaattagcatgtcatggcacatggaagaatcaacaagatcctctagctgcccacatctactggtactagtagaagcaaatcttggaataagccaagacggaaaggctagtgaattaggccaaagctagtgcttttttgttaagtacaagctagtagctgctatacatgcaaaagctaaaatcctagcccacacccccacaaatccactcaattcagcacactgtagcacacccccaacgatttcaaagcagataaataaacttgtaattgaagaatttcaacagactaacacactctcacatcacatgcataatctgaaattctgaatacagttaagatactgcaattaattaacgaagaagatagacatgcatcatatgatgcatgtagctagagatatatgcagtgtatcgaggacatgcatggcatggcaattgggtcgccggcgccggcgccggcgacgaagacggcggattgattacctggaggagagggtggtggcggtgggagggggcgcagtgggggcagatgctggcgcagcagccgaggcagaagatgttcttctcgttcttcttgcggctctcgtgggcgggacacccaacgaagaagctctcctccacgagcccccctacccatccaggcctcatccccatcaaccccttcgtcttcctccaatcctcctcccaat

SEQ ID NO: 90450 - DNA, 1424 bp, Oryza sativa
ttccgtgtggccggaatgtaaacgcgatccccgaggtggatactgacagcgacgtccgccttcttcaaaccgggcacgtgccacgacgacgccctatccaccacactatccacacacacaaaaccgcattactactcgatcgccggcgtcgcggcgccatccgccgcatgcatgcacacgccgccgcagcttcaccggaagcttcgcctcgaccaccaccaccaccaccaccggcccagctcccccgccgccgccgccttcacatgccgcgcgatggcgacatgcgcgcgcgttgcgtacgtgcgggctcgcgccacgaagtcgacggcgagcgcccgatatttcctcgcggaattaatcatcccgcgccgtgcgcgccgtgacccaacgccaacgccgccgccgccccgccgtaccggagcacggtggctgtccacgtggcaccccgcgcggggcccacccaccacctcctctccgcgacgtttcgaggaaggtgaggggtgaggaggcggcggccgctgtcacgggatcggggacgtattcgagacggcgacggtgtcaacgatcctcagccgttgatgtcatgatcggacggctgagatcgtctcccggttcggttggccgtttgaccggtcgccgcgtcgctataaataccgtttcgtttccaccgtttttactccgatattttgcaattcgcgacgcgatccgtctctcgctcgatcgccatggcggccatgagtgacactggctcgagcttggcgcagtgggccgagctgtaccacgacgcgtcggctgctcacggcggcgtggtggcgaacggtgcggcggcggcggcgacgagcccggcgtcgccggcgggatcgacaggcgggagcccgacgcgggcgccgggggtggaggggccgcgcgtggggaagccggcgaggaggcggtccagggcgtcgcggcgcgcgcccgtgacgctgctcaacacggacaccaccaacttccgcgccatggtgcagcagttcaccggcatcccggcgccgcccgcgggcgcgttcgcggggcccggcggcgttccggtcatcaacttcggctccgactacggcttcaccggcgccgtccttcccttctccgaccacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaattaaccaacggttaatcgaagacacatcacaagcaaagaagattcatggaccagttg

SEQ ID NO: 90451 - DNA, 829 bp, Oryza sativa
ccttctcttcctacatactagggcatctgctgttatcaatggcatcagggcttagcgttgacgagagccatgtgcccgatcaaatccaagacccggttgctggagcaaagaaacaaaatcttcaggtcagataaagatagatggaaaaaatacatgcaaggcaccatttggaacacacgagttgcgtatgaaacattcagtttctgcagtaatcaggaaaacgaataggttctgaaaagggctggctaaggcgttatgccattaagtggatgctcacctgtagccccactcgttgtcgtaccaagagacgagcttcatgaaagaagaacttaagccaattccagccttggcatcaaatatgctagacctggaaaatatagataggctttagcaatttttgctcctatgttcaagaaaaacattgcgaagacgaaaatacttacctggtgtcaccaatgaaatcattcgaaacgacgtcctcatctgtgtagcctaaaatacctttcaaagaaccttctgaggcttccctgggaacaaggaccaggacatggttaagtactatgttggattaacaactctccagtccaatcattcgaacaattgcagacaaatgatgacccaaatactaacaaaaaattgagaagttaagccagaaatgattagaaagcatagagcgagaaactgaacagaatataaacaccaacgaaaaaatgagtgcattaagcaatgaagcagcaactaaatgtgctaggacatgacaagaagattgaaggcatacttgatagctgctttcacatcctcataagaagcacttttctcaagacggcat

SEQ ID NO: 90452 - DNA, 671 bp, Oryza sativa
agtccctcgaacttgtcttccaatttgcgcacctcttgtcgatatgccatcatattgtcgtcaatgcaggaccactctttcataacttggttgacaaccaactgtgaatcgcctcgaacaatcagacgctttatccctagggaaattgcaatccgtagtccatgaaggagcgcctcatactcggcaacgttgtgggacgctgaaaaatgtatccaaagcacatagcttaatctttcaccagttggggaaatcaaaaccactcctgctccagtgcccgaaagtcgttttgatccgtcaaaatgcatggtccagtgctccatcttctccgtaggggtatcctcctggcactcggtccactcggcgacaaaatcagctaacgcttgggacttgattgaaattcggggcttgaatgatatgtccaaagacatcaactccaaagcccacttagcaatacgtccgtttgcttcgcggttgtgtagtatgtcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaatagatcggtcgctggactttttggacatggccttcttcctc

SEQ ID NO: 90453 - DNA, 1786 bp, Oryza sativa
ggcaccactgcatcatatgtatactctgtttgtgcactcctatacggagcattcactgggtttcaccctcccatatattttgagacaagtgcaatgataattacatttgtgttgtttgggaagtatcttgaggtgcttgcaaaagggaaaacttctgatgctatcaagaagcttgtagaattggtccctgctactgctcttttgcttctgaaagacaaaggtatatggtaaaattttgtccttcaaaacatatacaattaagtcacagtgccacactcatcacattagttttagaagttatttctgacttgttttaggcaaccgcctgtgttttttttttcatttcatactatcaagttacacaaactcacattgttcttttcaaatgcagaaggaaaatatactgaggagagagaaattgatgcgctattagtccaacctggagacatcttaaaagtgcttcctggttcaaaggttcctgctgatggtgttgttgtgtggggaacaagccatgtcaatgaaagtatgataactggtgaatctgcaccaattcccaaagaagtatctagtgcagtaatcggagggacaatgaacttgcatggtgtccttcatatacaagcaaacaaagtaggatccgagacagttctgagtcagatcatatctctggttgaaactgctcagatgtccaaagcccccattcagaaatttgctgattatgtgagtaacctcccatattcttttctgtgatgtccttcatttgctttgtctgtacttattttaagtgtttaccgtgtactttacatattaactttaaaagcgtcagagcattttttgtgatctatttactatttccgatacttgagaatgttgcaggcaaatgttgtttgtttatgagaatttgattgttcatatgccctcttttaacatcatcattcttatgttgctttctacttctgatgtaaaaagttgtaacttgtttaatctcaaaacattttggctgcttaggagtaccttccagtccaaagtttttccctgtgttaactttagtctttgaccttctatgctttcttaatacaaacatacatgtcttttgtatattcgtgaaaaatttaacagaactcttggaagaatagactagtttcttttatctgtgaaaagctcttgtgtctcctaaatgtgcggtaatgattatagaggcctgttatggggaatgctgacactgcctacattttgctttcaggttgctagcatttttgttccaattgtcatcaccttgtccatgattacattccttgtatggtaattcaacatatactaacacaatttttgagtgatactatgtttgaaacttcaatttttctgacatgtacattggctgctttgtaggtttttatgtggatgggtgggagcatacccaaattcatggatttctggaactagcaactgctttgttttctctctcatgtttgcaatagctgtagttgtgattgcttgcccttgcgcccttggtctggcaacacctactgctgtgatggtggcaactggagttggagctaatcatggagtacttgtgaaggggggagatgcattagagagggctcaaaatgtaaattacgtgatttttgacaaaacaggcacactaacacaaggaaaagcagttgtgacaacagcgaaggttttctcaggatggatcttggggatttcctcacattagtagcatctgcagaggtgaggttgaacttaagttgcttgtatggttcatatcaagctgtagtaaatgtgtttc

SEQ ID NO: 90454 - DNA, 1864 bp, Oryza sativa
ttttacggtctacaaaacacatttataataagagtctgctgcattaaagagaggaaagttcaaattgtcagttggcagtaccttcaacctccttcaaggctgagtccctttgcgcagctagttctactttgtctcttttcaaggcttcaatctgtttctccatttgagccatcctggtagcttgcgctgtttgaaatccaaatgtttgaggatacagctatgacagcataaattaatgggacagatctagaagattaccttttgatgaaccacttagctcgaagtttgaatcctggagctgggcaattcggtcccttaactccttctctgtctttttggcgtactccttggcctcatgcagctggtccctaactgcttcaagagttcccaaatgaggaaccagcttttccaaagttgtagtcttggcctcattgcgaagatggattctctgcatgatggatcatggttcagttctgctaaagagagaacaaagttattaaaggcagtcacccggaagatttacattcacaatgcgagtggcttctccaagtgctttcttcagctggcacacttcctcatcttctttttgacgatttatgacgatgccggcaacttgcgaattctcgtcccaccatttgagtaagataggaggacgggaatcatcagccgcctttatgcgaggaattgtttcttcgtcgtcgcctagtgttcctgatgtatttccaagacattagacgagtaagctgaagttatttaaatcggcatcacttgagaagatgtgttacctgaggatgttcctggctgaacatgagggatttcttcatcgggacctacatccgactggtttccagtcgggggctcttgtgttgttgcggtttcagctgttgccgactggtctccagttggcggctggtcactcggatcggctttgtcatccgaagcatgggcgccagtcggctgactttcggcagtcggctggctttcggcagtcggctggttttcggcagacggctcagcgtctttggataaatttggctctgtcacagccggatcaggatcttttccagttggatctatgtcggatggtttcctgcaaagtgtcctttcgatattcagcgtaatttctatgagagaagcatatcaaagggagatggtaccgagaagtttatacctggaagatgttctaatctttggcatttgacggccagccagttttttcctgggcatggtatgctttgggagtttgttgggcgtgcccttgtccccagatttgttgctgtcatcgccctcgtcgtcattaagcaccagctttctcttgcgaggacctgtctgcccagccggtttggaggtctgaggttgtgggtctgacctgattgtcggccctccacttccctgaatggtgtgctggcgaggagatcggcgctgagcaattgggggatcagatttcatcaatacatattcctgaataagatgcctccatggttagttaactcaacatgaagacaagatactattttggtcataagttgaagatttcagatacatacctgcggaggcggattgaatgcattatatggtacaactggcagctgatgtgagtagctgacgacaatagcatttgagaagattttatacattctctccttcatgattttgaaatccagagagtctggttcttcgcgattaggatcatgcttgccgtcaaactcaaaagctgtacgggatctttctttaattggcgccagtcggcatttgatgaaatgccgagtgatctgctctccttgcaagcctcgttctttgagttttaacatgcgatccaacaattccaaggcttgggcagcttcatctccgattggaagagagt

SEQ ID NO: 90455 - DNA, 682 bp, Oryza sativa
ctgttgaggggtgcggaaaaccggtgtcccttcgacatcttgttggccgatgagatcacgcgctcggcgccctgcttccaaagctcgctgacgtcgatcctcagcctccttcgcgatccgctcacggtcctgctgctcacgccgtagccgttcttgttcttgtgcttgatgctcctcctccagtcggcgacgttcttcggtctcccgggcttggcgttgctcctccgtctcattattggccatgaaaacgccaaagtagagaggggtgtagttgtcatctaggcttccgtcgaagtcgtcgaagtcgtcgaagtcgttgtagcgagaactaaattcgtcgtactccacgatgtcagtaggacgtgagtcgacggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccgtcatcttgatctggtgtcgttggagaagatgcgatctcggccgagtggtttgaagccgactcggttgagatggtcttgaagtagctttcagccgcgttcgggaatcca

SEQ ID NO: 90456 - DNA, 632 bp, Oryza sativa
ttcagtatcagcagcaagtgacgtaaaaccatcacatgctttagggaataataactgcaactacataaaaaatcatgccactttacaagcataccaaaataagaacgttgccgatggaattaattaacagattcagcctctttgttgccacttcacagcctgagaactttgagcctctccaaaacaaatgcaacagctcgtgggatccaatgaattgaagaatagcagattggactacaccataacagcgattaatataaatgcattccgcggtaactatttacaggctaaaggttgtcttttagccacttggcagcaccattagcaatggatctgaaagaattcagtaagcaacatgatcaacaaaagaatgcagaattgcataggatagagaaacaaagaaatcccaatttgtattttcaaacttcaatagaagcaagtatgtatattgagaccgtcagttagcatttttccttctattcatttttggaacaagggttgcactaatcaatattagaagtaaaaatgaatgcaaccaacagagttagacaggctacaacctgctgtaaaggaggtcctgtaacaacagttttacctcattatggatcattcctgaaagagcatattttcaa

SEQ ID NO: 90457 - DNA, 2333 bp, Oryza sativa
atacccccggccccatgtcaccgacaagctgaaatcacttctttctgtcatgttagcttcatccacctggcaagtttctactttatggtttcaaaatttagttgctaacaactgaccattatcaattatcttctgtcagttctgctcaacatactttttcatagatgaagtgctgattcagatgtcatttactcctttcagcctcttatatctggttcagcagtaggtttggaaggacaggtactgctgtttttagtaacacgacgactttgacttatctgttcattttagtgacactcatctgaactttctctaacagctgactgtttatcatcacaacggaagtccatgctaccggtgtctttatccaaacccaccatcgtcgccaacatcgcagagttgttccgataatggtattcttggaattcgtaagtaattatcttctctacgtagcaaaaaaacaccctatgaaaaggcatgtggatcaaattgtgagaaatttctgcatctcaattctaattgtaccaacatgaagaaaatttcggatggagattctcgaatagaattcaataattgagggttcttttatcttgtgttggtgtcttttagtttatgttttctttacattatgtcagtgtgtgctgagtttgttcgtgtgtggactttgtaataattggttgtatctcgttgagcaaaagccggaatgttatttcattatcttaaaaaaaatgaagaaaattaccaactacagtagaatagtagaggaattccataggtataggtatattatcttcataggtacatgtaaatgtacttgtcgtggatgtagaggccggttttctaatatcccatccatattgtctatatgaatgatccaatgtctacatttttgtttgttagttccaggagtaatcggctgccttcaagcattagaggctataaaggttgcaactgctgttggtaaacctctctgtggaagaatgctacacttcgatgcactgtcctctcataccaggatcgtaagtcagttcattatgtccatcgactcaatttcctaaacagcaaccatcagaatcctctgtttcaatctccctgaaaggccataaacggttacacaaactcctgcaggtcaagatcagtaggagttcaccaacttgcaaggtctgtggagaaaatcctgttttcaccaaagaggacttcgtgaacgttgattacgagagcttcacacaatctccaatgtccaaaaatgtatggatcgctctttttgttgggttcttagattgtatcatcggatatctgtgcatggcaatatgacatcaataaatagtgcaaacttcatatgtagtgtaaatctaaaaactatcgtaggatacgcaaatggatggcgtgaacaaatcttagacgtccatttatatatcatgtggtagttttcaggtttgcactacacacgaagtttgcacaattgcactgtgtattttccctggcatcactcctaatcactctctgtttgaactgatgatgattgcagtcgacgacgcggagcctgaatcttctcccggagaacgcccgggtgagctgcagagactacaagaaggtgctcgacagcggcaggccgcacctgctggtggacgtgcggccgtcgcaccattttcagatagcgtccatggctcactccatcaacgtcccgctctcgctgctggaggagaagctgccactgctgcgggactcggcgagggaagtgtcgtcgcggcgcgacgggcggcagcactgccctgtgtacgtcatctgccggcgaggcaatgactcccaggtcgccgtgcagatcctccgcgagaatgggttcctgtatgcgagcgacgtcgccggtgggtttgagtcctgggccaaggaagtcgaccccagcttccttctctactagccagatgctttacatagttgatagttgcaacttgcaagtaacttgtactagagattagagaaaaggacatatgtagttgccttgaaggttcaaacatgagtcaggtgcctaatgttaaatgtaatccatttccagtgtataaaagaaaaaaaaatgaaggctcaaatagatgtgattgataatatgattgtatttaccactcctcttaataaaaaaatgtgcgtctcgcgtattccaaaaaaaaaagataatatgattgtatttagatcatgagaaattcacatgagtctgtcagacattgaaatggggtgtaaaatttttgttcctggagatcaagttcaaacaaatgagataccataaccaggtcaaggtttacctttgatatctgcctcattggtcgtgtgttagaggcgta

SEQ ID NO: 90458 - DNA, 609 bp, Oryza sativa
gtttgctttgtatgatggagaagaaacatcagcatgctatgcttgcaagtatcgttcacatagtaaatggagattgggcttctcttgtttatgatttgactgcaatggatgttgttccaccaagaactaatctacgccgagtgacaatggtaattcatcaaaatgcagaatatttatttatatggttattacaagatggaaaaaaacaaaggttcttatctcatactccctccgtcccaaaatataagggattttggatggatgggacacatcctacttttacaaatctggaaagggagcttgtagtgttatttagtttgttattccattattatttttaatgtttgttgattggtaggacttggaggatgcgttgggtgaggtgacctttgaagatggaattccagatatcaagtttagcagggtgtgtagctttccctctttaagttcagttataaactgcggcatgtctctctctttatcggcatcttcctgaactgttaaaaacatcctttacgtgcttggaaaaatatggtctgtggcatttaaataccacttccgtatgccgcctgactacacgctcgtcctgaggtcacttgcctctttgga

SEQ ID NO: 90459 - DNA, 646 bp, Oryza sativa
acttggtcatgacggcgcagcagcgcctaggcgccggcgggcggtcctccgcacgaggcctctggcgctaccgccgccggctccatgtcgtcgaggcggagggcgcggcgagcggcggccgttacccgccgttcatccgccattccctcgtcaacgcctccgacccaagaagatgtgcgtggggggccggatgcccgcctcgatatcgagcgccggcgcgacgctcgtcgcgccgcccacgcaacggagggcgcttcctcgtctggagcgccacttcggtccgggcacgggggccggccccccatgtccccggttggcggtgccagctgtcgagcctttgtggcgagccttcggaacgtccgttggcccccaaggttccggcccaccatcaccgaaaaatacgacgaaacgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggcgaaaaagcgtatttgcatgcggtaca

SEQ ID NO: 90460 - DNA, 1855 bp, Oryza sativa
agtttcaccgcgaaccggccagaacggtaggtgggcttgggctgcagccagctcttccacttccgtaagaaccggaatctggctcaacgcgtcactgctctcggcccattaggtggccgacgttctccggcccagctttttggtttatgaagagagcgagcgatccacgatcaatctggcccacgatccactccacaacccatgcctaccgaggctttcttgtttccacgccgtgtataagtattgagcattttggtgtttcttagcaatgcaccacgctctcttttctttgatcatcctactagtcccccaatctcaaaataaagtattttttaatatgaatctggacataaacaaatattttttttcctggaggagtagtacgatacaatctgcccgtcagaacatcaagcagggcagagttgcctgtgatttgtcagtctactgtctactccctccgtcccaaaaaaaaagataaaccatgagttttcgtgccaacatttaactgtccatcttataaaaaaaactataattagtattttcattgttgttagatgataaaacatgattaatactttatgcgtgacttatatttttttcataattttttcaaataagacggacggtcaaacgttggacacggaaaccaaggtttgtctttttttttggacggagggagtacattgattcggaaggacaatctcatatatccggttttggaattggaaatttgaaacagaattttcttcagatgaagaaaaaagtattgtcatcagcttatatggtgtgtgaaaaaaaagagagaaataaataaaagtagtattatagtacaagatcagtttgcaaaacatatagaaggtgtaaaaacacagaactctgtaaacattctcaaaacctagccctgggcacacatgagatgtgcccaactacagtatatataagctagcagtatatagtctttgacagaaagctctttctctcgtcctaacatcctgactgaaaacgaaaacatgtacatacatcagtgcacacccacacgcagatgccaggcaaccaaaaccgagctgtgctccatcaactcacgcatgcatctccttcagttcagttaacccagtatcttcaggcgtttcacagatcgtgcaaaatcactgcaacaaacaaaacaaaggattaacatgtcagtattacacagaatctaatgttcaatcttgctgattcattaagttatactaacactgaaataactaagcttgaaatcgacttactcccatggcacgtccccaaccagcatccaatccccatcaccatcctcgtaggtgaccacaggtccagcggcatcgccatgatcatcattggccattttcttctcgcctgtaaatatatcacgataaccaaacctagcatcagaatcattgatcgcaatcgaattcggttactagattctgcttgcttttgtaatcacatgtgctgatgaacaattgggttgagttaaattagctactgaccttggtggtcgttggtggggaacatgcgggcgagcgtggcagcgagctcgtcgtaggaggaatggagggccaaatcaaccttcctcccgatggcgtcgccttccttcttcaccttcacgtagttggcgccgccgcacgcccgccgcgccgagctcaccggtggccaccccaccaccgtcttcttcctcctcctgcaatcgtcgtcgctggtgttgcagcagctgccgtcgtcgaagagcagcagcgtctcctggaacgcctccctgaatcccctcttcccggccgacgaggcagacaccggcgcgctgccgctgccgccgccgctgctgctgctgctgctgagctcgtcg

SEQ ID NO: 90461 - DNA, 903 bp, Oryza sativa
gctcctggaaataatggcgcaacttcctcgaagccatcagaatagcataaagcatcttctgggcctgagggtatcgggtcttggcgtcccggagggcctcgctaacgaagtagacgggccgctgcacctttcggcggggccgatcctcttcgccaggccgcatctccagggcgctcttcgtccgagaggccacgcggggcgcactcggcttctgtgccgacgacctcggggtcagagggcgacaggcgcggccttcccgcagtggccccggggccatcctgggggttgggggcgcctggcaccgtcggacaagcaggcggagggccagctccggccgtcgggggccttgggccgccgttcggctcaggggcctctcctccctgctctctcccgggtcgagtcgacacagggtggggatgcgcggagtgagggttgtcctcgtcgcgctccacgaccaacgccgcgctgaccacctgcggggttgccgccaggtagaatagcaacggctcatctggctccggggcgaccaggactgggggagaactgaggtacgccttcaactgagtgaaggcccgcttagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatccgctctatagctcgtatcttctggggttggcctcgatgcctcaggcagagaccaagaacccgagaagcttgcccgcaggcacgccgaacacgcacttatcggggttcagctttatgcgggcggagcggagactttcgaaagtttccgctagatccgagagtaaggtctcttggt

SEQ ID NO: 90462 - DNA, 3434 bp, Oryza sativa
agcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcctagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacggagtcctcctgaagtgcattcctcgggaacaaggcgtcgagcttatcgccgatgtccatgaaggcgagtgcggagcccactccgcctcacgcaccttggttggcaaggcctttcgccagggtttctattgaccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccggacgggttcgagtatctgtatgtcgctatcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctacttcgcctcccccgcccaccccagaagcaatggccaagtgaagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctagccacgggcgacggcacagagctgcctaacccgtggaacatcgaacaccttcgtcgcttctacccctagtgggggtcgggtgtcatgtctcgggctcgggccaaccccgcacccccccgggcgtgcagggttggccgggggctaccacatgcatatacttaccttttttctcttccgtatttcaataaaagcattttcgatttcctgaggactgtgtctgtgccatcgtttccttttgaagaatcttggctcgaattagcacgctcgtgctcgaccctgccctcggtggcccgggtcggctaaaatcgccaaacggggcccagaaccgagccgtgccccggggcgtggtgaactccgggggggaatcggcaaaggcccacaatcgggtcatccataaccctcggtcaccgcgctcccggcctggccagtctcgacacgaggatctccccaggcactagccccgacccgcgccgtttgaggctgggacctgggcacgagcccttgttcaagccaagacatagaaggaccgcggcacagaccatcctcgtctcatacacacaacaaacagaactgacgcagaaatttcctctttacttgattgcagattaaatcagtctatacaagaagggggcccgaaggcctcggaagaagaaggaaaagttattaagattggcgggggcctaggggctcactccgacgcgcccgggttgccggcctcgtcgtcgctgtcgtccgcaccgtcgtcaccgccctcctcgtcgaagacgagcgcgaacgcgagccgaggggctgtaccctcgaagctgtggacgatgtggtcggcggcgtcccggacctgcgcgcgcgcgccgtcctcggttccgggagggaactcttccagcgctgcccacggggagaagtcagggtccctggcctggtagcttgccagcacgagctccaccgccccccgggcgaggtccctcgaagatgacttgatcgtctcctcgagctcctcggggagccgctcgagggccccggccatctctgagaggcgctgggcgaggcccccctagttggcggtgtacttcgcgtaccgcccgtcccagaggcccgcctgccgcccggcgcggtctagacaggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggttgccgtggcccgcggccgccccgccgctgtgcgctctcgcgtccagctccttcgcccgcgcctcgagctcagcggcccgctgatccagtgcggccctctcggcgcgggtgccttccagattgcggcacgcctgctcctcccgcgctgcctcgcggaggaacaggctgtccgccagccgttgcgccgcggcctcggcctcctcgagagctcgcccccgctcggtgagcgcgtcctcgcggaggcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcatcaaggactccctgggcggcgtcgagcttctcctctagctccgccgcccggctcccgtattggaggcggaggtcgtcccgcgccccgtcgagcacggcggtggcgatgagggcagtcccgctcctcctccacctccctggcgacctccgccaggtccctacgacgggcctcgagctgtgaggcgtgccggcggtgtgccttgcagcccgcggctggaagtagcagccaccgactaccgtcggcggcgacaccggctgtacggtgaagaaccaccggaacagccggagaaatgggcgcaccc

SEQ ID NO: 90463 - DNA, 792 bp, Oryza sativa
ttgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttctggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgttgtccagaagaccaccgattcgtgtggtcttggacgggccgtcgcccagggcaacctccttgaccgggacctcgtcgcacgtgaccatccgctgccttggggcagccgggacggaggtgctgagcctctcgtcgccacccacgggcttggacgccgcggcgaggtggtccgcgcgctgctccatacaagcaagcgcgactttgaggtcgccatggacggtgatggggccaccggggcccggcattttcatctggagataggcgtagtggaccgccgccatgaacttcacca

SEQ ID NO: 90464 - DNA, 683 bp, Oryza sativa
  unsure (1)..(683): unsure at all n locations
gcattagcacttggcagaattaaaaacactcaaaaacagatgagcttatatatttaatggagatatagttgcatacgtaccccaagccgtagaatataaatgtcnccttcaatactgaagggaagaaggttaggccgttgaacctttatggccacaagagcaccatcaactgtacgtccctgataaacctaaagtacaacaaacaagagtacactgagcataacagaaaaattgaaagagatagtacagaaaaatataataaggcttaatcagaaactacaaagctcctgtctctaatatttaaaaaagaacgggaaaagttttgcaagatatgattacctgtccaaaggaagctgcagcaacaggctcatcagaaatgtaactgaaaatgtgtgatacagggagctcaaattctccctcaataatcttcattgcatcttttctcgggaagggaggaaccttttcatgtaactcggcgagtgcctatgattggggtgtgcgccagttaattttgagaaagactatggagattgtttaatgatcaacaaaacacttctgaagatgatgaagcaattaaagaaatgcagaaatgttattgtatcctgcagtaattttacctaacctcagaaatctccgagcctgtgatatcaggccttgttgagagggactgtccaactgcacac

SEQ ID NO: 90465 - DNA, 1020 bp, Oryza sativa
ggtgatgctttgtcaggctcctaggtacgtaggaaggaagcttccatggactgcaggatactcgctgtgtcgaacctgaagtttcggaagcttttacctgggcggctgtcaagagtttgtgggtcagatcctgttctagtaataacggggttctcaacaggcgccgctccagttgaggaattcttcgctttccacacagtacctgtcaaatgatgtgtggtaccatagatgttatcacaattatagaggcaaacggtatatgtagcaccagaggttcaccaattttatcacaaattacatactaggagtacattgcaccaggttcaccaatggtactacacacactatgtactaaaagttgatcataagtatagccatgagttcatgactatgccaggatcagacctgctttaattatgtactagctgatattttgctcagttgagaactacttctgcagattaacttagaaaacaacaagcgaaacttgaagcagaactgctaaaaataattgacaaataatttaacatttttaggtcctaacataaatgggcaaagggaggatcagaagaaacctctagcagacgtgtctgatttctgatactgtgggtgacgatgtgtggctatccaggcttttagacccctggatgaagaagtaaaatgtaaaggaattaaacaatgtagaaacaaattcacactcaggaaatgtggatgcgggttaaatattttagaagccattaaaccaacatgctcatgatgactgtctgcaccaagaaaaaaaaactaaagtgggtcaaaaaggtactgactgcaaaaatggtgcgaccatatagagcttcatcccattcactccacgagatattgcgtcatcaccagcaggaaggagttcatcgatgttgtgccatgagatctcctgtcaatttcagaggatcacgactcagtaatgcctatttaactctctttaaccaaaaaggttcaaaactcaaaagggtcaatggataaactacaacgaaaaaaaca

SEQ ID NO: 90466 - DNA, 2347 bp, Oryza sativa
ccgtcccacctcgcggcgggcgggtcaccccgggtcgggaccgcggagcacgactggctgtgggattgccgcggcatcggcgggggcgggagggactacgctaggcagatggaggtcgcggtgcgcgtcgtgcaggccgcctgcaccctctgccagcgcgtgcagagctcgctcctcctccccgcctccgcctccgcctccggcagcgtccactccaagatcgaccgctcccccgtcaccgtcgcaggttggtcttgttgccttcactcctgagcgagctcgtagcactggtcagttcgtcgccgcaatttagtatgcctccaaaatccatagcgagagattagtcaaactggagctccatcatattagaatattcagattgatactgattcattgttcttaattcagtccgaattcctaaatggaatggttgcttaattagttattgttgttgactttgaaattgagcgaccgtgtgcgtagtggtcttatactcttatgttctgtgatttcctaaggaagagaattgaatacttgcacttgacttgttggcctgttagaacactactaaataataatggtccactaccaggttcagtatgagtacaatggtagtgggtagctcatgctccatgttgccaacataccagataccagatagctcataataccacatggtcatatgtcaaatcaaatctgatctgatgcaatgttatttggcccacaaatttaagaagatctttgtgttaaatgccatcaagaattgtgactttgtggttggtatcttttggatgcaataaatttatgcttttgtggtaattggttaccagtagtaatctttccttcaaacgttattccagattggggcgtccaagcgatagtaagctggctactctcggattgctttcaagatgaaaacatatctatagtagccgaagaagatgatgagacgctatctagtagcgatggtgcagctttgcttgaatctgtcgttgctgctgtcaatggttgcttgattgaagctccgaagtatgggctgaggtccccagagaaagagctcaaagctcatgatattcttcaagctattaggaggtgcagctctatcggaggtccaaaaggaaggttttgggtgcttgatcctgtggatggcacgcttgggtttgtacgtggggaccaatacgctgttgctctcgcgctaattgaagatggggaagttgtattgggagttcttgggtgcccaaattatccaatgaagaaggagtggctcaactaccaccaacgatattacaggttgatgtctaaggtttctcctcccacatcaggatcctggcataagggttgtgtgatgtatgctcaccgaggatgtggccaagcttggatgcaaccattagttcatgactttggcaagcttgattggcgtaattcaagagaggtccgagtatcaactgttagtgatccaatctcagcaacattctgtgaacccgttgagaaagctaatacaagtcattccttcactgctggacttgctcatagtgtaggcttaaggtcagttcttgagtttaatgtctgcgcggtatgcataacctttatggatgctaatattgtgtaactacagccaaaactactctatacatttacatgccatatctgcaaaccattgcctgatctttcccgaatagtatacttcttttgaaactgtttcctgaataggatgctggttctgcatcagtataaaattaaatggcaccttcatttgacagttgtccgtttccatctattgtagcatgtaatttgcaagttttggatttatcgtactgttatatttatatgttttgcttggattccaggaagcaacccctgcgtgtgtacagcatggtgaaatatgccgcaatagcacgaggggatgtagaaatattcatgaaattcgctagagctggatacaaggagaagatatgggatcatgccgctggggtggttatcattcgagaagctggcggagtgatcacagatgctgggggccgcccactcgacttctccaggggtgttttcttagagggcttggatagaggcataatagcctgttccggaccattgcttcatcacagaattgtgggtgctgtcgatgcaagctggaactcatcaacactgtaatgcaaatagtacggatgattacagttggttggaccaatgtcggtcatagaatgcaaaggtgagttttacaaagaattgctgttgtgccctctggttgaaatctgttcagccatcttattctctgatagtctcctacgggaaaatcagctatttctaggttgcagaattagtatgtgttcatttcagttcgatttac

SEQ ID NO: 90467 - DNA, 1617 bp, Oryza sativa
ctgcacccctaagtaaaaaactggattgtaattatttgcaaccttaagtaattaactgacaactttcaagatgaacaggctggtaaattaagaatcagaccagttatgagcaagtcagataaagagttattgggggtttgggggggagggggggttggtggtaaccactcacttgtatgcatgtgacaacgcgcagcgctcaacagcaagctctgtgttgctctgttcagctagtatgataaccgtcttgaaaatccttccatatagcagcctccactcgagtgccgtgcgatccacaggcccactaacatgcatgatcaacacaacatttccaaagttctttctccacttaatcaggtttccaatctcatagttcactgtaccaatctcatcaactcccaagtgcacagatggcagcttcttgggtacaaattccttcatgtcaccctctccaatggttgcccgctgcctgtcaatttccaatgacatgagccgaggctgccggtaacccactgcaagaaggtcctgcagccaggcagccgttaatctcacatcttgctctgtccagaacccttcctcagccatggcatagctcaaatcaagaatcctctcgaatagagttctcttgtttgacctccactcattcagaaacttgatcaaccgacccacattaacatgcagatccttctcctcagcgaacgggtatgcctgaatatgatccttccggtaaatagtcggcggatagaaagccacatacccaccaatctcccacaagatccgttgcgcccagtagccacggatcacatctgatgccattgagctcactgacactggcatcatgagaccccagaaagctggcgtgtggaacaatgtgttgaacgaattcaccggtgccatcgtgccctgaggcagtgccactttcggcgcctctgcatcaaacctgagatcaaacgccgcggttggtggcttcctagtgaagtagaacacggcatcgacatccggcaatccatctgagagcccttgctgaatgtattgctggccactgaacacctcagtgtagaacacctcgtgagccacctccccaaccttgtctagcggcagcccccgtggccacacggaacgctgcccaaagtgcacgtagggattcaccaccgtcctgttgggatcggcgtggctgtactgcagaagcacgggatggttggtgaccccagatcccaaatcgacatcgaaatgcttgcccagatcgttgccggggacctcggcgcggtcgtcggcgtcgaagatcaccttggccccgtgctggatggcgaagaggtagccggccgtcttgcggacgtgggacgcgtaggggaggaagtcgacggagcggtagccgagctgcgcctggagctcgagggagaggaagatggcgcccttgagctcccacccggagggcgtgtgggagttgccgacggcgaggagctgccaccccttgacgcgggcgagcgcgccgagcgcggcggtgggcggggacgagacggagaccacgatccacctctccgcgcggaacgacgcgaacggcgcccccgccgcgatcgcaagcggcggcacggcggcccacttgacgtccgggtacgg

SEQ ID NO: 90468 - DNA, 3069 bp, Oryza sativa
agagctcgaggattccgccgtcggccgattccgacgtcgctgtgctcgccgactccgacctcccggcgcgcacgcctctgcggtcacccaccgcctacgccgcgctgtccgcggcgctccggtcggagggccggagctcgcctgctccgccgcctacccgcgtcgtctgctgcgagagagaggggaaagggaagaagagagagaagggagaggaaagaagtgaggagtgaggctgacatgtgggccccaccattttaaaaatacttttttgtgtgcagctgacatgtggggccaagctttttattattttttcgggatataattgccacgtaagcgccacgtcaatgccacgtgggacagagacctagtcaaataagccacgtaggcgccacgtcagccaaaaccgccttcaaaaccgccgagggatcttgtttggccagttttcataagttggggacaggtcgtacccggttttcggtcaaggacgaaaatcggactaggcgacaaatatagggacccaaagtgaacttattgcgctgcagaaaggctaagcatcggcacaaggtttggagcagcaggcttcagaaaggctaagcattggaaatagctttattatcctttttatacagaactagcaaggcaaatgcatgccgaggaattgaccatgtcatagaacaacctaactggtggacaagtagagctacgtcaaaggagcttccactaaaatttcatatctagaaggttaaaggcttaaagctacacaatagaaatggcaaatagttcagtgactttagtccgaactattgagaactttttgttccaaacaataaccaactttcatcaacatatgctggatttcgaaacacaattatactcctttaaaagggtatgtatggttttccgtttatcaaatatttcatcaaatttgaagggtacagcaaattgtatccctcaatggtgtatctcactgaaggcaacccctgaaagctcgcaaaacagccgaccgtggtgacactcttctcagtaaactcttagctgtcctttccttcactagggcagctggaccaagatgatcctcagtaacaatgtcactattgatacaacagtatacaacagcagaggaaaaaaaacagctacaaaataaacagaataaatgaaattacaacaatggagaaccccctgaaaacagaaatctatggctgtctactctgtccacactgtcacaaggatgaagtttcgttccaactacagaatatgtatttataccaactccattagaagagggtctcccgtggacataacccgaataagctttataaaatcaatctcgttctgtactttcactgggaaaacagcaggtgcgtgagctgtataaatacttgagaaagtctcgttgcccaccaagttgctcctgaacactgttccagccagagcatcagagtcaaaatttttaggcgagtccatcgccaggaagaacatcgggacagcaactttgtggtgcaattccaaatcgccgacaagtcccacaaggtcaccaaaatcctcaacaaattgacgtggtatgtaaaaaagctcactgccacagaatgcaatcttatcttcgcccatgctttctttatagtttgtctggaaatgaactggggaactgccaatgacctgcttaaccattgacccttgctttacaaaccattcctctttgttgttctccaatggaacagtaacccaagaatgtgcaatctgcagtatgagaaagtatgttatggataataacgtatcatgtgaattgattaatatcaaatacatgaagcctacaaaccttgttggttatccaaagtttttccttgtcagcctgcagcaggttccagtagttaagaatcatgtgatcttgcaggaagagaaatccatcagcaccaccgtatctcgcaaacaccttgggcagaaacctaattaagttacacaatattggcagcacgattagcacatggaagaaagttcaaattcataacattattgatcagctataatcacgacaaacatcaaaacaacttaaaggcagttaaaagttgcaaaccaacaatttgatacaatcatgcaaacccctttggttcagccatatgaacctaggcccctgaagacttgaacttaaaaatgaaatagaaatttgtaactatagttagtcctttctcagttgaatccctggtggaccactatattcatataggcatgtttgatactaaaaagaccacattacagaacatgtagctagtgaactctgacaatcaactactccctccatcctagaatataagaagttttagagtcgtacacggttattaagaaagtaagtagaagtgaatggtggagggttgtgattggatgagtagtggagataggtgggaaaaatgaatggtggagggttgtgattggttgagaagagaatgttggtggagaagttgttatattttgggacaaatcctgagggctaaaagttgttatattttgggacggagggagtagcaaatattgtaaagtatttttatgctaagctccatcatacaagtgtgcatttctatttagccttttcagtgaagacacactcaaatgtcacaaccattataaccagctcagccacaacaactgaagagtcttggaggcagtaccatcataatttgttgatgctcattattcaaacaaaaatggttaattatcgccaaaataacatcatatatataacgacacaatcagccaacattcaatgtggtttaaagagtgaaaaatttgagtcttctctacaaacaaacaaaaaaaaagaatcctctagcaaagttcaatttaacaccagcaggaattatctagtgatatgtaatgatataataataatgactttaagtatttcaagcaatgtgttcatttaaatatagtctggatgcaatcatcaatataaaatcccgacattacagtcctaactgtatttgacattagcataaacgatattgtcattaatgaatttcatattggattatttaacaaattccagagaacatgttcagaatgtgcatgtggttataa

SEQ ID NO: 90469 - DNA, 3117 bp, Oryza sativa
cgatccgcgcggggaggggggggatctctttgagcctaaggcgcggcgcccgcgcgcggtgtcggtcggtcggtcgcggcgagagcgagagcgagggcgagggcgagagctggagtgtgcgttactccacagtccagtggtggggtgtgtgtgtgtggtggtgtcccagtaggtggagcggttggtgggagctcgtggtcgctcgcggtgggggagaaacgcaacgaaacgggggaggagaaggagaggggtgagcagtgaggtgagcggagttcgttgggatcggggttttctggttttcttcttgttttttttttgctggatttggtgtttttctttttagataatggaataaaaattccaacctgtgcatcatgtgatgcacacagcccgtggatttgatgtttttatttacgtgtatagttttgttttatggaatgtggatcgaaatgggctggaatgataatcatctgatcattaaagaaacattaaccatcggtggcactccttgcacatgggattaggagggcaatattttggagatcatgtagatctagatgcttagtacagtacattttactactggtactcggcagttttttctagaaaacaaaactagggctgtgtttagatccaaagcttgaatctaaacttcagtcatttttcatcacatcaacctgtcatacatacgtaacttttcagtcacatcatttccaatttcaaccaaaatctaaactttatgctgaactaaccacagcctagtacttggagtggtccgtagtatattactctacttggcaatgccaatggactgcaaggggttgtccctaaggaatcctgagtaaagaaaaacagtaggaatatatcgtgctttaagtactgtaaccttgcagaatgccggtgaactgcagggtgttgtcgctaagcaatcttggagttaaaatggcatcttactgtatatgtagtacttgtagcgatgtagtttcttgaaagatttttttttagataatggaatgaaacattacggctctgttcgcaagattaggttcccaacacaaacagtaagcatgcaaaacggagcgtccattagcacgtgattaggctaagttcatatccaactacagctattttcgatttttagaattaatttaggagtttatatatatatatatatatatatattcttcacagggatatgtcatttaccgcaccctatattgttcctttatgctttatagggtgttcttctgggttccttcttctagattccttcttgattagtcttctgaaatctttgtttattcttccttccacgcccaaattgttgatattctattatcaatatatattgaaaaacatatttagcttaaagaattctattcatctggttgcccatgaccaccaagatccatagtgtccagatcagaaaaagaaacttctaatttctcatctactgccttttttatttgttcaaatttctgatccatttcttgttttaattctttaagtatttcttcctttaattccttctttaattgtggggaggcttcttcaaatttttctattattttccaatcaatatattcctcatctaatggatccactccttttgttaggcattccttgtatgtgggttttttagaatacccttcttcttttatagtcgttttaatgggtatttctggagtcttctttcctttagcttttttgcatttttgaatatattcttttgcagcagactctagataataatttattcctagtatttttctagcctggcttagtgcttcatcaatgtctttatatttcttccaagatattcctcccattaatttagcatatatcttttgggccacaatttcttcaaaagatatatagacccctgggagctttccatcaaatacgacatatataggcttctgttggattatttcatgatcttcattagctggcattaataacccgtttattaagtgaaaatattcagagaggctattcaatattgataacatatatcctttttcttcccttttattattgtattggtaccaaaaattatccaagatgcattcttgtacttcatctaagattatatggtcttttggcttaaatttatatgaatttggtgggaatattctgagcttgttgtcatctccaaatgtgaagcattcaattccgctgtaattcattgatcttttcatacctgcaattcaggtaaacgagaaagcatgtcaggcaaattattatctttccccttaatatgttcaaatataactttatagccgtttcctgttataatatcttcaaataaaacccatcttctagttgagcttttcttgctatttagctgattatagtacctacaaatggcttcacaatcggttctaaccgtgaattctttaaatcctaagtacaacctaaaggcattgattgcattgattattgccatgatctctctatctgtattattgacagtttttaatttataacttccagaagcatatctacatattttttcttctgatttagcggaaaatttagtaggtctttgctttaatatagtaccccaaccgtgttgtgatgcatcagtttcaataataaagtaactttcttctaatggtaattctagatgttttaattctttcaccctctcttttattaatcttactaatttaatgtcttcagaattaaaatatctctgaccattttttcttaatttagcatataacggtcctgctaactttgctaaattattgatgtgatttctagcataatttacaagtcctaagaattgctgtaacttctttttatcattcatagcatcaggaaattgtaaaattttcttagcaatatgttcttgcaaatgaattttgccctctcctatttcatgtccaaggaagttaattttttctttgcatatgtccattttctttttggataatattaacccattttgttccacctttctaaaaaatatttcaagatgagctctttgtaagtccttgagaagactaacaggtcatctatgtagactaatatgaattcttggttttcgttaaataattcagcattttcctttggaaaattgctggtgcattttttaatcctaatggcata

SEQ ID NO: 90470 - DNA, 770 bp, Oryza sativa
agaaataggagccaaaataactctggtcaagcctgagagaatccattgtgttgcaaagacagaaagaccagctgatgttactgttaggccttcatagaagctgtaatcatttatatatacattaaaggtccttgaactctcagagactgtatcagcaaaataaagagcaacataatagctatcattctggagaggtattggaggccattgcagcaccaagggtgcatcttgttctgccaccaaagctgtattaaacaccccaggaggtggaagattccaaaaatcagccgatgtgacattgtgggtactactgactgcatgtttactgtctgggaatggctgccaataccgattgaaggtgtcattagggtacctaagtttgaatataggaaaacaggtcaaaaacttgtacagatcttgtgaaatttacatacataagaaattaatacatgaatataacacagcatatcactccacattaacccgtgagaagataacctaaaaacttgagttattcagtccatcaaagaaaatgatccaaagagtattacttatttgtttcaaaattttcatttatccctataacctatgaatacacatcattgtccatcatatcaagattggctcagctttgcagtcaataaacatactcacttctagtgaatcatgtaatccccattcaacatttcatcactaagctaatcgtaatagaggacctaatggggactgcagaagttcataatagtgaaggcaagagtgatcgagcactc

SEQ ID NO: 90471 - DNA, 2107 bp, Oryza sativa
cccaggatccagactaacgatggcggcgagcggcgtagcccctccctcctccttctcccgcggcgtgtggcgaggacagagtggcgcaggtaagtggagtcggcggcgagcggtggagcccctccctcctccctctctctctctcgcggccggtggggttgctgctgctactgcaaggccgcgccgcgccgtttctccctcctcccatccgcgacgatgccgagcgggttgctgctgcatggccacgacgcgccgtttctcctctgcacggcgcgtcctcgtcctcgcatctctcatcagtgggccccgcactcgactttttgagcaaggttctcgttccttcgctgggaaccgaagaagctagtggagctatgggccccaccaacttttttcaccacgtaggacaaagtaacgcttcacatagacaaagtaacgcccccactgtgaagggcctaatagatgtcacatcactgccttatcaatggattttactcccaatactctctgggtgtgtttagttcgtgccaaaattgaaagtttgattgaaattggaacgatttgacgaaaaagttgaaagtttatgtgtgtaggaaagttttgatgtgatggaaaagttggaagtttaaataaaaaaattaggaactaaaccagtccctagtctctataaagtactacctcctaaaatataataatctagaatcgaataaaatatatctagcgctaagaatccgaacaaatcatctctctagattcgaagtactactaccttcgtcctaaaatatagcaactttttgctatgaatctgaacacacaattgttgagattcatagctaaaaatgtttacatttgagatggagggagtaacatatatcaaatcttatcatagattcttactacctccgccccaaaataagcgcagatttgatatatgtgtctaatgtttgaccatccgtcttattaaaaaaaattaaaaaattagtcacatgaagtactaatcataaaaaaatttcaaataagacaaacggtcaaatgttggacatgaacagtgtaaaactgtacttatttttgggacggagggagtataatatagtaatctaatatcagattagatatatttaaaagtataaatctgaacagatcttttgttcagattagtatcactaaaatatatcaaatctgaccatagagtcttatattttgggatgaatatagtacctctttcatatatagagggtgccaacattcgattaaaaatctatccggtatcgatctcacctactccatccttgaaccagctcacacctttgttctgtcgttgttttaccgacactcacaatgcaaagtttatattcgagaaggtaatcgcttggagtacttctaacagcctctctaaatttgactagaacagcctctctaaatttgactatttaaatatctatttagctagtttgttaaaaatattaaagagtgaaatttgactttcactctaatattcttattattacactttccaatatgatagtgggttacacatatcaatctttatattcttcgtcttccttccttcctctagatattttccccctcaccattttttctctccacccatttctttccatgccgcttggtggtaggtggtggacaaggctagcacaagatgcacaggaggtgacggcatggacgaggcgagcatagaggctgtgcgggagggcagggaaagggagggaagggcagagacacctccgtcagggaagccatatccacacaggggggctagcagggtgatgagctctccgaccgctgatgccaccgcctatgccttcttcgctagattcggtatcgagctcaccttccctccctacctcatgcagatcgacatagaggacgagcttgacagtgctggagaggggacgatgaagggagaatttgttggcggtgacacatgaggatgatggaagaggtgtggatcttgacgattgtgacatgacagtagaggggtttgactctgtgacatgcaagctttgatggcggcctcaccattataattgtcgagctgctcctcgtcgttgccattgtacaccaccgcttaaggtcgtatcctatggga

SEQ ID NO: 90472 - DNA, 2315 bp, Oryza sativa
tcattccgattagcatagccattttcaaaattcaaatcaaggtactcttctaacacatcaactaaaccaaggtggtgatacacattactgcttgatgagcagaattggtaaggaaacgaatcaaaaataaacgaaccaaatcaactctgctgtgtttagttcacgctaaaattagaagtttggttgaaattggaacaatgtgacgaaaaagttgaaagtttgtgagtgtgtgaaagttttgatatgatggaaaagttgaaagtttggaactaaacaagacaattaagttccaaattataaattctggctttggtttataaggaaacgggcaaaaatcattttgttcccaaggaggccctaatttccgagcaagcacaaaaacggcgggggacacgagcacgttgagcagcggtggtggaggcgccgattggctggccgatgcgaccaccggcgtccgtctcgcacccccgcatttgtgaggaacaaacccgcttttccccgcagcgcttttgcaaaagccatcttttcttgccaatccactcgctcacccatccgtccatccatccaccgcggcgtattataatctgcgccattatctcgcccgcgcctcatgatcgccgcaagattcccctagcagacacaaacccaacccaacccaccatcgctagctcctcctccgctttctttttctcccccaaccaaaccacccactcgccgcacacgcacaggtgacaaagcccacactgccaatgccgttttaataccggcgagacgccgggcacgcgcgcgcgcgcggcggatgacgaaacgcaccggcacaggaaggatggcggcgcgtgcaatccactgtaccacgctgctctgcgaacctactagccgtaacagcaaactgtactacctacttgtaggggtaaaaaaaaaacgaaatggtaaggcaaattaactgatcgctgcaaattaattagcccctgccacgacaaaacggggagtaaattaactgtagcagtaactagtagtataggcgagcacgatgcctcgatgcgtaggaacgaatgatttctccgaccagcattagcacggatctcgaattctcgatcacggcgagagaggagatcagcgtgaattcattctcgcacgccttttcaccgcatcgccatcgctacgctactccccctcttctcaagcaagcttgctgctgcatcaaccaccaccacaggtggatcccgaaattctaacggaaaaactactagtaaccggaatcgtgggatgaaattggaattgtggtgggggacaatcctaacgaaccaagaaccaaatggacgtcgcaacagcaaagcgattcaacgaatgtggaaatggaattgcgaagggtggggatttgggggggggggggagggcgtaccgttgggcatgagcttggggtcgacgacgagctcgccgtggatgcggaggccgacgatcatctcggagaagcagtggacgcggcggtcgtagcggaagtcgaccaccttgtagttggtgaggcgctcgaggacggcgccgtagcggcccaccaccagtagtggtactcgaggacgacgaacaccacctcgccggcgaaccgctgcgccgtgatgaacagcgggatcagcccgtcgctgaactcatggtacacgttcccggtgtacccgcccgtcgagaacaccaccgccggcacgcccggcgggtgccgcacgtcgcaccgccgccgcaggctgtccttgccggtgtcgccggcggtggtgccgttgctgccgctgccggcgtcgaccaccggcacgatggtgacctcgtcgatggtgctcatgatgctgccctcgaacttgcgggtgtacggccgcaccttctccggcgcgctgccgcggggggcgttgtacaggagcaccgacgaggtggacgggtccgtgcgcacgtcgccgcggaggtagcacacgtcgctccggtagtggctccggtcgcagcacagcgcgctctccgccgccgcctgcccgccgcccgcctcacctgcgcaccacccgattagcacaccatccccaaaccgccaatgaatcagcagcaatcaatccagctgagcaaaagcgattagctcctctcctcaccgttgatgagcgccgagcaggggagcgacgccggagagcgagtctcctcgcgagcctccaggttgttctggttggacggcaggtgcgtcttgaacgccttcacatcctcccgccgctccacgcgctctgcgaagcacaagaatcaccgccattaaaggacaccgaaatcggttggggggggggggcgaagcaatcaac

SEQ ID NO: 90473 - DNA, 636 bp, Oryza sativa
aatcatctcccttaaatctgaccaattccatctatcagatggaactacattccacatatcaggttgaagaatgccctggtaggagatgcattgagtacagccttagaacatagtattggctattgcaacccagatatcaaataacaaaatgacatttcaattcaaaagccctaagagtttcaatatcttacttaaactacttgagaaagaatagcaaatcatacaggcagcatttttcttggccggattggcacctgcaacataaatgctgggaaagttattggacatcaggcactaaccttgctgacagggctcccgctataagtttcataaggaccttcttttgcagcaatttcagcagaagctttcaaggcatgataataaatagtctcaaaaatatccttgttcaattgctgagcctgaaaagatcattgcatcgcatttcagcgaagtatatatagattggaataaccacatttttaggttggaaaaatttacctctgttgaatcaaatggcatgccaagtaaaatgaaggtgtctgccaagccctgaacaccgattccgattggcctgtgcctcacatttgatctctttgcagtctcaacagggtaataattagtatcaattattttatt

SEQ ID NO: 90474 - DNA, 1314 bp, Oryza sativa
caaaatcttatattcagatgatgttaaaaggtttagccttctgccataagaaatgggtgctacacaggtatccactaataatcttgctaaatttcttttagagagagtatcctttgacaatctgtgctgtagggatatgaaaccaaataatttactcattggcgctgatgggcagcttaagcttgctgactttggtctggcgcgcatatttgggagtccagagcggaacttcactcatcaggttcttttttgtggaattatatttattagaatttaattctctgtataatctagtcgattgtatacttggaacttgagaatcttgttgctgaaacaaatatgcaatgaacatttcttcaagtgtattgatgtttcttttgtatttttttaactcggtcgatattgctgtttgatgcttcgttgttctgtttatcaaaaagaacatccttgtggatattttgcgcccttatgctttacccttttttcaacaacagtaggcacctaggaagtagaaaagcttaaatctttatggatggaacaaaatgcatgtggggaagttcttatgttatttcctggacatttgagttggcagagttggattttgaataaatgtcacaggatactgatttcggaagtatgtgtccttgaataaccattttcttggtaaatattaatagtgttggaatgactgtttcattctgaattatttgtgctgattttcattcaccatcatatctggaggttctcttaaaccatctttttatcagttatgttgacgatagtcaaggatcaatgctacacttattacagcaatgctgtgtgctttgcttaaatgagtgttttttattttttattagtttcactttgaatcatattatcctgatgctgctgggcacttcagttttgaattttttttctcaacatataggtctttgcacgatggtaccgagcaccagaattattatttggcaccaagcagtatggatctgcagttgatatttgggctgctggttgtatttttgctgaactgctgcttaggcgaccgtttctccaggtttaaccgactcttataattttatgctctgtgtaatttcaatctatttataactaagcactttttatgctctgagaatgttgcatggctaagtttgctgttcctatatgttgtgataactgcatgcgtaaatgtgttacctcaaaatgttgtttccaaagccagattggacttgtagttttcaactgaggaactggaaatggtcaggctctggtgaggtgattgaactgaacctgtaaatgatttaaactttgggttta

SEQ ID NO: 90475 - DNA, 707 bp, Oryza sativa
tcctgcagcccttcctcttatgcggcccgggtcggtgctcctccagatcgtgcccgtggggctcgactgggccgccacgcgttctacggcaagccggcgcagcagctcggcctcgggtacctcgagtacaaggtggcgcccgaggagagctcgctcgccgccgagtacggcgtcaacagaccgtcgtgcgcgacccctccgtgatcagcagccgcgggtggtgggagatgaagaaggtgtacatggaccggcagaacgtcactgtgaacatcaaaaggttcggcgagctgctccggtcggcgaggctgcacctcaagaacgccaccgcctgcggcaaggccgcctcggcggcgacgacgaccgcggcgaggtaggggtggctggctaaaccaagctctccgtcaattaggtgttaattaatcaaccaatcaatcaatcacagctgttaatttgcccatgtttttttctcggtttattttttttttcatttcatttttctgctcgtttttggttggggggtttgggaggagtataattaagaagggtaaagaaagggagatcctgtaaatagaattggatttattggtagggatcgcctccgtgcacagtgcattcgttttcagttcggtgttgttactaggagggagaagaataatttatggttaggggttctcataaatcatcttcttttgttagtctatactact

SEQ ID NO: 90476 - DNA, 639 bp, Oryza sativa
cttattggaaaatggtggtcgcaggtctatgggcataccaaattctgtgaataaaacgtaagaaatgaaatttttttgtttgaaatggcaagctgttgatgcccttctattgatgtgtctttccttatgctgttggtgcccttctattggttgatttatgctgtggaatcatgaaatattttcttctatttatatggcttattggctttccttatgctgttggtgctgtggaatcatgaaatattttccttttggatccgttacctgcttgattcatcgactgatatttcattcttgtcatggtgcacaggccattgcatttatgtattaaaacatggaatgcggatgtggtgaaaagatgggttgaagttgcatctgaagaggagatagctgaagcaattgatgtacctagccctgttgggactgctttgtgcatggcagctgctcttaaaaaagagcacgagaaaggttattcctgactttgttcatgtcacatccatacttacaaatagtcaaatatcaagagccatctcgttggttctttacatacactgaatgctgttatagaagaagcatcatgttagagaagagaactttgatattcacaactctgcttcttattccactaacgagagttgt

SEQ ID NO: 90477 - DNA, 742 bp, Oryza sativa
aatcacaacctttttggtttcaggacaccataacttatagcctttcacactagacggataaccaagaaaaatgcacttaatagctctaggctccaatttaccattatcaacaggagcataagcagtacaaccaaatactcttaagtctgaataatttactggggaaccagaccatacctcaattggagtcttcttatcaatggcataactgggtgatcattgataagataacaagcagtggaaacagcttccgcccaaaactgtttaggcaaacctgcattagacaacatacaacgggcctttgatataattgtcctgttcatacgctcagctacgccgttttgttgaggtgtgtgaggaatggtgtagtgacgcacaatgccttcagacttgcaatatgatttaaatatcttagaacagaactccatcccattgtcagtacgaaggattttcacctttctttcagtttgtctttcaaccatagttttccactctttaaacacatcaaaagcttgatatttgtgcttcaagaaataagccaaacttttcgcgaataatcatcaacgatagtcattatgtaacgagcacctccaaaggatgtcttacgagcaggcccccataaatcagaatgcacataatcaagaataccttcagtggtatgtgtagatgtgttgaacttcaccctcttatgcttgccaaagatgcaatgctcacaaaatttgagcttcccgatgctttgtcc

SEQ ID NO: 90478 - DNA, 1414 bp, Oryza sativa
ggcctgggggcctgagcgacgatgacgggcgagctccggcagcggcgagctctggtggtcgcgcgctggggcctgggggacgccgacgggccggcgctggtgggaggcggcgacggaggctggcggaggagggacggcggacggcaggcggcgctggcggtcgcgcggcgagggacggcaggccgcgcgcccgccggaggaggagggacggagggacggcaggcggcgctggcggtagcgcggcgagggcggtggcggcttaggtcgctggggggaggaggactggagccgactagtatacctggccaaatgggccgggccaaggcgtgccggcccgagcacggcagcactgtagccggcccaggaacggcacggcacgcccgctcgtgggccgtgccggcacgacccgttcagccgtgccgtgcttggcccgacgtctgagcccatgggccggtacggcaccgcacggttgccatcgggtcggcacgtcaacgccacatcagcaaaaccgccatccaaaaccgctgagggagtcaaattgcactagtttgaatagttcggggagtcatcctatccggttttacggttgagggtcacggattagattcgggtgacttttaagggagtcaaagtggacttttttccttttattaaatttaacattgaacatattttgataatatgtttattttatgttgaaaatgctagtatatttttttataaagttggtcaaacttggataaaaataaaagcaacttataaggacaagttcactgtacttctttgcttgataatactaagttcataaaactacatatacatgggcctccgcgtaatgacgctagcgtacacagaaaaatacaatcatcacatatataagcagcttcagcagtcagcatttcgcaacgtgcatactactagtactaagttactggtagctaaagctctgaaacaggctaatgctttcgtcgtcatcgtcctcttcagcttcagagattgcagtcagatcagatgacagatggtaaggctctactccaaggggttgctcatcatcacagaagaatggcttgggaggaacttggagatcatcgctgccaccttcaagcatctctatcacctcgctcatcgtcggtcgatcagatgacctcatctgaatgcaccgtaatccaacaacgcaaagctccttctccagctcatgcatgtcgacaatgtcagagatctcacatgtttctcgtcgagtcaactgcttgtacacccgggatggatagtatgcctgacttgagtttgctgcattcggatctgcatttcttcttcctccggccatttctagtagcagcatcccaaagctatacacatcagatttgcttgatatggtaccaaagctccgagagatcatctcaggagctatgtaacc

SEQ ID NO: 90479 - DNA, 1132 bp, Oryza sativa
gtagggcatgcccgcaccaaatcctgcacgagctgtttcatgttaggaaaatgaaaatcacgccgcagccggtgcagcgtgcgctggacgccttcgtgtccttcctcgtggacagccgccatgagctccggcagcagaggcgaggccgggggaatgtacagccgcccgctgtactggatcatcccgtccacggccgcccacggcagagcttgggagcccgaggtgagctcttcatgcatggcgacgagggccgggtcagtggtttgcgcgtggcggagcctgtcgacgaagtcaaagcgtggggccgagagcgccaagatggtgccatcctccggtgtgtcccggcgcgacagcgcgtccgctacggcattggcatgtcccggcttgtactcgacggtgaagtcgaacccgagaagcttccccacccagtgatgctgaggaatcgtcgcgagcctctgatcgagcaggtacttgaggctgtagtggtcggtcttgacgacgaagcggcgcccccacaagtacggccgccagtgacgtacagcgtgcacgaagccgatcagctcacgctcgtatgctgcgagcgcgcgatggcggggtgccaccggcctactgaagaaggcaacagggtggctgtcctggacgagcaccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacgacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacg

SEQ ID NO: 90480 - DNA, 1812 bp, Oryza sativa
ctgcaccccttgcacatgactacggcctttcacccacagtcagatgggcagtcagagtccgccaaccgcgtcattgtcatgtacctgcggtgcctcactggtgatcgaccgcggcagtggctccagtggcttccgtgggcggagtacgtcttcaacaccgcctaccaaacgtcactgcgggacacaccgttccgcgtcgtctacggccgcgatcccccatccatccggtcatatgagcccggagacaccagggtggccgccgtcgccaagaccatggaagagcgggataagttcctcgctgacattcgcagccgccttgaacaagcacaggcgacccagaagcgccactatgacaaggcacatcgccatgtcacgtaccaggtgggtgactgggccctactacgcctcaggcagcgcgcggcatcttcactgccacagaccgtcgccggcaagctgaggccccgcttctacggccctaccgcatcaccgagctcatcaacgacgtcgcggttcgcctcgctctgccaccccgagctcgtctgcacgacgttttccacatcggcctcctcaagaagttccatggctccccgccggatgctccaccgcccctgcctgctgttcaccatggtgccgtggtcccggagccggaacgagccgtcaagacgcgcctcgcacgtggtgtgcgccagctgctgatccaatggaagggagagtccccagcttcggcgacgtgggaagacgccgacgctttcatcgccaagtaccccgacttccagctcggggacgagctggctctcgatgaggggggagatgtcatgtggggccgcacgtacgcgagacgccgtcgcgcgcgtgacgtgcgccgcgctacagagcgcgcccagcgcacagctgaggaagccaccgggagtggctaagattagaaagaagggattagtttccttgtttcttccttaattgtaggcatgttcgattcagtctgtggactatttttgagtcttgtattcggcactgtggagaaaaaaaatcaagaatcactcacctaatctcctcttctctctcccaaacctgaacctacggctgaggggtaaaacctcgccggagaagacggattccggctacgaattacgtagccgcggtccagctaccaggggccttgacgcccttgacaacctggtatcacggtcacgccgatcctcatcctcctgctccgccgacccacccaacgccgccgctccattcccagccgccgcgccaccactcagccctccaccatctccaccatcagccacctccgtcaccgcaccaatggtggaaccctccaacgccgacctcgccaagctgatcgagagcctcaccggcacgatcgccgcctgcagaccgacgtcgcgacgttgaagaaggacaaggaaaagtcctcttcctcgtctggcccgggtggcggcactgacgggcaacatcacaacgaccgacccccgaggttcctgtttacacccaaatttagcacctaggcttaaaataggaaatattgccaaaatttggaagtctaccggtttccttcgaggtaggccagtctgactgccgtgtgttgggcggtcagaccgccggttgaaggctggtcagaccggcggtatgtggccggtctgaccggcaggcccgaatccgattctgttgcgtcgggtttcgaggtttccttgctcgggaaggcatgtttcgggtttcctttggtttctaccccgagttggacgtggagaagggcctgtagagggcaagaccaacccctatataagggacaaggccggttcattgtaa

SEQ ID NO: 90481 - DNA, 658 bp, Oryza sativa
cccgtgagccgcgacacgagcgggcagacggcccggcggtacaggaagatggtggtggcgacggtgaggatgtcgaaggccgacatgctggagggcgggacggagaagcccgggaaccgggtggtgcggcgcatcgcggcgccctgcacgacgaacagcgacgccatctgcgtgaacacgaccgaatagaggatggtgcagagccagatggggaggagccgcaggatgctcttcacctcctccacctgcgtcaccgtgcacagcttccaggggtcacgcggttgggtgcacgtgccaagcttcgggttagcgcccaccaccgccgcacggtccaagaacctgcaatacatggcgagttcagtgcgtgcatgcgtgatcagttcacagctcacaaaaccacacaacactttacctgaaaccttccgtgtgcaggagcttcctcccaccggaatccgccttctcgtcgctctcgtagagtgtcacggcgcccggcgactcgccggccttccagttcctgcacgcggcgaacgcgacctggaagatcctgccaaccgggttgccgctggggcggatgtaccggtagcggagcgtgccgccgaggaacagcagcagcgcggtggccgcggcggcggtggagacccagaagccgagcgcccag

SEQ ID NO: 90482 - DNA, 1828 bp, Oryza sativa
tcctcgccgcccgagacggggacttaaacgacgtgagacggcctcgcctccgcctccgcgcccaacaccacggcgcccgcccgcgcggggccgcttcgccaatggcggcgacgcagcgtcaccgacgccattcgcgaccggtgcgcgcgcctcgcccggtggcttgctcctcagccgcccgccggctgcccaaagaagtgaagagaaaagaagagagagagagagagggagaagggaaaggaggggaaagagggggaggcttacgtggccaggctggcatgtggagcccgtgtgggtcccacgctgactcagccgccacgtaggccaaaaccggggtcaaaaccaccgaaggatccattatgaccggttttgattagttaagggactccgaatatctggttttgtgattaggggacgttttttaactcggtgacaagttgagggaccttcggtgtactttttccgcaaatataatgctccaacttgatgactaataacacactagcaccagcagctagttgcttatttatagtagtatttcatacacggaaaaaattttaagcattagtaaatatcaattgttggatcgatgaatatggaataataacaaccattatttatgaacgctaattgctagctagattcatcattgtcatcacagcctagctactggctaattcagatattccatcgtcctcttctgaaattgcagtaagctcggaggagtgaaagtaagaatccatgacttgtggaggtggcatgccattgccaatgccatccccatcgcagaaaaatggtctcggaggcacttgcagcgcatccacacccccttcgagcatctctattgcctcgctcatcgtcaggcgatcgtgtgatttcatctgaatgcaccacagcccaacaaggcatagcttcctctccagctcatgcatgtcagcaacattggatatctcatcaacttgttgatctgctatcagctggtcatacacccatgctgggtagtatgccctgcttgcatttgagtttgcatttggatctgcattccttctacctccagccatctcaagcaacaacattccaaagctataaacatcggatttgtcagatataacgccaaagctccgggataccatctcaggagccatataacctactgttccccgtaaagccctatctgacacaaagctcttctcccttgggtacagttttgcgaggccaaaatcagcaacctttggaacaaagttatcatcaagaaggatgttgtgaggcttgatgtcaaagtgcagaatctgcatctcgcacccctgatgcaggtagttgatccctcttgcaatgcccaaagcgatctcattcagcttgtcccaggagaaacacttctctaatgagaagatgtatttatcaagagagccccgaggcatgtactcatagacgagcgctcttctcatttcttccgagcagaatccgaccagacgcactacattgatatggtggatccgaccgatggtggagacctcactaatgaattcatctccgttgcagttggagttaccggacaacatcttgatggcaacatgtacattgccggggagcagtacgcctttatatacagagccatagcctccttgtcctagcttgtctcgaaaatgggatgtgattgcaatgatgtcagtgtaggcgtacctcattggaccaatcatctgttgcatctggagaaacttctctaccgcatcgattgtgatccttgttttccagtacttgtgggcaaggaagatgaataccaccagcggcgccaacattaacctgaataaaactttgcagaaatgccaag

SEQ ID NO: 90483 - DNA, 530 bp, Oryza sativa
agtagcacgagtagcctccccgtagctagccggcgccgccccgaccgttgtcgccgctcgccatgtgctcgccaccgtcgccgcccgagctcggaagcgcctctcgtcgccggcctcccccgatgcgtttcctcctaatccaacgctagcatcggattcccgtagccgcataggtgctctcgccgccgggaatcggcccctcgtgacctcgtcgccgttttccccttctcccgccgccgtttgccgccgccgcgattcgccgccgtcaagctccctccggtgaatccgagccgttggctcgtctcccctcgtctcgtgcaaccacccggtgtgctcgctttcgcctgtatcgtcgtggttcgctccgccgctcgccgctgtcgtccgccgtccgttccggccggcgtcgtcgtctacctcctgccggcccgcgtggcagccacgtaggcgccacgtcggcgccagctcggccaaggccgggtcaagtcgaccccggtcagcccctccccgtgcgcgcgttccaccgcaag

SEQ ID NO: 90484 - DNA, 698 bp, Oryza sativa
ataaggtgccctacgggtcttccttacacacgtgatcttccaagcagcatagaatgccatttcaacgtcaccaccaggggttaccgtgctcttgtgtacaggttcaattagcataatcaatattttcagcaggctcatttcttatttacatattgttttgaatcttcctgatcgcttacgcttaatgctctgtaaaaaaaaaaaaacttatgtgggtgcagcggagaccacgaccctattgtgccattctcaggcacgcaggcatggataagatcattaaacttttccattgttgatgattggagagcatggcaccttgatggccaggctgcagggttaagtgattttcctatcgtcttgcatccccatctggtcttatctctgaaaacaatcgattgcatcatcatttattagtcactttcatttttaatatgaacgaaattagacataaaattgacactatgtttaacaaaatatgaagatgaaaaaagagaatgggaaaaaaatagtacttcttacaattggtagcttagtttgctaaaatttcttcttgacctgattagaggtgaatgttgttttcttacaccagattcacaatcaagtatgctaacaacctgacctttgcgacaataaaggtttgtctcgttctctaccccttcgttgggtccattcaccatttttgttcatacattaaatgg

SEQ ID NO: 90485 - DNA, 565 bp, Oryza sativa
taccaattctcccacttagaattggcctttgcaacatgtgtttaataacatcggcttgacaagtaactatgcatgtactagataacaaataatgcctcaatttggtacaagcatagtataagcatagacaaagtatctctataaaaacatacctcgtttcagcatccaaaagacggcggctcaaatatgtaatgatatattccttgccatcttcctcttgcgtcaaaacggcaccaatgactttgtcctcggaggcaacatataaccgaaaaggctttccggctttaggcgctcgcacaacgggtggagtagataaatacctcttcaactcttcaaacgtctctttttgttttgccccccaagtaaaatcggcttcttttttcaagcgaagtataggaacaaaagcatcgattttacccgctaggttagaaataaacctcctcaaataattcaccttacctagcaacttttggacctctttcttgcatgtcggcgctttgaaatcatgaattttttctatcttcttaggatcaatctcaactcctctctcatgcaccatgaatcc

SEQ ID NO: 90486 - DNA, 1090 bp, Oryza sativa
atatctaattaattatgcgttaatggctaagacgtatactcaattttctgttttccccttcttggtagcgcgtacgtcgtactacttataagtaggagccggccgagcgagcaacaagtagctagcttggtagcctacactagaatggaagcagctgctttgtcgaccgtcctgtgtgtgctcgcacttgtggtagcggatgcagatcatcacgtcgtccatgtccaaggacgacggcatcgtcagtgccaacctttctcctgcggccatctctcaaacataactcatccttttcgccggcgaggcgaccctcgcaggtgcggcgtctcgtcgtacgagctagactgcagcagcgatgatggcaaggccaccattcggatcaacacagggaaatactatgtgagtagcatcgactacactgcttccatcttttgggtcgtcgacgccaacctgcaggatgatgcaaacagcagctgccctcttcctcgctcggaccagctgccttacgttggtctgggtatcccaggatcacacgacagctgggacttgggccttgatgatatgattacttgggtcggctttgtcaattgttcgcaggaactaattacgaacagtagtagcaaataccagcccatgaattgcctgaccacgacttcgtcctacgtttattatatgctcccatcgtttggagcaccatctatccaagacatcgaaccttcttgtggatacttggccatgactcctatcggcggtggcagtaacggtaacagcattaatctgtccgaatatgaagatgttgtaaaatccatgaggggtggatttgccgtcaaatttcctacatatggaggaccttggactacttggtatggtctcatcaaagattgcctcaacgagtctgttaggtgagcgccttaattccttataatctcgaaacctttactttatcatctgaaaagggccgattttgtttagctcttctcctccaatcccgtttaattaactctttccaataaatgatcttgcagcttagctgatagccatgacaatccattacccagagtaggcatcaaagaccggatcattgacatcc

SEQ ID NO: 90487 - DNA, 1036 bp, Oryza sativa
aaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgacgcccgggggaagaggaaacagggaggaacacctcccccatctcctccccgaggggacggggcggtgcgtgccagccgcaggcgcccggagggggccgcgccgacatcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccaccttgtttgtcttccggttttttcttctgcttcagcgatgtcccgtcgcgttcctcccgccatcccaagtccggccaatccgaggccgaagatccggcggccgcagaggaacggaggcgagaatctgaccggcgagaggccgcagatcgccttcgggaagctgaagaggccgcccgggaggccgctcgggttcggcaggcggaggataccgctcaggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttc

SEQ ID NO: 90488 - DNA, 7761 bp, Oryza sativa
ttcttcagaaggaaaaacggcacagacacaacctttaggaaattgaaactgcttttattgaaatgctgaaataagaaaagtaaggctgtgcatgtgtggtagcccccggctaaccctgcacacccgaggggggtgcggggttagcccgagcccgaaacctgacacccgacccccccctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcacagtacatggtggcccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagtccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggccaggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgcacttggtgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggactagatatctaaggacgtctccggtcggggaggtcaaagtgacccccgcaccggcaccctggagggacagagaaccatcgaactgcatcacccagtgggtggtgtgaggcagctgcgaggagttcgtgctggcctcggggattgagacggtctctggagccggggtccactctgccacaaaatcggcgagggtctggctcttgatagcgtggcgtggttcaaagtgcagatcgaactcagaaagctcgattgcccattttaccacccgtcctgtaccctctcgattatacaagatttgaccgaggggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctttgctaggggccgtatccccggggcgttcttcattcaagtggcctttcggggcgcacttgtcttctgtgccgatgacctcggggtcggaggatgaaaggggcggccttccctcagtggcctcggggccgtcctgggggtcgggggctcctggcatcgtcggacaagcaggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcaggggccgtaggccaccgtccgactcgggggcctctcctccccgctcgctcccgggccaagttagcacagaatgggggtgcacgaaatgaggattgttttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagtgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggatagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccgatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgtgtcgcctcatgagtaggggccgcggcgagaagctctcgcctcatggccttgaaactccggtgagaaacgtgagcacacgctcccccatcgacagtggcaatggtggccccaggttcttggaaacctaggtcatcatcaccgtcatcgatgtcaacggcgggggccttctgtttggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagtgattcatcatcccctcgctgtactgcgtgcaagtccgcttcttcacctgggcgtggataagtgccttgaaagttcatggtgaactgctggcacaaatcctcccaggagtggaccgacgcgggcggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtctcgacgacgcggaaccggtagtggcggcgccggaggtcttggtggtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcaccgtagacgaggaggcgacgctccccatctcgccgttctcctgcaccacccgcgactggcgatgctgcggatttttcgactctctcgagtgcctccccctgcttaggattttggtgtggaggaggtgggggagtacgagctcgacggcgtgggtttggctccccgtcgtcgccgctcacactcggagagaggtcgtgcacctttgcttgctcggccattaggctgaacaagaaaaacttggcgcacacggaagagtatgagagctcagaaaacacacgctgagccccctacctggcgcgccagatgacggagctcgtggctcctcaccgggagaccgcgcaggcccccctttgccagttcggccgggggcttagggtgagatctcaagctctctctgtatgtggaaagatcgcgtgcccggaagaaacgcgagacacagacgatgtatacaggttcgggccgctgggaagcgtaataccctactcctgtgtttttggtggatctgtgtaagagcaagttacaaaatatcaaccagccctctcctctcccgggaaaatcaaaatccccccttctcttcgtgggcatggtccttttatctcttaaggggataccacatgtacccttccctttttaaactggacttttcttctttacataaatgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgagaagaaataaacaaagttgaaaaggtttataaaaaagaaaaaccctaaaagtcttctccccccccttcctctcttgggccggctcggcccaactctccctccctctctctcctctccccgcggcccatcagctcccccgcgcgcgcgcgccgctgacaggcgggcccgcccgccactctcgctgacgggtgggacccacttgtcatcgccttcctcccgccgcgccgccgccagcccgtgccctagcgccgccgccgccgcgaatctcgccgtttcccgccgtccccgcgcgcattaaagagggggaaaatcacccccgtgattccctctcccgtttcccccccttttccctctctctctccctcggattcgtccggattcaccccgcgaagttcgccggcgtcttcaatggcgcccgagatctccgcgcgcggtttcctctctccccggccgcgctctccccctcccgttgctatatatttgctccccgtgcttcgctcttccgtttccgccgctcgccgctcgctctcgccgtcggattcgtgctcgcgccgtgctcctctctctccgccgtcgccgtcgaccttcggctcgccgccgacgtcgctccggtctccctcccgactcggcgacacctccatccgcttcgccgtgttgccgccgaccccgtccgccgctccgcttcgtccgccgactgccggagcaccgtcgccctcggcatcccgaaccgcgccgtcgccttcctccgctctggttcgccgccgtcgtcgctccggtc

SEQ ID NO: 90489 - DNA, 703 bp, Oryza sativa
acacaaatcttcgatggttctagttacgttttattttcattgagtgagtaacaaacttgccatgcatctaaccaagtttctgtgcgtttttcaaaagtgtattttgaactcggtagctacaagcgatgggatcaacggtgcaatatgtgcacaaggccgtgaatacgcggccgatgacacgggctttgcctttgtcaattgtcgcatcaccggcagtgggctgattttattgggccgtgcatggaggccctactcccgcgtggtcttcgcgcacacggacatgcccggtatcattgtgccgagggttggagcgactgggacgacccgcaacgagatgcgtacgtattctttctactactacttccgtttcattttatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggtggttaaaaccgttcaacgattctcttatagttaattgagtacaataccatgtaaataatggcgggggtgcaattctttgtacttaacacggttgtttagtactactaagggaccacctatatattcgtcgataaattttct

SEQ ID NO: 90490 - DNA, 690 bp, Oryza sativa
ctagaaacccactccgcataacgacatggcctaataaaccccgcctttaataaccgatcaatctcctctttgactcggtcatataataaaggattaaaacgacgaagtggttgcttataaggcctaaaacccggtttaactggaagccgatgctcaacaagctcacggctaagacccggcatctcatggtactcccatgcaaagcaatcaacatactctttaagtagctcgattaccttaaccttataatcggctttcatgtttttctgtacaaaagtcggccttggtttagttccatcacctatatctacttcttccaatggatcggccgatgtaaacccttgtccaagcttctcaacttcatcaaaatcttcaacagtttcaccaatatcgttctttgtagaccgatattcttgcaccctcttttgtaaccactctaaactagcctctttactcattatacaaatttatatggcttagccgtgctacactagccggctttacagagataggtacaaatttgccatcggagatactaataaaatcataactagaaagatccctccccgataagcattggatattcccatgacgccactcaaacgtagcatcggccattgcaacttcggccgatgtatccgcttgaacaatttcaacatcatcgccgtcccattgaattaaacattgatg

SEQ ID NO: 90491 - DNA, 704 bp, Oryza sativa
ttctcccatagccactttagattgatctttatctaagcacttcaacaagacaccatctatgtttcggcgatacaaatctccttccacaaattccttcatgtatttctcccatagccactttagattgatctttatctaagtactcaacaagacaccatctatgtttcgacgatacaaatctccatcaagcaatgtatatttgaatgcttgccgccgaatttttcgatcaaccttaaatgtgggatctttcaaatattgaatcaaaggaattctcgaatcctcttctgtatcctggacacaaacgtccgaattcacaattaattcggcttcaaaattacttgaaacgtgccccccagcattctgcctagaaccggtcagaccggccacacagggccggtcagaccgctcagggatgccggtcagaccggcggcatgtggccggtcagaccgcccctggtcacggtcagaccggccgtgcaacgtcggtcagaccgcctctggtccccaactttgccaattttgcgcaaaaatttaaaatcaagcaccggctcttctaatatcagaaataaccccctttttacattataaccagatgtttgttgtgccaagtcatttgctctaaaattatcacacctagcaatatgtctaatagcaaaattatcaaaattggcaataatatctaaacatgaatcgaggtacctatt

SEQ ID NO: 90492 - DNA, 700 bp, Oryza sativa
tagagaagctgaacttttttgttagtaacacattgcacatgcaggaagaagctgttatgaaaatagatgcacaacggagacataaattttacgtggaaaacccttgcgggaaaaaaccacggacgccgaccggcaatgatcactatagaggagatgattacaaacgtaggggaatcacaatggaaacgtcactccttcccgtacggcttacaagagtatatataagggataatagaaagacacctaataggactcatactaggaaactaatccgaatatattgtgggcccaaaattcggatcacatatttaacaatctccaccttgagacgaatttcctcttgttgcataaaaacatcaatcaccaaaaaatacctcatgtaggtaaaatcaccgcgcgccaaatagtctctaggactatactgtaacacccaccaagcttgagcaaagctcaaacttagtagcaggaactggctttgtcatcatatcagctgggttatcatgagtacttatcttgcatactttgacatcaccttcagcaatcacacatcgaataaagtgatatctcacatcaatgtgctttgttctctcatggaacaaaatctattaatgcaagacgtaactccacaaagctcagtgtacaaacctctaagccaaatagcttctttacaagcttcagaaatagccattactctgcttca

SEQ ID NO: 90493 - DNA, 1132 bp, Oryza sativa
ggaccagcgaacctccatgccgtggcgcgagaacgacatggtgcgcgccgtgaagtcccatgttatcggccccagggtaaccatccattgggttcccagaacgagatcgtatcccgccaacggcatgacgaagaggtccacgtggaactcctctccatcgatggtgatcggcgcctgtcggagcacgcccgggcactggatcttctcgccattggccactgtggccgtgaggcgcggcttgggctggatggccaggttggtgcggcgcgccgcctcctcggcgatgaaattgtgggtggagctggtgtcgaggagggcggtgagggtgaccgcgcccagcatcacccggacttgcatcgtgtcgcagatcgggactcctgcgaccgcctgcaaagagaagacaggggcctccccatcttggtccgcgtccaacgcggcgtctcggcgtcggtgagcgtcacgccgtcgatgtagaagatgcggcggcagacccggttatggccacgggagtacttttcgtcgcaattgtagcacagcccgaggcggcgacgttccgcctgctcctcctgggagaggcgtttcaccggtttggcctccatcttggccacgggtgcgctcgccggcggtgcagggagcgcgaggcgctggggcagtgccggcagcaggccgcggggcgctggccgggcgggaactggagccggcttgtcgagctccatcaactcaacttgacgggccaggctcatggcggccgcgagcgactgcgggttgtgaatccgcacagcgtgactcagcggcggaaggagtccccccgtgaatagctggaccagctgggcttcctgcagtggaccggcgcgtggtaggagcgcctggaagctgttctggtactccttgacggtacccgtgcgccggcactcggcgagctcgaacagcggcgctgagcgcaggggcggtccaaagcgcaggtggaggaggtccttgaagcgattccatctgggagtaccctcgtcctcctggagttggatataccacaattgggccacgtcctccaggttgtatgaagccatccatactttctcctcctccatgatgcgttgttgatggaaataagattcacatctgttgacgaagatca

SEQ ID NO: 90494 - DNA, 745 bp, Oryza sativa
caggcaagtggacaaggttcacgtgcttccaacaactttggtcgaggccgggtgaaccacattcaagctgagaccgctcaggatgctccagacgtcgtgatgggtatgttctctgtcaactccgtacccgcaatagttctatttgattcaggagctttccattctttcatatcacaagcttttgtgaaaagaaatggttggaaaacccaaaatttgcgtgtaccaatgatagtacattcccctgggaggaatataagggccactcaaatatgcccggaagttaaccttagaattgaggaagttgactttctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacctctaacacccctaccgcaagtcggtctatcctaacctgtttacaagtcacctccttggagtcggtgcccatagtctatgaatatcccgacgtatttccagaagaattaacgagtatgccaccagaccgagagattgagttcaccatagaactggcaccaggcaccgcaccaattgcaaaaagaccctaccgaatggcagctaatgagttagcagaagttaaaagacaaatcgaagaattggagagtaagagttatgtgcgacctagctcatcccctgaagagccctagtggg

SEQ ID NO: 90495 - DNA, 738 bp, Oryza sativa
tgcacccctgcctttcttgtgtccattggttggcacaatggcacgggcgtatggggatgctcatgtcgttgtttgggaacaatgtgctgacttatctgaatgcgtctgcaatatgactactatcctcttgcacttcaaaagccagaccattgccctttttcacttttgctttttatatttcagtacttcatataactagttatggtaagcattgttagtcgcttcctttttttatcattatttttatggctatgcattaatatcctttgtgttggtctgcaggaagttcacaggatcaaacgtgaacatcctgatgatgatcagtgtattgtaaatgatagagtgaagggtcgcctaaaagttacccgggcttttggtgcaggctatctcaaacaggtaattgtgatactgtttgagtgggtcagccattcttttaatttgattcttatacttacgatgtttgttttgtgtggtatacatatccatcttcagagcaagtgcatttgttgtcagtactttgtacttttaactagaaactatatctgtcatgtgttctgattaatccaatgccctgattgaattaatatagacactagataattcttgatcatagaacttcgtgtatttgtgcaggcaaaattgaacaatggattgttagagatgttccgcaatgattacattggtgatacaccgtatatatcatgcacaccatcgctttgccatcacaagctcactgca

SEQ ID NO: 90496 - DNA, 771 bp, Oryza sativa
cccctttcgccgttttggagttgtcccgtttcgcgtgtagtttcggagcccgaagacccgcagtgcgaggatttcgaggatcaagcccaagatctcgagcaaggcaagccacctttgaacatcttgagcctatatttgaagttaattatgttgcttgaaaaatattatgcattgataggatcgcacttaatctgtttgtcccgtctacaaggcagattggcggacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtct

SEQ ID NO: 90497 - DNA, 1439 bp, Oryza sativa
  unsure (1)..(1439): unsure at all n locations
agtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcttattcattagtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcaagtataaattcgccctcccccagagcggcaagggggccgcctgcaaaattccaggccccccgccgcccatttgcaggcggccccccngacgctacggaggcgggc

SEQ ID NO: 90498 - DNA, 828 bp, Oryza sativa
atgtccatctctcttgcagtatttgcatgacttatacctgcctctggactttgatctcccacggtagctacttgagcttttatctcttgatttgttgtttgtgttcttctcctgttgcctaccccgacaaccaagctttctgcttgtgaatttgaaccttcagagggtaccatcttcttcatcttttctttggcatgcaaagcatcataaacttctttcaaagttagagtatcacgactataaagaatagtatccctgaagtttgcatatgagctaggcaatgaacacaataaaataaggcctaaatcctcttcatcatgctttacctccatagactcaaggtcagcaacaatttccttgaaagcggagagatggtccatcacagactcatcatcttgcaacttgtgcaaaaataacttttgcttcaggtgcatcttactggtcagatccttagtcatgcatatctgtttcaatttcaaccacagcccaacggctgtctcctccttaagcacctcctgcaaaatattgttagatagatgaagatgaatatatgacataaccttatgatcctttttcttctcatcaacagaccaatcctgtgtcctcttatcaaatccagaaagcgcatcatcgaggtcttgttgtgcaagaacggctcgcatcttcacttgccaaagtgagaatcttgtgtctcggtccaggagcggtagatcatacttcaaactcgccatgggaattaatcctgaaatttgctagtaagaaattagggtaaactagaaaaaaacacgaactatggtacacctcctgtgtgcaccaagcgaagtactg

SEQ ID NO: 90499 - DNA, 1248 bp, Oryza sativa
ttgcatatcacacccatgatgcaggtagttgatccctctggcaatgcccaatgcaatttcatttagcttatcccaggagaaactcttttcagacgagaagatgtacttgtcaagagaaccctgaggcatatactcgtacacaagcgctcttcttatttcttcagagcagaacccgacgagtcgcaccacattgacatggtggatcctaccaatggtggagacctcgctgatgaactcttcccctttgcaatttgcgtcacccttcagcatcttaatggcaactcggacatcaccagggagtagcacacctttgtagacggagccatatcctccttggccaagcttgtctctgtaatgacttgtgatggcaataatgtcggtgtaggagtatctcgttggggtcagcatttgttgcaattgcagaaacttctctacttcatcaactctcatctttattttccagtacatgtaggcaacggaggtccacatcagcagcatcaccaggacgaacctgcatgctacaccataaacatgttcatccctgctgtagagaccaagtgtatgaacaaatagagcatgacgagactacaatacagcgaaaaaggaaaatgtaactgaaatttgatatgtgtgattgtcacgtaccagaaatgacccttaaaatccagaaagtttgtggcactaacatcaggagcacaacaaaagggtgtggaagttgagttgcatggcggccgcatatcgagaagtaagaattgatattagtaacaatgacgaagatccgatatactgtcggttctccattactgtcgctgcaagaccacgatgtcatgcatgagccattgtacagcaaagcaaatttccaagataatgttatttggcattggtaaatttcactatcaagaatgtacaaggaagacgggccaaagtgttcagttttaagtcccaaataaattgactcacctgatcaagccccttaggcagtcgatgaatcccccagacctgaaaggaaaacgaacagcgaatccttcactcatggatctgacaacatcttcataatttacatcctccagtgtcgcagccgcagtagcagttcgccaattctctagaccacccagagctaaaggagtcattgccaggtatccacaggaaggctcaaggttctcagctaaataagatcccagaccagttagcacatacacgatagaagagttgccgcttcggcaagccacaggcctgtacatgacattg

SEQ ID NO: 90500 - DNA, 1439 bp, Oryza sativa
tagtaagttgttcaagagatttatcaagagatcagcatggtgtagttggcccaataatttgcgtcagtaacaacgcaagccagtggtatttgatacatccttatgcatattgtctgttcttcagccagactgcaaagttgttagtaatggcatccaggcaccctcaacttttaaggaaacagaaaatggagtaatcggtgttgatgagttggtattcacttggtactccagtgacataaccagagattgtcaaaaatgtgaaaatgaagcaaacactgtggtttcagctcacaaaggggccgagcattctcaattatggtattttctctttctgaagcagaaatcttacatcaatattatgacttgctttgcctcggtaggaaactctatggtctttaccttttcattctcttagtttaaagtttgccaattaaattgttcaaaagatttccatagttgaattagttgtaaacactgcagatcagagcagctgctagccaatggaagcataccaaagctctaggttcacatgcatggttattctaatttaaaacgcgcgcacacaagagaaggttataaccgattaagagtaacggaatttttttgaaattcttaaaattaaaaaaaaaaccattcatctacaaggtaacctagatcaaaatgaatttttctttaggattggagcataggcatcccttggtaactagagagggtgctatgaatgaacacactctccaaaataccattgttagtatcaacgtatagtttatttgattgtaaccatttggactggaccgcctatacatgttccaagttaaagaaaaaaaaagaaagaagaaaacataatttacttagcaacaactgctaagcctcacgttggttccatgtattccagccatagaaaccacacccacattccttaatgtcaatactatactctctactctagcttatcactagaaccaaggatggacatgctctcagatttgatgtggtgttctggttatctttaatttctcactttttcacaataagcatgacctgaactttggcttgtcagcaccttcttggatacatattcttgaaaaaaacaccatactgggtacttgcaaaaggaaaaaagaagaaaaagtgaactccatgtagggtcatattgatattttaattctgaactcttgcatacctatgttagatacacagaaagcaacaggatcttcagcatgaacatgtttgcacgagttctaggtcactggtgatccatcatgaaacacagcttggtgcccaaagaaaccagcatcccatctgtctattgataatatatatttttttagagtaaatttcacttagagccatcttttattactgatatttcgctttggccctttaatcaatgttctcactttcgaccagtctttgtttttaacctttgtggcactttg

SEQ ID NO: 90501 - DNA, 798 bp, Oryza sativa
gattgtagcttcagttttgtagcatacctaactgaggtcccaactcccaactgaccaaacaatatggactgagtgttatgattaggatttgaatagaacttttgagatagggacaaaatctcaaactaattctggtgcatactctggtggaccaaattctttcttcggaatgaaaaagcttcatgatttcactagttttggaaacttttaaaaaattatgtaggttgatgttactttcacagttcaggtgtcttcacccagttaatcacagaataagactggacatctaatcccactcccaatcagatgagtaatgttgagacgtgaaacatggatgatgatagaaacaaactataaagtcttggaagttaggactttgtcctaatgttggacaaaagttggagtgcatatgagtgtggtagttggtaatcactgactttgggagccagcaaggcacatttacgtgacattttttttctatagtgttaatagctactgttgtgacaccttgttcatgaatagctgccaaacattcccagttgcttctttcttttatctgatgacaatcttcgttttctttcatcaattcaggcatcaagtcctttacaagtaaatatgctgatggagagttggagagactaggtatgattgccctttacatagaactgttctttttgccattgattttattgcactcatgcttgtacttgctatgatctccagaacacaagctttttattggaatgcttccaaaaaatgtaacggacaccgaattgactgatttatcttcggggtgca

SEQ ID NO: 90502 - DNA, 657 bp, Oryza sativa
ttgtgaagccgattgagatggattctgcagatatttaaaaacatcatatctccaatcatcggctgtgatcatagctatctccacctcaacgtcctttatcatcgacttgtatcctgatgccccttgagccaaatcattagcttcaacattttgctcccgagatacatgctttagagttaccagccgaaaactattcatcaattctcggcacttctcattgtagaacatcaatgtatcatttttgcattcatattctcctgccaactgactgatcaccaacaacgaattacccataatttcaacagcattggcttcaaccttcttgagcaactgcaaacctttgagaaccgcttcatattcagcttgattgttaattgcataaggtttgatagtataggcaaactcaaaacttgccccccgagggaaaattattaccaagctgataccacatccatgagtgcagaccgatccgtcgaaaaataaagtccaaggcacaatatcaactgagccgattgaatcatcatgatgttccacaataaaatcggctatagcctgccctttgattgccttgggtaattcatatctaagatcaaattctgttaaggcaaatatctactttccaactcttcctttgagaaccggagccgatagcatata

SEQ ID NO: 90503 - DNA, 1544 bp, Oryza sativa
gttgtttgtagagatgtcgacgtcgaggatgtccagcagcgcgggcaacctaaattgcctgtagtcattctggcacttgcgcttgagccgtatgtgccgcaggacgacgtagaccaggatctgcccgtggagacgggcgtggcgacgactcctttaagttggttcttgtcgtttccatttcctttgctcttctatcttgattagcttaacttaggtatttgcttgccgggcagacctcgaaagtgcgcttgcttatcgcgactgtcgcatccaatactggaggatgaagttcaaggtcgccgaacttgaggggactatgttggaagtgaagagggactgggccgtggaggcactccgaggtcgcgaggtgtggttcaactcgtacctcaggagttgttgcacaacctcgcgaggatcccgaggagtcagcggccggctatatctcgtggccgttgtcgtagacacgggtcttgatcccttgtagtactataccgtttgccctttcgacctatccgttactctgagggtgagaaaccgaggcgaagcatatcttgactcccagtccaatgtagtaatcctggaaatcggcgctgatgaattgggagccgctatccgttatgatgcggtgaggcaatccatatctgcaaaatatccccttaatgaatttgatggctttgtcggccttgatttcccccgtgggtgttgcctcgatccatttggtgaatttgtcgattgccatgaacaagaatttgtaaccgccctgtcctcgtgggaatggaccgagtatgtcgagcccccagcacgagaacggccaagtgagagggatggtttgcagtgcttgcgctggtagctttgtgtgtttgctatgaaattgacaagcttcacaccgttgtaccatgtcgcaagtgtctttgagggcggttaggcagaaaaatccttgtcgaaaagcttttccaaccaatgtacgactggcggcatgtgatccacagaccccttcgtgtatgtcgaggaggaggtgtttgccgtcgtcggacgagacgcatttgagaagtaccccgtttggcgcctttttgtatagatcgttgccgatcatacagtagatttttgcttgacgggttattttctcggcttctgcgtcgtcctcgggcaactcgtcgctgcttatgaatttaatgagtggggtccaccagtcgtccgtggtctcgatgtcggcaacggcgtgctctgcctctgtagccccctgagctgatgtcgggggtgactgggctatcttcgtcgtttgcctctttcaccgatggctttttcaggatgtccagaaaggtgccgggttcgagtggctctcgtctggatgcacgccgtgctagatcgtctggctcgatgttgtccttgcgatatacgtgtcagacctcgatcccatcaaatcttttttccagcttcctgacttctgcgagatacttggacaactcagggctagagcatttgtaatctttgtgcacctagtttgcgactagttcggaatccccttttacgatcagtcgcttgac

SEQ ID NO: 90504 - DNA, 3343 bp, Oryza sativa
cagtttgcccgacggtaccccgaacgtgcacttctcagaattgagcatgaggcgatatcgtctgaggtcgtcgaaggtttcccgtagatcatcaatcaacgagtggcatgtcttggtagtgacaacaatgtcatcgacgtaggcctcaacattgttacccagctgatcgctaagtgccccttggaccgtacgctggaaggtatttcctgcggttatcagtccaagtggcattttaacgtagcagaatacaccgaacggcgtgatgaatgttgttttctcctcgtcctcttttgccatgctgatttggtggtagctagagtaagcgtcaaggaagctcaagagctcgcaaccagctgttgagtccactagttggtcgattcgagggagagggaagtgatccttggggcacgccttgttgaggtcggtgaagtcgacacacatcctccacttcccgtgggccttccgcaccatgactgggttggctagccactctggatggagtacctctctgatgaagccagctttgagaagtttatcgagctcttctcgtatggcatgtttccgatctggtgcaaatctccgcagtttttgctttactggcttggcatcgggtcgcaccatgagtttgtgctcaatcacctccctggggacccccggcatgtcggacggctgccaagcgaatacgtccgcattgtcgtggaggatggtgatgagcgcgagttcctatttctcattcagtgatgccccgattttgactgtcttgtcggggttggcactggagagtggaacgattttgattgcaccgtctggtttcggcgtcttagtcgttttgatcactttcttgggtggctcggctgtggcgggtgggctgggcgtgtgttcgaccatgtcgaggctccgcttgtcgcattggatcgccagctttgcgttcccttgaatagtgattgttctcttcggcccgggcatcttgagtacctgatacgcgtagtgagatgcggccatgaacttcacgagtgcagttcttccgatgatggtgttatatgctgtgtcaaactcagcaacatcaaatgttatctgctctgttcagaagttgctcgcttggccgaaagtcacaggaagcgtgatcttgcccaatggcttggacgaagactgaagagtgattccatggaagggttgatcggtaggtgtctgttgacaaaaaaatcgaatacaccggcctgggagatctgcttagctcctgtgtaggtccaaatatgatgagatgcgggcgtgccagtcagtttgatcctgcaactgacaagatatgcaaatagtagatcaaaacagccgatcggctgacaagccgatggagtagttccagccgataaccgataatagccgatgccgataccagccgatggcgatagggtttaagaaatcggctatatgtccaatgtagataattatataaaggcaatcagctgataatgatgtaataaaataacaatataacccaatataaaccaatcggctagcaatgatatgataaataagcatcgatccgaaagtttaagcacatatcggctggaggtccgatgtcatgaaatccacaagattagattaaacagtgaaacctttgttgtcatcggctaaatccaacttatatgtatatgcaatccttatgagccgatgcaacgtccagataattcaacggctgaaaccccgatgaaacccttatcggcaatcaagaagcaggctagagattatggttctaagcacaacttagtagatcaaacttaactgattcagcactaagtatgaaaagaaacacaatatctagataatcaagccgatgactgattttcagggtggtacatgcctaagctaatctaatctagcaacgcgatttagccgatatcggcagaaaccctaaaacgagaagcagccgatatagctaaattgatatgctaagactagattaatagagacatatgataaataggtaggcaaatatatcatccaaactagagcaatccaagaggtcgaatgtactgatgcagccttgaacgacgccgaagtagatgagacaattgcctgggccgacggaacattggacttaccccttcaccagagattgaacaccgatgcagccccacgtcaggtgccaagtcccgctggacgataaaataaagtagaaaaggtaaaaggtggtgatgcgccgaattgtattgatcgtagtgataaattatatagacccagggtgtacatatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgctacatcctctttaaactcggtcacttagggataagcttcctttagtagattgatttccttaaccgaatatagcaggaatccaactattggcgacttgataactcccatcggctgattccgagatactgtagccgataatgattctaagccgatgacgtctttgccgattaccaaatttcactgttaacagtgtcaactcgcttcgtggaatttccattgcgtccaaggtgctggcgaagagaaggttgatggagctgccgccatcgacgaggactcgcgctaccttgatattccgaatagtgggttcaaccacgatcggatatcgtcctgggataacaacagccttggggtggtcctcatctgagaactcgatcttctgttcagaccacttcatcttgggtgcaaccccttgccatgtcgaacaaacctcacgctccacttttttgtattctcactttgaagattacgctgtggaacctccgaagccgagtccgactcctgagtggttgcctcagtggccttctcgactacacgtactcgcttgcccttctccaaagctagttgcttttccagcgactttttgaagatgaggcactcctctagagaatgtctgtccgacttgtgtatggggcaccatattctcttcgtatcactgccttgtgggtctgagtgtttgggtggtcgcttgtatttagacgcgaggacttccgcttgagctttcctcttcccactcttccgcttttcttcttgcttggttcgagtgcgtccttggctggcttcttctctcctcctgcctttgtcttgtcactcttgcgtctcagtgcattgtctgcatgggcgcatcgatcgacaacctcgaacaaccttcgagtagttgtgatttgccttgttgccaactcctgggtagtatagcgatctctgacaccagttttgaaa

SEQ ID NO: 90505 - DNA, 1850 bp, Oryza sativa
agggttcaatagccttccggaatggatagggcagttcatttatctgaaagaaattagcatcttcgattccccaacttgacatctttgccagagagcatatggaacattaccaccttagaattattatatatttatttttgtccaagactggctgaatggtgccaaagggaggatgctaacaagatatctcgcatcccaaagattatgttagatggtgaaatatttataccgggacaagcaatcgatggatgagaggtatatgagtaataactattcttttcattcatctattaacgtttgcatttgcttcaacattatattttgatctagaaattcaatgatgcaaataatatttgtcttgtctggtatttgttctcacgtcatccctcaacgttttgcaattagttgagctctccaatttccaactgagtgtgctctaaacctgtcacactgtatttgattgctgctttatgaacgaatattttatattactgatgttaatcgattcctcagtcctcacctagctgtacacgtttcttaacttgtctgtttttgttttcatcttgtgatattttcagcacaagcaaggtttggctaatatgctatacttttgcagagcgaatcaaggcagagtgaaccatagatcaagcggtcttttgcccaggacagaatgtgtagagagcaaaaaaggagggacgaagcaaaattctaaatcagtcaattccaacaacttctgaatattatttcaccttcaaggtatactaagtctccactcccatctgtctattacatttttcacttgctggttggtacgtacgctaccgcattttgaatcgacagtaagctaatcgagtactagcatctatcagaggctggaagctccgtcaggggcgtcctctggcctcggccgtggtactcgaagctgtcgctcaagcggcagttcgccgtcacaggcgccacgtccggcgtggcgtgtccttcttcgggagtgggccgtacaatctgatgccgctgtccgccgacgccgtccgacgtgagcagcatcctctcctacaacgaccaaggtcaggaccaatgaacccctcgacgaacagcatctacctccggggcatctccgtcaaccaagaagaagtccggccgcctccctccaggcgtcggcgtgctcatgtcatgactcgacgtggccgcgcgcgccctacactgcaccgtcctgcgacgccaaggaaggcgacgccaccgaggatcgataccgtgcatgccgagcgtgagcccgttggaggattcacctgcgcccatgacacgcggaggcggcggcggggaactggatgatgatcgatcggtgttgagttgtgaaccaaagttcatttgcacataataaatatcagtttctgctggagcgaagcgcccccgcggtatggatcgttatcctttagggtttcaccttcatgtatatacctcttataagccgccattcggtgttgtaactttaccccgatacagtgaagatattttattggctggtgtcagtgattttttctctcctctattgttttttatgtttatttgcctatcgtttcctatcaatcgggtccaactcgctagcgcaggtggcgagagcgacacggcgtgcttggcgttcgtcgactgtggttgggcagcgacgatgagcgcggtgaccgtgcgggcgttccagatggagaacgtacaacgtaacttgttgctgttcgatgaggccgcgtccagactactaagctggttcagtcagtggcaccctttggttcatcaggatatcttgggttggtttggtttgtggtctaaataggtcttaccaaattttgtcaatgccaaat

SEQ ID NO: 90506 - DNA, 955 bp, Oryza sativa
cgacctgtgcctataatacatatatatagcttctgtggtgattgaacttacagtttaaccgatgatgctgcggccacggggcttcatcaatcctttatcttgcaaaatgtccctgacttgcactgcgccactccacatgtcttgatacgcatacaggttagacatggtcacataatatccactattttcaggctccagacagagcaaatgcttggcaacggattcacacatcttcagttcagatttcttgctgcaagcacttaacagcgcaccccagactccatgtgcttgtttcgatggtaaactctccacaaacttatgtgcttcctgcagccgaccagcacgcccaagcatgtctacaacacagacatggtgttctggggttgggataatcccaaaatgttctatcataagatggtagtacttcaatccttcatcagtaagtccagagtgactgcaagctgacaacagagcaataaaagtacttcttgtagctttcactccagaattattcatcttccagaaaatttcaatcgatttcaacccaagcccatggaatccaaaagctgatatcatggaattccagcaagcaatcgatttttcagcagaagattcaaatactctgatcgaaatgtccagtcttccgcacttactatacatatcaacaagtgatgctgaaataaaaacgttagtttgcagaccaaacctgaccacatgcccatgaatgttctttccttgcctaagatccccaagttgagtgcaagcacagataatgccgacaatagatatttcattgggttcaaaatcctccatcttcttgtagaactgaaatgccctcaagccttcgttattctgtgcaaaaccagagatcatgcaattccaggagcacagatttctaccaacgagactagagaaaattaactcagcactttcagtatctccaaatcggaagtac

SEQ ID NO: 90507 - DNA, 1145 bp, Oryza sativa
ggttggtgtactctcccgccgccgctgatggcgacattgtcttcaccaccagctgccgtcatcgccgctgaccggtttcttcgccaccacagttggtgtactccgccgctgtcgctgatggcgacattgtcttcaccgccggctgccgtcatcgccgccgactggtttctccgccaccatggttggtgtactccactaccattgctgacggcgacatcatcttcacagaccggcttgccttcactgccaccgactggtgtctctgcctacacggctggcctattatgccaccgttgttgggcttctacgacttcaccgtcggcttgcctctatcgctgccgactggtgtcttcgcctatacggttggcggactcagccaccgttgatgggcctggtcatctacaccgccggcttacttccgccgccgctgaatggtgttttcattgccattgatggacgactttgttcccacatcagccacctctgccgtcatcaagaggaatattacaaagctaagtcatcatttttccttatatgatattttccttatcctctgcctcactacatcaactggttcgccgttgacttgtgagtcgggggctacagatgttatatcatattttttaaacaattttcataatatttatcttgattgcttgcgacataatctgagtacaaaagtgccaatcgagttatggagttctatcttcctatacttttcgtttggtttgtcgatggatagttgcctttgggctgattcctagcacccgggggcttattggatggaccgagtaacgcaaggtgctaagtattattaggaataaatcaaaagcatagagataagataaatttattttctgctctttacaattacaaaagtacccgagtagtaaattctgattcgtgaaactttgttccattaatgatgaactcatgtcactcatatgcatgtttgggaagtgcctaggccgactcccgatgcttgtgggctatgactagttggacagagtgtttaaacgtacggaatcatctgctcggggaaatcaaaattgacaagaggagaaatacatatttataaacatttttaaatacttgaaatttcctcgagtattatatttacatcaaatactactcatcccatatgt

SEQ ID NO: 90508 - DNA, 799 bp, Oryza sativa
cgcggcgatggcggcgttgtaggccttgaggtcgggcttgatcccggcggcaccccgcgccccgaagacgggagaagagcgcgagcgccttgggcgcgtcgccctcgcggagggcgaggtggatgaggttggagaagagcacgaggtcgggagccacggcgtcgtcctccatgagtggcagaaaggtgagtgcgtggtcgaggtggcccgcgcgggtgagcgccgcgaggagcgtggagtacgagaacgcgttggcggcgacccctctgtcccgcatatccaggaggaggccggaggcgaggcggagcatccggcgcggcacgtggagcagagcaggaggttgtacaggatgaggagcgcggaggtggggaggtctggcgcgaggaggtcgagcagcgcgacgccgcggcacgcgtcggggaggcgggagaggagcgtgccgaggaggcgcggggagacggggcggtgcggggagagcgcgggggccaggtcgtactacctgcgccggctcgcgtcgtccgcgcttctctggctcgtcgtcgagtctggcgctgcgacacggccgctcctcctccatccccgagcagcgccgcctcttttgttcgccggaggagaagaagaaaaactgcaggagagagagaggggtattttggtcagctgaagtgggaaaaatggtgaaaatcttgtgaaatggtgaatatagcaaagcaacggtatggcatcggttggaaatgacattttaacgacgccattccgggaaatgtcattgtggcgaaacccactcttggcagtggcagaa

SEQ ID NO: 90509 - DNA, 585 bp, Oryza sativa
tatagtaatttcactccatattaatctctgaaatgcttataggggtatttacgaatacaaaattgcactcatagaagaaacgcaatcaatgcacacaccaaacaactcatcatgtatcgagcttatgatgatcagaattcataggtatttacactgaaagagcacacagtacatgctcaaggcagtgtgagggggaaaaaaggagaaaaaaaaaggcgatcacttcttgacgaactggaggccgttggcctgggagtacctctccatgaatcgcatgaacctgtcccactcccgcggcgtgcgcatgacgtacttggcctcgatgagcgccggcttgccgttgacgaacttggcgctgacgtccaccgactggagcacgccctcgtcgtcgatcatgtagaagccggtgatgtcgccgagctctgccgacgagtcgaacaccgacggctggtcgaaggtgaagatggccacgccgttggtgccgtcccgggacttggtcagccgcacgtccgggatcgtctgctcgtcggtgccctggatgaactggatcgccggcctcgccggcatcatcaccacctgcatcga

SEQ ID NO: 90510 - DNA, 893 bp, Oryza sativa
atgccatatgttcattcgggaagttgggcagaatttcagatgatctcatcaagacaaacatgtttctcaaagacttggtggcaatccatcggagaccaaaggagttttgaatgtggagctgacagtcggcagcaagactatccctacaacattttttttcatcgatgggaagggttcctatagcctgttgcttggaaggaattggattcatactaattgttgtattccttcgaccatgcatcagtgcgtgattcaatggcaaggtgacaagattgagatcgtgctagccgacaggtcagttaatgttgctagtgtcaatttagctctttgggagatggatgggattgattgcctgtctggaaaagtttgggatggagattttctaaaagtgtccgattgtgatatacagccaattgaagatggagaccccaaattattattttaagggcgtcgtgcagggttcaaatttctacaccaaggacacggtggatgatctcgatggcaaactgggacagggtttcatgtcggctgatggtttagaagatattgacataggcccaggagataggccaaggccgacatttatcaacaagaatttattggcagagttcagaaccaagttgatagagcttttgaaagagtatagagattgctttgctttggagtattacgagatgctaggactcagccgatcgattgttgaacatcggcttcctatcaaaccagggtacaaaccttatcaacaacctccaaggagatgcaacgccgatatgtatgatgctatcaaggccgaagtaactcgattgtatgatgttggctttatcaggcagtgccgatacactgagtgggtttcaaacatagtcccggtcatcaagaagaacggcaagcttagg

SEQ ID NO: 90511 - DNA, 1277 bp, Oryza sativa
cccggcccgagtgcggtttgatttttgcaggcattttgatcatcgttttcttcataaagaaggagatgggtttgcatgcaaacttcgtagtttaactcagtttttttttcctcccgaacggaagacattcagtttttcacacaaacatcgtagttttaactcctccaaagagtaggtttgtcattgcgtcttcttttttcccctcagatttggtagtgataataagttgtcattgttttgatccaagggatagaattcagttagacaaaattgaactataacaagagcatgtacttgccatttcgttttttttttcaattgagggcatgcatgcacccttactttgttggtttgagcctctcaactattctattttgtgcaaccaggttcttttatgcagcaaattcttgctgacgtgttatatcatctcttagataagaaattacacattctccatcttcaccaaagagattacaaattctccatcttcacgatgttcaagccgacttctcctcatattcatgaattgagggtgtgtttggataatgggaaatgagaggtgggattgggattaggaattgaatgaagggttaggattaaatggatgagggagaatgaatggttaagatttaaagaggggtgggaaatcatttcccttagatatttgccaaacactgcctgagctccaatttaaagatttctccatcgtagcgtaatcccgaaatggattcagaaagttcagatatatagttgagggttttggagtttttgacagcgacaaaataggatcgtatactttaactccacaatagtccttcaggcctagaaagaaagaaaaatggaaataccattaattagattagaagtagggcaagcgtattagggctgagctacaactcctaatttttgcttcaggagttgggtctagagtggaattgtggagctgcctaaacccagctccatatctctagtatattttgtaagagagctccactcagctccgctcctattttaggtggagctgaaactgtttggctgagctacaactccaatagaggtggagctggagttgaagctgtgccaaacatagtatttgcataatcaagagatccgaaatacgtagtaaaacttactccatctcggcaatttcgctttacacgccacaaaggatttgtgttccaaactccgtattgcaagtctttgagccctagaaaaaaaaaatataaaatgaaccagcaaagtcaaaaataagtaggattcgagtgtttgcataagaa

SEQ ID NO: 90512 - DNA, 2032 bp, Oryza sativa
gtggattgaagtatgaagtacctgctgatgcttcatgatcagcaaaagaagaatgttgactcattctcaagccacttgtggtatcttgatcagatacgcttactgtgttagctgttgaaagctgttttacttctgtagttttggctctaagtgccgttggcttgatagcttcaatgaactcaatttttgagcttcccgaggtaaatatatatgtcctcctccttttaggatggattaaagcatctgtatctagtgaaagaggaatatttgagtcatttgtaccagatcttgtgattacttctgacacctcatgatctatgtctctttgagtaatcccactgctgatgtttctttttgctttccctgccatctgtttcgtatacttcctggtttgtgatgtgtttgtatgagagactgaactttcaccattttcccttactgtatcatctaccttgatttgcttgtattctgttgccactcctgatctgtgacgcaagaagtttacctttctcttttgaattggtgaatgaactgcacatgtcttatcaactttggttccttttgtcatatttttaacaacagaatcttcaggacgttcattctccttgacatcataactgacagttgaagcattgaacaatgcttccatggcttcagctgccatctgagtatttggcccaatatcatattcttggtataaatcatcagtaccacaaaatggttccgttttcttcagacaattagtacccaagtcctcatcaatgcattctagtatgggccaagccctggtacttgatccacagccaccgtgtttcacttgattattagcacgatctactgtattttccatggaaataatactggttctgcaatcatcaacagtgggggtatcaacccagtcaaaatttccagccttttttagtggggaactgcacctagcccttttggccaggcattgagctatatctgaacctaaagtagaagctgactttgccctcgttgtctggtcgatgcttatttgctgataagtttctatatcatcttctactagcagcctatccacaatgtcaatagcgttgatctgtgattcatcaccaggctcctgcgaactaaggtaatccaactttgcacatccgcttgcagaagtcatcatgtgcatgctgtaatactgaaatagacagaaaacacctgttatgaacttgtaggctaactgtgaatggtgttaacaacatggagttgatcgatcatggcctaaatgctgagtagacaatacttgaaaccaagagctggaatcttctcagactgaactgtgtatatgagaggaacatattttaagatgctacagtttctaaatcaagatacacataccaaaatatttatgcacacggaagacagaagtgtatgatcataagtaaaataaacaacgtttatgggcttgtttgagagctaggggtgaaaaaaaacagggaagaacatccacaggagggaccttttgggtgtcacgggatccccttgggaaattccacccaattgtttggaataaaaagagccaacaaaaatccctgccttacaaaaataaacggaaaattaagaaaaaattgcaaaatccaaaatcttcttggcgcgggtggtggtgtgaccaggcattgagctagacagctagtgaagggagggggctgccgcctagctcaccaacagagggggcaaccgccgtcgagctcatgaatggaaagatctccagatgcaggtagtgacagcagttgattagatgcggcaccggcggtcagtggttgcaagctaaacgcgggcgagagcgagagaggcagcaagatttatggtcggtttttagtattacagttgatgtggggttcgtaccaactagaaagagccaaaaaaaaatgttggattctgattcatatcagacagtgtattcgcagaagtaatgcatatgcttattgctattggaaaaatggattttatgataaatttggttatcacccagtccaatatgtaacagacgactgacgaatac

SEQ ID NO: 90513 - DNA, 737 bp, Oryza sativa
gagctgggaagctgtgaaagcctcgcgcttaaggtgctcgatcaattgccgctgagagcgcacgcctctgatttcgctgctgaattacggctgttggcgagaggagacagatggtcgggagcgtgcacgtgaatggatcggtgaacggcggcaatggcaccgaggagaggctcgacgagctgcgccgcctgctcggcaagtccgacggcgacttgctgaagatcgtcggcattggcgccggcgcgtggggcagcgtcttcgccgccctgctgcaggacgcctacggccgtttccgggagaaggttcagatacggatatggcgccgggcggggcggtcggtggaccggaccaccgcggagcatctgttcgaggtgatcaactcgagggaggacgtgctgaggcggctcatccgccgctgcgcctacctcaagtacgtcgaggcgcgcctcggcgacaggacattgtacgccgatgagatactgagggacggcttctgcctgaacatgatcgacacgccactctgccctctcaaggtggtcaccaacctgcaggaagctgtctgggatgctgacattgtggtgaacggccttccatccaccgagacgagggaggtgttcgaggagatcagcaagtactggaaggagcggatcagcgttccggtgataatctcgctcgcaaaggggatagaagcatccttggacccaattcctcgtatcattacgcccacgcagatgatt

SEQ ID NO: 90514 - DNA, 1958 bp, Oryza sativa
ttcctgcagccctgctttccttaattattcaaagtaaacaattcttctgttttgttctttcacaaaatttacaatgctctacgatggactgttgccccacattcctttcactggtttggaagattcagaacaggaatggtccttcaatctatagttaatttcaataggcacatgtcactgccaccattttcatttcctttctgtagattcaagtaactaaactgctttcgtttcccacttcttcagtgcaaaacttgaagaataagatattttttaacggtcaaaaaaacttgccacatactccaattatacttatttcatttcagctgaaattaatgagctcacataaacttgccacagtattatccagagaatgtcaggacaccctgtcaatgtagctcaccgaataaatatttctccgaaccggttttacttttccctatcgatatattttttttcgcaacctatcgatattgagaatttggtcagatatgtagccggagtgcccaatgttatgtgcagtcatagaaaacacctgttttgtgcagtcataaaaaacatcataaagaccttttgtatgagtgttctgaggtcatacaatactgaaatgatcacagatttaatcttaagcaggctgtaattcttaagcatagttgaaaagctgatagggaaagtgataagcaaataattcaacgtgtagcagtcttcagttgttactcaatcaagggttatacaagctaacgtgccagtataattctaatttgcaaccatagaggatatcaacttcttcctgttgatggtggcatgtcctcaaattcaggcaactcagtgcttcaccaagcagcaacagccactcatataccaaattagacatttgcaaccaggttctcatatatccctgttcagatcagaactgctgaatcatgtttcattttagcacagcaatttccaatcaggttcacatttgaaattcgtaagaactttgaaagaacctataagaaaataggaaaacaccaacatgactgtagcagcccaaatttaataatcaactgtatgaagtgaattaggagaattgcagcctgcatcattcagtcattagacaattgcggagatcaaaatttcacacagcagactgttaaaatgattaacagcacagcacagcagaggcatcaggcatcatatcaatcgaagatatagtaacagagatcacaaccttcatgggttaggaaaatcagaactgcaagtctaaaatattggcatcatcagtatcaaatcttcattgcatctcatgttatggtaacaaggattcatggctcaatccttactcaaacgtgttgccaaatttagaaggattaccggagcagaattaacagaatgctgaacaatatgcacaaaattctacccatcccgatgcacatgcagtctcacctgttccagttgtttgattgcttgcgtcttaaaccattcaagaaaggcgacgtatgggggcagatagaaccaagtccacggcgaggagtctgatggcggctctcgcggcgggcagcggacgatgccctgctcgcagcatctgcccgtgtcgccgcaggggaacggcccctggacctgctgcgcctgcgaggtcgagctccctgcgccgctgaaactcacggagtcatccaggaagtagatgttgggagggcactggctggatttcctcatctcgacggcgaaggagcagcctcgcccgaggaagatcgtctggtctgcgagggtgtccaaggtgagtttcttccaggacggcggcttcagctccagcttgaagacgtcgaacgccaccgtggccttctccgtggagacgaacctgacgaccatgagagatgcccgcgggattccacgaggtagcgggcgagcacctcccctggctccggcatggtgggtcggggatttctgcggagctagtacttgttcacgggctgcag

SEQ ID NO: 90515 - DNA, 661 bp, Oryza sativa
ggtcggcggccaaatctacgtcctcggcggctcccgcttcgacgcccggagctatcccctcgacaacccctccccctccgccgccgcctaccggctcgacctcgccctctcccgccaccgctgggagcgcctccccgacatgcgcgtcccgcgagggagcttcgcctgcgcccccgcgcccagcggcggagtcatcgtggccggaggtggctccaggcacccgacgttcccctcctacggcagccgcaccagcggcgtcgagttgtacgacgccgcagcgcgcgcgtggcgcgtcaccgcggcgatgcccagggaccgggccgggtgcgtggggttcgtcgcgcacggggcgggggatgggagggaggatgagttctgggtgatgggcgggtacgacggctacaccacggtggggggagtggtgcctagtgacgtatactgccgggacgcggtggcgctcgggctgtggagcggcaagtggagggagattggggacatgtgggaggaatgggagagagagcgccttgggccggtggctgtcatttctgctgaagatggaagggtcacagaggtgttcatgctcgatggtcatgatatcttcaggtcagggattttgttcttttgtctgcacaattgtttttgcatatatgtttgtgtctgc

SEQ ID NO: 90516 - DNA, 1171 bp, Oryza sativa
tgctctctttgtaaccgcagcaatccatctcctcaacgaatcttcccacttgccctcttattcttcttcccaccattccaatcggatccaaaagtcaccagaaactcctcctcctccccctccccctcccatggccaacgcgaacatggtgtgggcggagctccccaaggaatgcctcgccggcatcctccgctacctcccttgcctccctgacaaagccatgtgctccggtgtctgcacacaggggcgcagtgtcgcttctgcgcacctgacgcctatgcaaccgtggctgttcatgccgttcgccaccgtgatctccttcttctgcgtcacctgcgagcgcacccaccaccaccagagcccccgcctgccggacaatgcccgcagcgcgcgcttctgcggcaccttcctcgagtgctgggtcgccgacgccgagatcccgtatgatgagcctctgccgtggaatcgtttccccgctctgctcaacctccgcaccggggagcgcgtcctcctcccgagacacctccgcaccaacaaccctggttccaccgccatcaaccgcatccaaaccttcgtcctctccgattccccatcccagacttaccggtactgggtcgccgccatagtgtccggcaaacccaacctcatgttctggagcaacaacatgaacgaatgggcgccgccgatgctgaagtgggactcggggttcaagatttggcagaagatgctacccaaggacccgatcgaggacgtgaaatacttctatggcggcccgctcggaggggggttctatgttctcaacaataaggaggacctgctggtgtacacgcccaaggccgacgacgaacacggcgagctcacgatgtcgtccgtgaagaagttcgaggtccggaggaatccccgatcgaccatgccggggccaggggaggtgctcggccgctacctcgtggaatcccaaggggatctggccatggtcgtcaggttcgtctccacggagaaggccacggtggcgtttgacgtcttcaagctggagctggagccgctgtcctggaagaaaatcaccttggacgccttcacagatcggaggatcttcctcgtgcgaggcttctccatggtcgtcgagatgaggaacccctgccttcccagcatctacttcctggatgactccgcg

SEQ ID NO: 90517 - DNA, 986 bp, Oryza sativa
tagcacccaagttgtccgagttcgcgacaaagacatactccttgccctgagaagaatgggaaaataggtaagcacacgagtatcaatatgcaataaagaactcacatatttttagtcatagtattgcattcattttttatgattgttagccccaaaaggtgatgtcatagtttggttactatttctttggaaaacatgtttttattcctctaattttctcaagcaacaagattaatgcagtttcaccaaacgtgaaatggcaaagaagctgtccgtgtgatgaataagcataagcacacatcacacagctcagtgtctgtatctttggagtgtggtgcatgactatgtgcgcatgtttacaaccaatttgaatcaagtagtgatgctaacaacaatgccaacatgaaaggtcaaagcactttagctaacctgtgccaacaaggtatcaagttttccactgttattcaaggaggggaacacatcaccatggcctgggggatacctgcacattcaaaaactggttattcagatttagggaggtttgatctgctactataagtggttatagtcaaatgtataaaccaaagccattttggaataatctgagaatactaaccagccatccttgccagtcttccccttgcttggaagtggcaagaagtcttcagtaacaatgcgaggatattggctctgcatgaaacacgattatgttaattaacaatcaccatggtgcaaaaatgcgacaaatcagaaacatagcacagaagcagctctatacctggttgaaagtgtgaatttcaatgttggagttggagtacttctcaacaatcttcagaaaaaataaaaagccgttagcatgcaagttggcccaaatactaaaatcctagtacatctaaaaaaaattgaagagaaataacaaccttctgtgtgtcatcatgagtgttgaatgagttcattataagcaaagggacattgcatccatactt

SEQ ID NO: 90518 - DNA, 594 bp, Oryza sativa
cgtgcgttaccactttcgtcgtcactacttccagcgaggaagtcgtcagcgagggggtcgtcgtcatcttcctcctcctcctcgtcatcgtcctcctcgtcgccgctgtctcctccctccaaggaggcatcgtcggagtcggagagctcctcggcgccggagtccgagggggcgtcgaggtccgaccctgactcatcctcctccacctcctggagccgctcctgctgctgctccagctcggagtcgtcggaggacggctcgagcagctcctgcttcttcttcggcgccctcttcgccgccttcgggggggccttccccttcttcgccacggccagttgccgcgccgccggcgccggctgctgcctgcgtggcgcgcccttcttcgccatgggaggagaccgtcgccgcgtgggagcggaggcttgccggcgaatggggaggagaagggaaaaaaaaaaccctaaaaccctagccgcgagaagcgaggagaggagagaccctcccgttttaacgctgggcctccgcgagaacgacctcgccttccatatgggccgggccggatcagcccatcccagcttcgcgaagtctgattct

SEQ ID NO: 90519 - DNA, 1198 bp, Oryza sativa
aagtgatatccccaagtgtctcaattagaaaataatgctttagtagatgaatttacagaaaaggaaattaaagatgcaatttttaaaatggaacatattaaatctgtaggtctttatggatttcctgctgagttttatcaagtgttctagaatgttatcaaatctgatttggtagatttatttaaggattttcatagtgaaagtctaaatctttattcactcaactttggtactattattttactgtctaagtgcaaagaggctattaagaatcaacaatataggcctatttgtttactcaatgtcagttttaaaatttttactaaagttgctacaaatagaatttctggagtagcttagaaagttattagtcctacacaaacaacatttatatatgggagaaacattatggaagggttgctatcctccatgaaacaattcatgaattacataaaaaaatgaatggtgtaatttttaagattgattttgagaagcctatgatatgatagagtttaatcttgtcattaattagaatatatgcatggttctattttgtttacatgtagtataggtcactgcatatttagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagcaagacaaggtcagtattagccgagtgaatcggtcctagctgtacatgagatttagttgttgctagtgattagccgcatatgctgcgattagtggtaatcatgtattgggatttcttggcaaataagtaggattagttagttacttagtgcatgggcatcccacgtctgtgtgcatggcgtgagttgtggctgagtgggtttggccattgtaatctctttgcatgtactgagtctatataaacaaggaaacgatgtgagctaggggacacatcaaccaaaagcctgtgtgttttgttcagttcttgtgtgtttgtgtccaccgagtaaatacaagtgtttatgttagtgctagtgattagtacttaaacattcagagaggagagattcccaacaattggtatcagagccaatttatgcccaagatcctgcgcttcaacaagatgtccatcgtcgagcactccgcgtcgcgatcgatgagg

SEQ ID NO: 90520 - DNA, 997 bp, Oryza sativa
gagaatggagcaaacaacgttcatgaagaccaagctcaactgcatgtggagtgctgcgagaagtagccgaattgcaagcaagacaaggtcagtattagccgagtgaatcggtcctagctgtacatgagatttagttgttgctagtgattagccgcatatgctgcgattagtggtaatcatgtattgggatttcttggcaaataagtaggattagttagttacttagtgcatgggcatcccacgtctgtgtgcatggcgtgagttgtggctgagtgggtttggccattgtaatctctttgcatgtactgagtctatataaacaaggaaacgatgtgagctaggggacacatcaaccaaaagcctgtgtgttttgttcagttcttgtgtgtttgtgtccaccgagtaaatacaagtgtttatgttagtgctagtgattagtacttaaacattcagagaggagagattcccaacatgataaagtgtagtggtctgttgttcaacaaactttgagaatggggggtttttcgcaaaaatggtgtgattggattgcttctttcattcaatggagacatgttggtattaaagtaaatgatcaagtgagggtaaattttcaaacttgtaagggtttaaggcaaggggacctgttatctccagttcttttaatatagttgttgatgtgttagccatattaattaagagaacaaaagttgatggtcagatttatggagttgtcacacatttggtggatgatggtttatctattttacaatatgctaatgatactattatttttcttaagcatgatttagagaaagcgaagaatatgaaattgttattaactgcttttgaaaaattatctagcctaaagataaattttcacaagagtgaattcttttgctttggccaggcaaacaaatgttatgagcaatattcaaatatttttggatgacaaataggagactttcctgttaaatatcttggtatccctatgcattat

SEQ ID NO: 90521 - DNA, 1005 bp, Oryza sativa
gacaagctcgaccagatcaggtgcgagttcatcacactccacttccactggatctacccgcgcgatcgtttcgtccccattttttttgtgctgattttttctgtgtgtgtgttttttttgctgttgtttttgttgcagcgagaacgagaagtccgggttcatcagcctcgtttcgcgctacctcaggtgagatcccgtagtgtttgcttcgattgatttgctgcttccgcggtgggttttgatggtgatggtggtggtggtttttgcagcggcgaggcggagcagatcgagtggagtaagatccagaccccgaccgacgaggtggtggttccctacgacacgctctcggctgctcccgaaggtactagcgtctcgttgtgaattgggtgatctgagatgctcgtgtggtggttttttccgaaccgatccgaggttcagtgactgtgtgtgaacactggatcatgtggtgatgtgtggatgtggtgcagatctcaacgagacgaagaagctgctcgacaaactcgtcgtgctcaagctcaatggaggcctcgggacgaccatgggctgcactggtcccaagtgagcacaattccatcccatcctgtttagaacttccagttggattgattagatcgtatatggccgtcatgctattcatagccagtataaactaagtcttacaaagcaaactagattttctcctgcttgtggcgtttacaatgatactatagtatggttgcctgctttgagtgatgttgatattgtactttgttaatttggtaactataaggcttgctcacgcatatgcaccaatttgccaaaaccatttcaaagttgttcagtgtgtttgatcagatcgtgggaaagtgtgaattatgtgttggttttaatgccacttgcccctttttaaattctacatgttattatattatatgtatgctcttctgtctatgtctcttagtggagttctcaatgttaacgatatggaaggactcaatattgtaa

SEQ ID NO: 90522 - DNA, 2311 bp, Oryza sativa
tttcttttatgaaatgcttgaccatcatcatgtatctggatgtagtagcagaatttccattagtgtgttttgggtgtggagctagtgaaatgctaattaacgtcagcatgtgcgctggcctgaattctgtcggctgtgcctcgtgttgatgtaaagataaatatttgctaatgtgatctgggccatctggcagtggctaccaaaccttttatcttttggttgagaaagaaagagcagttccagtgcagctgtgcattgattctttttgctcaatggattctgtgctgtaaagttgcttactggttcagagccagcgtgctccgttgcagtttgcttgctactgcagtttttatctgtgattcgagctgtaacctgtcccgtacacgttttctgaaaaagagaggcatttgtgttgtttggtgaggaaatgggattatatgataagaagttaagaaccttttaaactggtgtatctgcaacagttttgtgccaactgctgaatcgctaagcaagcgagatgtaatgttgtgcaaatataaaaaacgaaaagttatgctaaagtactttggataataaagtaagtcacaaacaaaataaacaataattccaatttttttgaataaaacgaatggttaaacagtgcaatcaaatatatcaaaatcccttatattagaggacggagggagtatatttgaaattatatttgtcaaatgtgacaagtccaggtgaccaggtggaattttacaccaatgatcttaaattctggttacatctcaatcaactgaaaaatgtaggatattaagattgcacaaatgaaaaatactagtaatttttgaactaacacgtcataaaaaaagagggggggggggagtatgaaactgttgaaaaagtaagttcatgatattaaaaattcacaataacccataatcatatcataacaagggttcatttggtgaaactcttactctgagattcttgttgcatgaagctcgaaccatagcagacactttagagattctggatgatacagagtgatgttgttgctccgctcctaaaaattacactgggagcggcattcccactacttttcagctccgatccactatcacagtaggagctataccaaacaaacccaaagtaggcaagtaccagtaatgatacatttttagcctttgtaaatatccaaaggaataagtttactttgggttcctctatttgtcgcccagtctgattttcgtcctttgatcgcaaaaccgggtataataggtcccccaacttacgaaaccgtttaaataaggtcccttggtagtatttgacccggttttgactaaggtggcgactacgtggctactttgactcggtctttatctgacgtggcattgacgtggcgcttatatggcaattcgatccgaaaaataataaaaactatgagacccacatgtcagtttcacacacacaataattttaaaaaatggtggggcccacgtggaccccacctgtcatcctcagtaccctctctctatacccctctctctctcctcttctccgccgccttcttctgcgtcgcgtcgccgctatccgtgtcgccgcgccgaccacccagacaccctccgcgcgcagggacggcatcgccgagtgcctctacaccgcgctcgtcatcctccagccgccgctccacaagccgcctgccgcctctcaagtctcagctccgttgccgcccctgtgcgccttccgccggcgctcaccattctcagggagagagggggggatagagagaaggggatagcgagcactgcgccggagaagaaggtggcggcgggccgcggcggcgctcggggcagacccaacaaggaagtcctcctcctcctcgtcgctggactgcacgaaagcgaggcgacgaggccgaagatggcgagcatctcggcgagcagcgccttgggcctccccatggcggcctgcacgaatgccaccgccgcggtgctgttcgacgacgcggcgtccctccaccccatcgcggcgtccgccgccgccgagacagcatccccggcggcggcgaaggtggccgccacggccctctcgacggctgctctgatggcgcagaggaggaggcagctgaggtagcccgggagctggaccagcatgagcaggagcacgacggccatggcggcgcccttgaacacccccgcggacgagcaggtgatcaccgtgctcagccctgtgatgaacagcttcgccatggccattgccatcgatcgcctcttgtctctgtcgttcttttgcctgaacacgacgtgttcttgagatttcttga

SEQ ID NO: 90523 - DNA, 933 bp, Oryza sativa
aagttccatgatatgcaagcagtttgcgaaagtgattacatggataggtccttcatcaaggatacatgtggccttcatttctttcatccattctcgttggctgatacacctcgcagtcacagtcgtgcaaggattgacttggaattgcatggaaggtcaaatgaaagcattaacagttggaactgtgaaaatattggcactgattttggatttacttcagacaggtttaatattgattcatcaatgatttttgaaggaagcaaacatctcaataactttggcaatggaactcaatctcctagttacttcaatcatgaatattgttctgtcggtcagtttgcttccaaacaggatcggatacccttgaaatcaaaacatgatgcaagaatgtcatatgatatttctcctgagaaaagttctactggttgtcatttgaatgtttctttttcccaagtggcaaaaagcagcaagcttactgaagatcagtatggatgcagtcagaggcccaggctttccagaggtagatataggagtcgttctgcaccaccattttacagaggcaaaagaaaattccctagattaaacgaaccactaaccaaattgactacagaaggtggtaaatataccactgttaatgactcaggaggtacgtcttctcagagccatggcaaatctttatactgctctgtcatgagcaataagtttgtatcttttatactggatgcagatatcacacctgttcaggagtatacatcacatatgaacgcaacccaacctattcctgagacctttagcaatgacttttctgacctaaatttcaggtatgcttcttttgcatgttgccatactactgagaatgtcttactctttttttattttttcataaacctcttactatgtacttatttttgccattttcttagcttgaaggga

SEQ ID NO: 90524 - DNA, 1100 bp, Oryza sativa
aattcctgcagccccttgagcgcataaaatgtttgaaatatatgcaggataccggaaacttgttggattttttctttctttaagcaggaagaattcattttttatgttcacatactatatgaagtagtcagtgtgtatatggtgacaaaggtacttctcggacagattttagtaacttactccttgttcttactattttacagcatgcagctgatgaaaggatacgtttggaggaactccgtcgaaaggttgtttaacttaaattgaccaggaatgttcataacattgtttcccctctttcatattcactttgtttggatttacaggttttatcagatgatggcagagggattacttacttggactctgaggaggacttagtacgtcactttatactttatagcagttggcatctgctgcactgtgttaatagcttaatataatatatctaagagaattattttgagattaagataagttttctttgaacactaggatgtgttgtttgatcttctatcatctatttatttgccaggttctccctgagactggatttcaattgttccaaaagtatatgcaacagatccaaagttggggctggatcatcaacagtactaattcctgtgaatcattcaaaaagtaggtgcctgacaatcatgtgaatgaaaaactttcttttgtgtacttagccttcggtgctattttatcgaggtcttcttgcacatcttctagttatgttcatttgaatctacttctgtaattaagacaatctgagccttctagtgctgtttaggttgcacaattttagtttgtgtttatcataccttcagcttcttatagtataagaatagtcagttcagaaggtcacatgaatttcttcaattaacatttggtgataacatgttatgatgcttttggatggctcagtccatcattctctacccattgtgaaggagcaaaaagctgtttatcccctctgtatacactagaatataataattgacacataccatttactttatattttaaaggaacatgaacgttctgaggagacaatcgcgccgtcttactcttgctgctgtgagtaaccttttctgcga

SEQ ID NO: 90525 - DNA, 1362 bp, Oryza sativa
aaatgaattactaaacaaacaagataaataaataagagtaccttgtaaactttgccaaaacctccctccccaatcttatatgcttctgaaaagttgtgagttgctagagcaatgtcctcaaattttacaaataggaattcaaaatcctggacaaggtttcttttcccaacatcatcggatgtactcatgacatccaaaattagctctctgtgcttctgcctatttcttctcttgcctgctcacaaatgaatatagatatcaatcattttatgagtaccacattggcttctaagaaacaaaaatacgttgattatacctttgatttttaaccatgcaaaggaaatgcatagaacagtcaaaatacaagctaaaactggcagcacaatcttgactgcgtcgctcttcgccgttccacctgtgcaacagtgccagtatggtgcaaagttttatgatccaaataacaaattgtaaatactactacctccattgtcaaatatacagagccacacattgaaatcctaaattgttaataaatttaaaattattagcatttgaaatgtggaaatgatgttaatataattgttatgttaaaaaactttatatattttcatttttaatatttttataaacatgtaattaaaaaataacaacttttttattgaaaactatgttagaacgtcaagtaaaaaagacggacatagaaatagtgatgcatagaaatataaaatatgctatatttgtttttaaattgataatgctgttgactttttatataatttttgaacattgcttttttttaagaaaaaatatacacttcatccgtcgcttaaatataagcatttatgtctatacactagctacatagccaaaaaaaacatctatatttttttaatggaggaatgatcatttattttgttgtgacttgtttatcatcaactatatttcaatgatgacttattattttttaatatttacactagatttttctaaaaaaaattgaaaatttacccaacgccatgtgtaaaaatcaaaatcagcagcatatgattcgttaaaaaacatgaggagcaaacagtgtgtgtcattttttacccgtatcaaggcctgcaatcctgaggtagagcgtgtcgctgtggccgctcccgaggccaactttggccgtgtcgatcaggtcccctgaccacaccaagcacctcgtcgtgtcgcccctggacctgctgctgctcaggttggcgtacgcgtacgccaggcacgagcagttgccgctgcactccgcggcgcacgcctcgagcgtcgccacgttcgccacgtgcacgaacttgtccggcggcttcatcccggccacggccaagaagccgtcgc

SEQ ID NO: 90526 - DNA, 3312 bp, Oryza sativa
ggtgccaattttcctttgatatgaaaacgacgaactcctcgaagaggcgtgacacgaagatacacataatctccttcttcaaaactcaaatctctgcggcgattgtcggcataactcttatgacgagactgagccactcgcaatctttcttgaatgattttcaccttttcttctgcttctcttaggatatccgtcccgaaaacctgacgttctcccgtttgatcccacaaaagtggagtgcggcacttccgaccatacagtgcttcgtaaggagccatctgaagactagcttgataactgttgttgtacgaaaattctgcataaggtagactcttatcccaacttccaccgaagtctaaagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactattttcttagggacgccatgcaaacacacgatccttgccatgtacaattccgccaaccgacttccagaataggttgtctttaccggaatgaaatgagctactttggtaagtctgtcgactatcacccaaatagagtcatgacccgatgacgttctgggtaaaccagtgataaaatccataccgatttcttcccacttccattcaggaatctttaaaggctgcagcaaactggcaggtttctgatgttctgccttgactcgctgacaaacatcacatactgctacatattctgctatttcacgtttcatacttgcccaccaaaatctttccttgagatcctggtacatcttagtactaccagggtgaatagagtataaagtatcatgagcttctttcagaattacatcttttaaatctttgttgtcagggacacagattctctcgcccaaccaaacagttccttgctcatcctccaagaaaccgatagcttttcctcttctcatattcttcttgatctctgaatatcaggatcattaatttgggcttctctaacttgatcaattagagtgggcttcgcttctaaagctgcaacgaaacctctactgacaattcccaaatttaatctttcaaattcctggcataactccaatggcaactgtcgtccttcggtagcattgcaatagcctttcctgctaagagcgtcggctacaacatttgcctttcctgggtgataatgaattcccatgtcataatccttaattaattccaaccatctccgttgtctcatgttcagatccggctgagtaaagatatactttaaactcttgtgatcggtatatacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatagacttggaaacccttctttggatcgggtaaaatcaaaataggagctgatatcaagcgattcttcaactcttgaaaactctgctcacattcttctgaccacttgtacttcacatctttctgtagcagtcgtgtcatgggcttagcaatcttggaaaaattctctataaacctccggtaatatcctgcgaggcctagaaaactgcgaatctctgaaactgtctttggttgtttccagttggttacggattccacattactgggatcgacggcaactcctcctgctgagatgacgtgaccaaggaacttcacttcagacaaccaaaattcacacttgctaaacttagcatacagttgatgttctcgtagcttctccaatgcaaggcgaagatgttcttcatgctcttctttggttcgggagtagataagaatgtcatcaataaagaccaccacaaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaatacagtagcacctttaagctgatcaaacaaatcatcaattctgggcagcggatacttattcttgatagtcacatcgtttaatgcacgatagtccacacacatccgctgagtatggtctttcttttccacaaaaataaccggagcaccccatggagatgaactcggtctgatgtaccctttctgaagcaaatcgtctacttgccttttgacttctgccaactcattggctgccattctataaggtctcttatggatcggagttgttcctggtaccaaatctattctgaactctatatcccttttgggcggcataccaggtaaatcatctgggaacacatcgggatactcccggactataggaatctcttccaaagttatctggttcagtcttgaccttaaagactcagatgacaatgcatgaacagttacaactcgaccatcattgctgatgagagttacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggatgtctaagatcttctacttccatcccatgatttcccgcaaaactcatagataagaatgaatgtgtagcaccagaatcgaaaagcactgtggcaggaactaagttaacaaggaacgtacccaaaatcacatctggagcatcttgagcttctgcagcagcgacatgattgacacgggcctttgatgctggtgcggtagagttgctctgagtagggacaaccttcacgcgtcggggcttcggacacttgtcagcgtaatgtcctgggtctccacagttgaaacacaccacgggtttgctgccttgctccctcttggcaggttgttgctgtgttggagctgcaacaggacgtggaacttgattacggatgttgttgccagcattgttgttgaagaactgacgctgcggacgaacaatagacgaagaacctccctgtggcacggactaaagtcctaaagtaagacacaacctctgattattcccct

SEQ ID NO: 90527 - DNA, 3510 bp, Oryza sativa
ttcctgcagcccgaatgaatgtgtagcaccagaatcgaaaagcactgttgcaggaactgagttaacagaaaacgtacccaaaatcacatctggagcatcttgggcttctgcagcagcaacatgattgacacgggcctttgatgctggtgcggtagagttgctctgggcagggacaaccttcaccgtcggggcttcggacacttgcagcataatgtcctgggtctccacagttgaaacacaccacgggcttgctgcctggctccctcttggcaggttgttgctgtgttggagctgcaacaggacgtggagcttgattgcggatgttgttgccagcattgttgttgaaaaactgacgttgcggacgaacaacagacgaagaacctccctgtggcatagactggggtcctaaagtaagacgcggcttctgattactcccctgttgtgctttgaagtgagcaatccggcgtttcttctgctccatgcggttgtacttgtcttcctgacgaatagccttatccattaatttctggaaatcagaataatctccagtcatgagtgggtaagaaagctcatcattaagtccttccaagaacttctcctggcgctcttcatcattgcgcacatcttccggagcataacgagcaagacgattgaactcgtgcagatactccgtaacagagcgagatccctgggtgagcgacctgaactccttcttcttgagagacaccactcccgatggtatatgcgtcttccggaaagcagcggtgaattcaagccaagtaataggttcagcagtagtcctattcaggcggaagtgatcccaccattcagaggcagggccatgcaactgatgtgatgcaaatgagaccttctcctgatcagtgcactgaagcaaatccaacttcttctctatggcatgcagccaatcaccagcttcaacaggattagtggtactagagaaaacaggcggcctcacacgaagaaattctgctaacttattctgaggaggtgcatggttatttccttggttctgctgattctggagttgctgcatcatcatgttcatgagttgtgtctgttgagcaagaacttgggcaagtgtgggattctctccactttattgttgttattggggttgttgttggggccattcccattgctgcgagtgttcaccatctggcatggacagggcacaagaagagaaaccgggcaaaactacttaggacagggaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagacacacacaagcaaacttaaagcaagcaaactaacacaacgatctaagacaacgacttaacaagtcactctagttcttccgagcatcggaggtcgattgaaggctcattcggctcgtcttcatcatcttgagttactacccactcaatcttggaatgggtgtgcttggattcttcttcttcatcatcacttatgatgatgaccggaggatctgctagggttggggcaacttcattctccaccacacgaacctttggcgccaattgatagcgagggacaaatagagctctcttcattgcagtgagacgaatcctggccttctgcggcggtgcttctcccttcaatgcggctaattccttctccaaacgatccaccttgtcttctagcttgcaaatcttaccacgattccggtcttcacgatcttgagccgctaatacagtctccgcacgactttcatccatagcccacagcatctcaaccaaatgccttgtggtagcatcattctcaattccttcagtctcaaggtaattgccacggtcacttccctgtggttgacgaggatggtagcgatactccgtatcggccaactgatcactgtagcgatcgcgaagctctcctatggcgatccttgccacctcctgacacgcatggatgtagtttcttcctccagcttcgaacatcactgagggaatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaagtactcaggcttgtagcgcggcatctaaagacaagtgaaaggagggagttaagacatctatccaattaacagcacaagtttttggattaatttgaataaagtttagaaatcaaaataaaccaaacctgcaggataagttgaaacagttggaaacaaggttacaagctttgtgcttttgagtaacaggttttaaaagaaataaaagaaagttataaaatcaacttgctaaatctattttattgcagcaagattaaataaaacaacattgtaaaacttttgctggtaaatgagccattggtacagtaataaatgtacggtactaataacactggaataaattttgaatgagaaccattaaaagagattatgaagtgcatgtgccattagtttggtttaattaaaagagaaagggaggagaacagttctacttttccaatatttttagaaggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgtataaagtgtcattacagaggtagatagttcctctcaaacaataaatatctaagcagcggaaaaagaaataaacggcgcagacggctccactccacataccgaggtgcgagcttcccttttgtctgaaacctgtgcacacctcgcaatggcgtgacccgaaggtatacaaaatcacccactgcgaattccaggtcacggcgacggttatctgcataacttttctgccgagactgtgccacctttagattatcccgaatgattctgactttagcttcagcttctctcaggatatcagtcccgaacacttggctttctccaacttggtcccacaagagcggtgtccggcatttgcgcccgtacaacgcttcataaggtgccatttgtatgctggcttgataactgttattgtaggagaattcggcataggggagactcttatcccaggtcttcccgaaatctagtacacatgcgcggagcatatcttctaggatctgatttagatgctcggtctgtccatctgtctgcgggtgatacgcggtgctgaaatttaatcgggttcccaactcttcttggagtttcttccaaaaatgagaggtgaattggcttcccctatcagatacaattttcttgggaacgccatggagactcacgatccta

SEQ ID NO: 90528 - DNA, 675 bp, Oryza sativa
ttatttagttatgattttccgaagatttaatctattagaaaaaaaaagaaaaagggaaagatgatgatgtcatgatgacgtcatcaatggcggccttggctcgggcggcacgaccaccggcgctacggaccttggtcgggcgaaaagagggcacctacgcgtagagggcaacaagacgaacgcaacggtactcaccaatgcgcccaacgacgaccgatggtggccggcgacgagaggaggcggcgcggcggttcggtcgacggcggcgacgggtctctggcgaccggcgacaacggggagagggcggccgaggttcctcacctccgtgcgcacctaacggcggcgagaggaagcggcggcgacggcgaaatcgatggcgcggcgcggctggagatcgccggcggcgacggcgagacaaggcggcgtcggcggcgagctacggggcacgggagaggacgggaataggggcaaacgaaagaggggaatgtcgcgtcctaaaacgactctaaaatacatcctcgaaattgtgccgagaataattaaaattcgtgtgaaagcctccaacaattaaaatgtgcaaatataaaagtcaaataaggcttggaggatttttgtatatttcctaaaagcctaaaatgcgtaaataaattttaggggaattttcagagcacaaat

SEQ ID NO: 90529 - DNA, 1470 bp, Oryza sativa
ttcctcaatccatcttgaatttgggaaatctcaattctttgtaagaaattctttctttacatcaatttgttcatacgagcctgtattaagcagatgagtatattttataatcttgaactgtgcccaattcaggtttcttgggaacaatagccttacaggaaagttgccggatggtataagctcttcattaaaagtgatgtatgtcaaatacaattgacatggcagtatagcacaaactacattcataatagtacgcactaattttgtataacataattctggaatgttgacagagatttttcgtacaaccaactcactgggagcattccttcttgggctagacaaaacaatttacagttgtaagtgtaaaagtgtgatatttgtgtcgctgagaaaaaatataaatactaatattctgttttttgaaaggaatttggtggcaaacaacttcttactcgataccaccagtgaaaggtacttgtgacatttagttctaatttggcgagtgaactatatgaaaatcttgctggtaactttaaattttcaattcaaattgtgcacagtacgctaccttggggaataaactgcctccaacaagacaccccttgtttccgtggatctccagaatgtatatttctcattcttcataaaactaaacagtaacatgaacttacgaatttgaatgatggctacaatttttttaatcttaattgcagattattccttcgcagttgactgtggcagtaatgcatccataagaggctcagatgacactatttatgaagcagatcctacaaatcttggagctgcaacatattatgttaccggtcaaacaagatggggtgtcagtagtgtagggaacgccatagatgcaaagaatattatatatagctcccaaccttttcaaaatgtagttgattcagagttgtttgaaactgcaaggatgtcatcatcatctctgaggtactatggacttggacttgagaatggaaattacactgttttgctccaattcgcagaattagcttttccagactcacagacttggctaagcttagggagaagagtttttgacatatatatccaggtagaaattttgtgcattttatataatgtttttctactgaatcttaccaatatttatctaaaagtattactgatatttacatagggtgctctaaaacaaaaggatttcgatataaggaaaacagcaggtggaaaatcttttaccgtagttaataggagtttcatggtaactgtgtctaaaaacttccttgagatccatctattctgggctggcaagggcactgttgacatacctactaaagataattactatgggccaatgatctcagcattgagcgtcactccaagtaagcaccacactaaaacaacagcaggaagtgttatattcgctgccgataaataatatttttcctttgcagattttactcctaccgttcgaaacgg

SEQ ID NO: 90530 - DNA, 2234 bp, Oryza sativa
tgaatgggtatgctggtctatgttcttcccatactagaaaacttcaattcattgtaaattgccttttgcttactcaaactatgtttatcaaaaggcatggggcctgtatgaaatggatcaagcacttggaattgttgacccaagtctcaaggaatttgacaaggatgaagcttttagagtcatatatgttgcacttgtctgcactcagggctctccgcaccagcgaccgccaatgtcgaaggtcgtgacaatgttgactggagatgtcgatgtggctaaggtggtcaccaagccaagctacatcactgagtggcagcttaggggtggtgggtacagcagcaacaccactagcagctacgcatggtctagcaaccctgagttgagtaggcaaaaagagatcactgaagtttctctccaggtgaggtgaatttaatgtagaaaatctatgggccatctatattggtttgaaatgacgatattgtaactccttttttttacataattttgtaattttgtgtcgatgtgagttattgcaaacaatggaattacttatcctgaatctttcctggtaacaaaagtttgctcctaataatttgtaaatggtgaataactgtggtgtattcactactcaaaaaaaaaagttaatagataaccttttatctgtaatggtcagtgcaatgcagaggtaaaattttgtccaattgtttataaacactgacatggtatggttacagtgcggtaggtgtgttgtccactttccaacggattcgactttgtattaatatttagatcgaggtgtcagcaatttaacaaacaagatgccacgtgaccttaatggttgtttggtcttgcaacttcatctgtgaccatggccaaagtgagaccatgttctgatggaggatgttcctaggtagcagggacgtcttggatatcatcccacctcttccaatagctatgtattacttcagggtgtcttgggtttttaaatcattattattgctaatttaatgtatgaagctgtgaacagttagatagttgttttcccatctttggaacctaacttatcgtatgtgttttttcgtatttctaattcagattgtttttatgttgttcttatttacttatttactcatcgattgatcataggaacatttttttttttgcatcggcaagatcagtgacccttgaagtagtttttttttataatgaaattcattccggcttttgcttaaagaaaaactacaaccagttattacggaggttgcaggacaaatgagtgcaaattacaaaattacagctcgattaaaaataagaaaactacatagtataccactttaaagacaaatatttccatctatggttggcaagagtatgtatagtcattgttctaccaacggtttacaagttaaatgtagtccttatcttcctcaaataagaaaagaaaaaacctttgaaatcagcggctgatccttgtcgatcaaatttcgctccaggcactaccagtgctaacctcaaaccaaagcatgacataacatcagagagtaactaagctataatcaatcattcgtctagtccatgccaccaccattgcaatcgaacccaactggtaggaacaccgccacaaggacgccccactaatagggaacctccgatgtgacgccttcatgaaagtggcaactaggatattactgtaacaccctgaaaattttgattttaaaatatggaaactaaaatttattgaaagtaaggatccccggcctatccaaggatgtcgcgaggaggagcgagagctgagcagtggcaaggaggcggcccaccactgatgacctgtaatgcgggccatggaggacgacctgctcagcgaggaggacgtggctgccggcaacgaccttcagcgtggggcgtggatggtggaggacctgctcaatatggaggacgtggtcgccaccaccgacctctagcgtgggccgtggacggtcgaggacctgctcctcattaacgacattgccacccaaagggagggccgctataacgcactcacttgctgtgtcggtatgcttttgatttctctctttctatttctctttcttctccgatggatatattgatccatcaatcgcttattagatcaagttagtgcagggcttaagaggcccaggaagagctatagactattgtggctgaactactggtcctggagcatgacggagcaggagcagctactggtcctggag

SEQ ID NO: 90531 - DNA, 1257 bp, Oryza sativa
ttgccacgcatggactaagtcctgagaaggcaattgtatctattaattaggatattttatgtaatttccttagagatatgtttgggcaaaagtctgccgcaaagacttatggtatcttagtttgttagagataaaagtcgtgtccgacacgggcatattttgtaaatcttgggtataaatagaccccgagccccatgtaatatgataacacacgttcaatacaatctcagcgcaccgccacccttttactttcattttgtttcgacgagttcttgctttcgggttgagctgcatcggtttcgatcttcaactagaggtaaaacttgttatggtggcttgcgttctcggaattagggcttccatctttatgatactctaatcttgttcatgtaattcgttgagttatcatatatcctatataatctccggcaatatcgttatctaacccccaattggctaatgtctgttactaaaaggcagccgattaggttaaataccaacgttgactaggattatataggatatccaccactctatgaaacatccaatggcttgattgtctagatattttccttcttttcatacttatagctgcatcagttgagtttgaccttgtaagtcatgattagaatctcaatctctagcctgcttttggttgccgattagtgtagcatcggggtttcagtcgatcttacctaatttaactacatttatcttatatgcttgattgacatgttaaattgccctttttgttaagatcttgttgcatttaagtatattaggctttcgtttgatatattttacttgctttgatatctcaatatagagtggtattggagtattagccgatacatgctagatctatctgatcggctatgctatgaacgtatatagtcttgttgttaatatatatttcgatctaagtgatttatactgtctcggcatggcgaccgatctgtcccaatcacttgatttaagtatatatcgacacaaggattatatattgttaatatctatagccgatcgagtagatttaattttttcttacttgttcatgattgccgatcgatctatatatgacatcggctcaaagatgaatgatatgtcatcggcaattagccgatcggctatcgtttatggatttaaccgcggtttctttgtctttatttcttgttgattgcaggatcaaatcaactggcatgctcattaacctaaaggcaagatttttggacctacactgaagttaagcagatcttc

SEQ ID NO: 90532 - DNA, 2374 bp, Oryza sativa
ggattcggcgccgcggcgggcgttagggcacggcggcggcgggcgcggcgcgaggtagacgataacaggtgggccccacccgtcagcgagggtggcgggcgggcccgcccgtcagcggcgcgcgcgcggggaggaggccgatgggccgcgggggagaggagagagagggagggagttgggccgggccggcccaagagaggaaggggggggaaagagacttcttttagggtttttctttttataaaacctttttaactttgtttatttcttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctcggcacaatttcgaggatgtattttagagtcgttttgggacgcgacaaagcacaaggaactggagtcgcacaagcgccgcttggcgaatttccgcaatcaacagggtgctaaccaaagggtccgctacaccaacccctatccagggggatcctcctcgcaacagcaacaacagcagcagcaacctcgctccgcgccgcgacctcaattcgtggtgcgcgtcccacagccgcagcagcagcagaatcagcaagggactcgtgcgccccgtcctcctacgccaaccgtgcagtctggtcaaggccgcagggacgctcaaggtcagcagcgtctgtgcttcaactgcttcgagcccgggcactttgcggataaatgcccgaagccaaggcgtcagcaaggccaagcgcctccccactccaacaacggtgggaaggatgtcattcggggtcgtgtgaatcacgtgacggccgaggacgtgctgacaactccagacgtcatcgttggtacgttcctcgttcattccatccctgctaccattttgttcgactctggagcttcccactggtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaacttggatgtgatccttgggatgaattggttggctcaattccaaggagtagtggattgcgcgaggcgcactgtcactctgtaccgagggccggaacaaccggttgttttctttgcacccccaacctctgtcagtagttcagaactgcatcagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtatatacgtccgagtacttccccctggggtgctcctgtgatttttgtggagaagaaagacaagactaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtgatgtcattcggcctaaccaatgcacctgccttcttcatgaacttaatgaacaaagtgttcatggaatacttggataagtttgttgtggttttcattgatgacattctggtatactcacaatcagaggaagaccatcagcaccatctccgtctggtgttgggaaagctgcgggaacatcaattgtatgccaaacttagcaagtgtgagttctggctgtccgaagtcaaattcttaggacacgtgatatctgctaaaggagtttctgtggaccccgaaacagtgaccaccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccaaactctcaagaaaagctggtttcctcgccggtgttaatcttgccggatactcgcaaggacttcctggtgtattgtgacgcttcgcgccaaggattggggtgcgtgctcatgcag

SEQ ID NO: 90533 - DNA, 1496 bp, Oryza sativa
  unsure (1)..(1496): unsure at all n locations
ggagaagagaagagttgggtcgaattcggcccaacggcttaaaggaggggtttttgaactttttcaataaaaacaatttgtgaaatgttgtttcatttattaaaaatacttcccttgctcaaataattcccagaaaaatctagaaaatagaggagcaagcatagtatttaataaaattttatctagctcatttttatattgaaaattttcctagaaaattagggtttagcttgtaggtttttaaaataatttctaaaaaattccaattaaacaacaatttatatatttaggattttaaacaagaaaaactcttaacaattatagttagatcatttaatgatcaaataattactaaactgttctttgtatcatttaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattaataatttactaaattctttataaatcttgaaacgaaaatcaggctgtgacagaactccaaacgagaggaatcgactcgggaaaaatccaaactcggttttagggataaaatcgaaacgaactcgattcggaaaaaatcctcaacgatttgcttcgaaacttgggaaaagatagaggagaacgtgaggaacaaaacccctcaaaaacccgaaagaatcggggtcggattggagcagaaacggaggcggaaaagggcggctcgggcttgctagggcggccggccggaggtaggggatggatccgacaggtgggccccacctgtcggtctcctgagaggagggcacgggcggctcggctgggccggcttgggccgcgcgggagagagagaatgttgggccgaattcggcccaacggctaaggaaggggatttttgaacttttttgaataaaaacaatttgtgaaatgttgtttcatttattaaaaatacttcccttgctcaaataattcccagaaaaatctagaaaatagaggagcaagcatagtatttaataaaattttatctagctcatttttatgttgaaaattttcctagaaaattagagtttagcttgtaggcttttaaaataatttctaaaaattccaattaaacaacagtttatacatttaggatttttagggcgtgacaaacctaccccccttaaacggaatctcgtcctcgagattcagaagaactggcgaacagatgaggatgagctgacttcaattcatcttctcgctcccaagtggcttcttctttgaatgattgctccatnnncccnngcagaacgtataacgcgattcctggtattcctctcgcttacttccaaaattctgacgggcttctcaacataagttaaatcttcttgaagctctatacgatcaggatctgcttctccgtaggtacacgtaaacatttcttcaa

SEQ ID NO: 90534 - DNA, 504 bp, Oryza sativa
ccgctactatagaaatagaagaagttcctttcccatcctcgcttatcttgctagaatccaaagatctagatgttatcttagggatggactggttatctcgtcacagagagttatagattgtgccaaccgtaaggtgactttaaccagtagcaatggggaaaccgtttctttctttgtgtcctctcctaaatatcatggtgtgatcttaaaccaagttgctctacaagagatccccatagtacaagactacccagacgtgtttcccgaggatttgccaggtatgccacctaagagagacatagagtttcggatagacttggtacctggaactaaccctatccataagagaccatacagaatggcagctaatgagttagctgaggtgaagagacaggtggatgatttgcttcagaaaggatacatcagacccagtacttcgccatggggagcaccagtcatctttgtggagaagaaagatcatactcagagaatgtgcgtggatta

SEQ ID NO: 90535 - DNA, 1196 bp, Oryza sativa
gccatgaaattacgatattggtctaatgaacaattgcatgtgatccactggatcatacagaggatcctgactcctcagagcattggttggctgcaataaccgctgtgtaatgcccataactttctgctcaggatttcttgtctgaagattttgctcagagaggtcatgcatgtttgcgtttgcacaacagtaactagtaagaatgttgaaagttctatagcatttaaagattgctcttactgttattctgatatctatatatgtccacatctcggagtcaattcggaaaatttagtactagttgaagaatgtagactgaaagaaatgacatgatgttacctgggcattgacttctgcaactgtgccagagttggaggtgtcactgtttgccttcttgtacctctcaacggtggatttcacactgcaatatgaccatgattagtcaagggttatgtttaatcactcctacacaagaaattaccagtttcagaacagtatagccaagacgactgcgaaaaaaaaaacttactcgctaggcaattccaaaaaagtttttttttctagaacatataattttcggcaagctagctatgagggagaaaagtatgataattaattgaatttactatcccgaaattatcgtataagtattggttttaaaagtttacacaagaggcaactgagcatagcttgtcagcatcttcatgtactactaaaaggacgaaaataaccaacatcaattagtaatacagagaatacagtataaataagtgcagtagaaagttgaaactgacattaatatctagtattccctccatttcatattataagtcatttgattttcttttctagtcaaactttgttagtttgatcaagtttataaaaaaatttaacatctaaaatatcaaattagtttcattaaattaaacattaattattttgataatatttttgttctatgttgaacatactaatatatttttctataatttaataaacttaaagaagtttgattagaaaaaaaaatcaaacgatttatcatatgaacaggagggaatacttcacatttagaatgtggcgttcaagggcaaatgaccatagttaaaacacaacatagcacattggtccgaatcgtgcgctatcacaagtcatcctcgctcattcatgaactactgcagagtagcacagtggagtac

SEQ ID NO: 90536 - DNA, 1392 bp, Oryza sativa
tcctcctctcgccgttttgcatcaaactctttgcttgggggatatctcggcagacttgaaggattgcaagcatatggttttgttgcaaaaaactgaagaagacaataacaagcacattgttaatatcccaaagattgggtactatgatgattaaaagtaaaaaaaaaaaacttttgagatgtattgtgaaagattaacaacctcctctaacataacatctagtggatcatggtacacagaaatgaatagcaacagagcttttatacttctaaatccaaaaccttgatccaactaggacatgatgactttcatagacattagagatggttcagggggaattattttgcagaaagtatttacttccaaacaaatatagctgatctgaagtttctaaaaaaaaggaaaataacgttttaacagtgatactttgctattttaaaacttcaaacagcagaatatttgaatgcagcacattactccctctgttacaaatctctggtgtttctggaattgtacgctctccaacatgtgcctttgactgttacttttaatttatattctgagagagtgagagtattattttacagcaaatgtaatggtaaggctttcatctgattaatcttgatagtgttatgtgggttagcatttattgtctgagagttcacggcacacatgccatgttgacatacatttgtaaacagaggggacaattgagaattgaaatggagtaacgtataatcaaatagaatctctatatggattctctctcgaaataaaaaagaatctctatatggaaataaacaggaatgtctccagcagctggagaaaagtccaaggaatttgaatacctcactttgcaatgcagaagatgctgttcctcgatctgctggatcaactgaaagaagaacatccactaacgccacagcaggcggaggaaaatctttaaatgtttctgatacacgcctagcatatggatgctgtggcttaaaaattgtggcatgaggaagtttagacttcctccaatagtcctctgatggtgaaccacagagtttaaatattttatgtaactgctcaacctacaaaaagaaaaaaaacaatatgaacactatttcaagacaaattcaaagcattcactaatagcgtttactccctctgcccactaatataaaacgtgttttgattacagaaattcaaatttgaaagattttgaccaatgattagttactacctctgtcccaaaatataacaatttttagctatgtatctagacatacccctgtccagatacatagctagaagttgttgtattttggacagagggagtaccatacaagcacatttagtgtgtcaaacttatagcattagattcatacttcaaagtaatttcacata

SEQ ID NO: 90537 - DNA, 1449 bp, Oryza sativa
ttttaagtaaacagctacttgaggcttttttaggactactataggatgcaatatattcctttagtctttctttacagctaataagatttaataacgagtacagattccagaagaggtaatatcaatatacctgagactcagtaaatttcactccaggaaaagaagctagtccagctaggtcatgttccatgtactcaaaaacaagatataagctacaagacattcttgaagttactagaccctccagcttaataatatttggatgatcaagccgtcgcaaaataaggatttccctggccatgaacttcacactctcaggttccaaattatcaaaccgcactttctttagggcaacaatcttctccttttcaagatcgcgagctctgtaaacattactgtatgttccctgaccaatctgtataaacaaaataacaacaactgaacacaccatggtataaagggcgcaatcagtccaggtgcaaagtaaagtttaacagtgcacaatctagttacaaagaaaaagggacataattgtcaaccaaatagcagttcctaaaattttgaagttcagagaaataaagtatcccgtagcaaacaaaacaggaaaccgcggtattataacagctaaacaccagtgattcagctaaactgaaactggatcaactgttagcagaatatattacattattactattactatttaaattttaaaccaagtttgcaggtgaaaaaaaaaagttgccaccatactctcagatcccatagcaatgtagtactactactagaatagcattgttcaccccaccccattaatagcagggcatgagttgctagtaatgcccactgttcccaggttccaaggtccaccaaaattatcaagaaatccaaaataaagaaaatgccaccgcattttcgcatccaacgtaaaaggtgcctcccactaataacagatttgtactgtttccagtcgtcctagctaccaagaatccacttaatagacaacccaaataaaaacatcgcgatagtacccaccctcatcaatcgtcagtaaatatccctgtaagaggggtaaactccccacattttacagcccaattttaccttttttccttccattagagaaagtatgaaggtggggagcacattgttaatgcatcaatctatattctcaacgagaaacagaaatccaaaagggggaattcgcagcccgcattgctccaaattctcgccgttccaatgttccaaattagagatcaaagatgagagcagaaaatgaacagagccaaaatggagatgtagagagagagagagagaggagaagagagtgtgtgaccttgtcgagcttctcgaacgactcggcgcggcgaggcacccacccgcgcacggcctccgcggcgacggagacgagccacggcggccaccccgccgccacctgctccccctccaccg

SEQ ID NO: 90538 - DNA, 1379 bp, Oryza sativa
agaagaagccccgcgctgccgacccccagaccagcaagagcgcgctcgacggcggcggcgacgacgacgacgatgacgacggcgccgtgttgccgagccgtgcggccaagaagccccgcgccgcggacatcaagatcaagagacgacaccccctcgacgacggcgaggagagcgacgcgtgctggcaagtcaccaccaccgacaacccgcacgacgccgcgcggacgtttaggaagaccctggagttcatcgcgtggtactcgaagctggtgaccaccatgaggcgcgctgaggagctggagaggagagagccacacccgcatggcgccctcaaggatctcttcccgagcagcgactgccatgagatcctcgaggagctctacggcggcggctggaggacagtgcaggtggcgctcgacgacggcggtggggggcgcgccggccgcacgacgttggcggcgatgcttgtcagtctaaggcagagggagaacgcagccgtggagcttgcaaggcgccgcgcggacaaaactcgctacggtgaagaaccagccgccgcgtggggatcgcggcggcggcgacgccagccgtgatccgtgcgccgccgcctctggacagatgtgtccgaacgggcggcgatgccgttccttccggctgtgacaaacttgacggagtgcatcgtacagcatgacgatcggcgcgttccccaattatcacacaagaagtgtcgaagataattggggaacgcgttgatcgtcctgctgcacgttgcagcattctttgttggtgttcatgattagtataatttcattggatatttatttagacttatatgcgagaaatgactagggatgtttcggctagctctataaggtggtgggcttgtcggcctgggtttaaagcctcaccccttctatttatttgatattacggtttttttatttagatttatatgtgcgtcaatttcattatttccaatgtagaactgtttacgcttggacagaaaatattaatgttgctgagagagggatgccattggctgaaaaacttgacaggaagtacttgtggtttcatactctgtaaaatcagtagcgaaacagagcagaattaatcaaccaaatcgaagttccactaagttgctttgcgttctgtgcgttgaagatttcttgaaaaattcttgattgtccactatgaagaataatagtcacatgcaaatttagttggccaatttccatgtgaaaaattctactaccctttgcatgctcaaagtttcttttttttttaatgcttcacatccatgactaatttccatgtgaaaaattctactaccctttccaacatgcattttgaacgggattttcatatcattggtatgaattccc

SEQ ID NO: 90539 - DNA, 654 bp, Oryza sativa
tctttcatgaatcaaatgtatcctcgagtttcttattctgacttggccaaagcaacaaacggcttcacatccaacaatttggttggcacagggcggtatggatctgtttacaagggtacaatgcggttcaagaattcagtatctgacgtagctgtgaaggttttcgatcttgagcaatctggttcttctaagagttttgtagcagagtgtaaggcactaagcaaaattcaacaccggaacttggttggtgtcataacttgctgctcttgccctaatttgaaccaaaatgacttcaaagcccttgtgttcgagttcatgccttatggtagtcttgataggtggatacatccagacatagatccatcaagtccagtcgaagttcttacgttaatgcagagattgaatattgctcttgatattggtgctgcactggactatttgcacaacaactgccagccagcaatagttcattgcgacttaaagcccagcaacattcttcttggggatggcatggttgctcatgttggggatcttggccttgcaaagattcttacagatccagaaggtgaacaactgatcaattcaaagagttctgtggggataatgggtacaattggatatgttgctccaggtaaatcacatttttgctgcagt

SEQ ID NO: 90540 - DNA, 849 bp, Oryza sativa
ccggccgtgtcatcggctccgacctcgccaatcgcgagttcgatggtaggacgggcgtgctcgatgaccaggtgtctcttgttggtgacataagccgctctttgctctctctggagcacctgagtgacctccaactcggctggaatttcctggaggggcgcactggtcgtctcccggacttccttggctctttcaaaaggctggaatctcttggcctcaccggcataccattttctggcaccgtgcctcctaagctcggtacgttaataatattttatttcaaaccaattcttattaattacttacattaatctattatcactaaattaaatatttagctaaataagtaaggacgtaaattagtagcattggtgtgggtagcgcgccgtgaacactgtagcaaacgcgggatccgtatggcagtggacgcagcagtggaccgggaaagctgagtactccctatgtcccaatacaacacggttcctggattccggttagagtatgtatccaatatatgtacagagtctgttacagtttagaaattggagttgtactaagtacattgaaatagagtcggactctttattataggatatcacttaaatagagggatggacatgttataaccgtatggcaacttagcatggcgaaatagagcggctgccgacggcatccggccgagggtcattgtaactctaatacgctgtaatatggtggatcggagaggagcgcccgtaatcagtgccccggggatataggcttcggctgaacctcgttaacaaatattgtgcctggtgtcgtcatcatgtttggatctcctatgacgtcttttccatgtttggttactaa

SEQ ID NO: 90541 - DNA, 3455 bp, Oryza sativa
cgagcaagacgacgacgaccaccaccaccaccaccattaccacggcgacgccgacgacgacgacggcgagcacgccatggagcacggtgactgcgtggcgcgggcgccgcgcgccctggagatcggcgagtcgtccgggaaggggcacggcaagtcgaagcgttccacggccgccgacgaggtcgcccaggccaacaccatcatccagtcgctcaacgcattctcgtcggtggcgcacatctccggcatgggcctcaaggtggtgccgatgatcgcgccgttctccagcctccgcgccatcaacctctctggcaacttcatcggtgagcacaactgacaacagtagtaacattttttgtcgctgtagcatttcaagcaaagtaactagatactgcacagtagttacttactactaccttcagttaccgaaaaatttgactgaatttgggttctaccacagttcatatctcgccgggatcgctgcccaagggccttcactcgctcgatctgtcgcggaacaagatcgccaacatcgaggggctccgggagctgaccaagctgcgcgttctcaacctcagctacaaccggatctcgcgcatcggccacggtaaccgcacatcttgcctcaccaatgtcacaatcttcagagtatcctgcatgtccaaaccctccaaattttaccctctcactagtagaattacaattttcagactataccaagtactgagtagagttcctttttccctgtggagtgatgagtgatagggacaaagattagagtttttaatctgtagcatctagtagctgacaaagccagtctggaccagaacaaaatgagcattccaggacatgtcacgttggttctagcatgaatctgcttcatgtattggctgtcactgcctcgtctgtccacagtttccgtgatccaggaacattattaatacagttggaaatggggccttatcatcatcatcatgatcaaatccctgtccctgacttctgtccatccataccctggatgtaaaagtgcactcctccataattccaacctggtccatgcatccactgaatccactgctccctaatgatctcaacttaattctctgaaaaaaaaatcaattcagagcatgactctgttttcacttgagaagaatcttgctgaaaacctgccactttggaaatgaaaaataaaaaaaaaagaaaatctctgcactgcaagtctgcaactgcatctacatgactctgcatttcttcagattttgcaatcttgagaagaatcaagttctaaccatgcaacttcggaaagaaaaagaaaaagaagaaaaaatctctacacttcaactacttcatctacatatgactcttgagaagaatcaagctcaaaccctgcaacttcggaaatgaaaagaaaaagaaaaagaaagaaaatatttacactgcaactacttcatctacatgactctgaatttctttagattttgcaatcttgcccagaattgttcaaaacctgcaactttggaaaccataaaaaaaaataatctctgcactgaaagtctgcaattgcatctagatgactctgaatttcatcaggttttgcgaaatctttcagagatgagatgatcattcatggcggctgactttgtgaatctgaacctggcagggctgtcggggtgcacggcgctgagggagctgtacctggcggggaacaagatcagcgacgtggaggggctgcaccggctgctgaagctggcggtgctggacctggggttcaacaaggtcaccacggcgagggcgctgggccagctggtggccaactaccactccctccgcgccctcaacctcgtcggcaaccccgtccaggccaacgtcggtgacgacgccctccgcagggccgtcacgggcctcctcccccacctcgcctacctcaacaagcagcccgtcaagccccgcggcgccgcccccgccgacggcgccgtgtcgcgcgccgcgctcgaggccggcggcgccgggggaggctcccgtagcgcgcggaagcggtcgtccgctgcggcggcgtcgcggaggctggggcagcgcggcgaggggagcgggagcgggaggagcaggtccaaggggaggcagccgtcgagcagcttgccggcgaggaggtgaagacggcggcggcggcggcgagtgcgaggtccattttgtgttgttgcgatacattcgaatttagaatttgaagatcttttgaatttggaatttggattggagagagagagcgtatgtattgctgcgggtgtgaagtttgactgaatattgttgttcagtttgcaaattattacagtgcatcattgcagctaatagtaggtgtgtgtgatgatgagtggaaaatgatgccaaaatcctgttcttggtcgatcttataaatccagtcttcgtttaaactcaaccttttttgtttcctgttgagatgagaaaatcttagttgaaacatttcgcagacttacgaatgaaaattacttcaaggtttcatatctactactactttaaaaataaaactcgtttccgtcgtccgtttggaaaaaaaaaagcgagaaaaacaaaaagaggaaaaaaacatcaatcggcaaaaaaaaagtccgactcctctgttagaaaaaaaaaagagagaaaaaacgaagagaaaaaaaaaggacgtccgactccccggtggagaaaaaaagtgagaaaaaaaaagaatttttccggtcgttatctcataggtgcggtgtttttttcatccccctcgcctccccccaaatcccagtcggaattgcatcacccccacccaaaaaaattcccaatcggaattcaatcaatcttcacaatgggaattcaatgaaaccccccgaatcccaattgcactaagaatcagataagggaaatatcttccaaaatcggcacaaccaaatcggatgaacacaccgcaagaaaaattcaaccaatctttgtccccaaaaaatcatcccacatacatacatcacaaaactacacaccctcggccgtcgccgccgccggcggatccatccgcggccaccgccaccgccaccgccaccgccgacggatccatcgtcgccggatctagggcgggagggaggtgacaggggaggagggagccgccgccgccaccgccgacggacccacgcgccgacgccgccgacaccaccattgccgccggatctggggcaggagggaggcgagaggggagaagggagccgccgccgccgccgtatccgcccgcagccgccgccaccatcgccggatccacccgcggctaccgccgccaccgccaccaccggcggatctgccgcgggagggaggctagagggggtggagggagccgccgccgacaccgcctcccaccctcggatccactgcggccgccaccaacccgcggccgccgacccgagagggagaggaggagggggggcgcc

SEQ ID NO: 90542 - DNA, 697 bp, Oryza sativa
  unsure (1)..(697): unsure at all n locations
tatcaggcacacatttggcctcataccaacaacttttgttttaaccaatttcaggaaccagtaccagctgtcggtattctcactctcaacaaaagcaaatgccaagggcaatacctgattgatcccatctacccctattgctgttagtatctggccccgatactttcctgtcaagaatgtcccatcaatgcagagaacaggacgacagttcacgaatgccatcttgcatgcatgtagagctaagaacgccctnncgagcacactcttgctaggatgttcaattgaggggaatttcttcaattcgtaagagctcccagggtttctttcctcgataacaccaagcaggcgtggcaaattgtcatacgaggcttcgtaagttccaaatctcatctctattattttctgttgggcccttcaagccttggcataactaatagtatacttgtatgtctcttcgatgtgtcggattattgaccttggttcatatgtgagattgtcgatgacatgcgcatacatctcagatgcaacaaatgcacaagtaatgttcctgtggtatttctgaacaccagatagaaaacatgtatgcttggtaacgactgacactgtccaataatccttccatttccccttatacgcgtgcactctccagggacaaccatctttttccttaatacactgaacttcatattgcgaccgg

SEQ ID NO: 90543 - DNA, 843 bp, Oryza sativa
tccacaactggctatgtaaagaccaatgcatgtagcccataatgagtagacacgtgaaatatcattggaacatcaggatccattagaagctaactggatcaaacataaaagataggaattaactttaaaaaaaacagcaatagaaacgcaaaaggtgaagcgtactaacttctccataaattgcccgttcagatagaagagggtaatcactagcagagacaaaccaggatgaacaaatctgctctttaaacttatgcatacgtgatagctttgaaataagtgaattgtcctcatgtttttttttcccacagagagaacacaatccagctagcagttctacgattaatagatttatctcttgagacgacgtcttgttaccacagcgggtcagtggctgtaaagtacagagcaagctatactttaacctgcaacaaggcacaaaatgcagaaacatggataagggacagctgaaaaggtaactaaacaagattaggtgaaaatacagaacactcatataattattgataccaagaaacttactgcacaatcttggattataataagcatatctgacttttcctctgccatacgagaaacaaggccaggataccacgggccaaaaaatatgacatggaatacgatcaagaaaattagagaggagatataaatgttgaggaaaagagaaaggctcatccgtaaatccaaccccattgactgaaaactggggagatggtgatattgctgccaagaatatccaagcagtatacctgtatcagagaacagttttagagaacaaatatatcatgtttacttaatttacctgctcccagactcacagaggtc

SEQ ID NO: 90544 - DNA, 559 bp, Oryza sativa
tctcttctcctcttgatacagcatgcttctcctctgaatcctttctatgccttccttttttctctaaattgaggcctcatcaacatagatattttcgctgctcaactgtcatggcttcaaggctgcatcacgaaaggatctgaaagtgagaactatcatgccatggtcgttgtgagctgcaattcaggctgatttggattttaatttggctggcaattggtgcttgtaaatttctgaaatcagaagagcccgcacatagcatccctgagttatttgggcctgcttgatgattgccgtttgccaacgagatgggaatcgtgttgattgaagctgtagctgatatgcatttcagcacatttcgttagtcatttcaaatttgtcaccggtgagcatgttggcctgcttgcaccaagcatggacagttgctgccttcttgaatggtgcagcgctagcatcgtggcagagcagtcgtgaccatagttattgagaccggaccggtcattaaaccggcgatgccctcggttcaatggtttgttggttcaaccagttgaaccactgg

SEQ ID NO: 90545 - DNA, 730 bp, Oryza sativa
cgttgatttccctttcacatggtctctctcatcgtgcacacagccataatcatgatcgcaatcatcaactagagaagtcgagaaacaaaggcgtttaccgatagcatggatggtgttgtgtggcgaaccgcagcatgcagcggtaatggaatcaccaggcccgttgttagtagcacaagaagagcatgatgaagagaatcccaacagcttgccagccgctttggccgtgtggtgagcgttgaggaagaggtcgctgacgcagcccttggcgtgctcagcagcggcctcggaggtgtcatcgagctcgtcctggatgcggaagtagtcgagctcgtcgagcacgtcgtcggcattgtacgctaagtcccgcagcttctgcaggagctcgttgaggtcggtgttgtggatctccctaccgcgaacgttgttgagcatggcccgcgcgtagagcagctccatcttgagggcatccacattgggcccgagcttctgactggccgcccacgcctccaccaagccgtctaacacagggttcaacgccttgcccaccacccaccgtgccacgatgatcccggtatccattgatcgatcgcgtggttgtggatgctggtggtttcaaggcaagatagatgtatagaagtagtagatgcagctgcctgcaataagaggaaggaatccatgcaattgatcagccactcgatagtgtcatactagtgcttaattgtactac

SEQ ID NO: 90546 - DNA, 2994 bp, Oryza sativa
aacaggtcgaagtagccattgcgacaaagtttgcagcccttccgtggaggcttggccgaggaagtgttatttctgcactgaaggactcgttatcccgccttggcgtctcctcagttgagctctaccaacttcattggttgtctcattgtcttttcactccaatattatgtgtttattattgttgctagtttatttaactggtgtcatcatctccttttcaggccagggatatggggaaatgaaggtattctttaatatacccatatttaaatactccctccactttttaatatatgctgttgatttttgcatatatgtctgaccagtgcaaatatgcaaaaataagttatgcttaaagtatgtttaatgataaaacaaatgacaacaaactaaatggtaattatatgaatttttgaataagatggtttgtcaaccatatgtttaaaattcaactgcatcatatattaaaatatggaggaaatacataatagaaatatttgaactgtactcaggaagcagtgggagcaattacattgttcttacatgattcaggttaccttgatggtcttggagatgcttatgagcaaggtcttgtaaaagctgttggagtctcaaactacagcggttgtaatctgacttcaagagttacatatgatgcagtttgttgtgctagttacctcttttcagtgaaactaatttcaagaacgctctttctataatttgatacagaaaagcgtctacgggatgcttacgagcgcctcaagaagaggggagttccacttgcttcaaaccaagtaaactacagtttgatatacaggaaccctgaagaaaatggggtaaaagcggcttgtgatgagcttggtattactttgatcgcatattccccgatcgctcaaggtagaattctgattctctgattctgttcttcacattaccattcaactatatcaagatcttttttttgcaagaaaaatgttcaatctagtagtttaaatgaaaatgtcctatcttagaactgaaatgtttacttcatcgatcatcattccatttctcaaatgagtgattatcgaaaataaaatcctagcttaatatgtctcctctgttcaggtgttctgacaggaaaatacactccaaataatcccccaactgggccccgtggacgaatatacactcctgagttcctgaccaaggttgtattttttactaatattattatgagcttgttgcatccttgttcacgaaccctctcctattgcactgctgcaactctgctcattgaagatgtttcttattccaaacagctccaaccacttattaacaggattaaagagattggaggaagttatgagaagaccccaactcaggtgttcttgctgctcaatatttccttttctgaagtctacccattgccaaaaacttagaatgcaaattattcagacataggagtaaattgtaagagggaaaaaatgataatttcatctttcaacaagctcaagggctacctggagatcaacaagatcccaaatgctgaagctaaaacaaccactaacactttgaattctcggaaatttgcagtgcaccaatttcgatgacatagtagtaagcaaagttgctccattctttttttctcctgcattttcttcaggtggttctgaactggctgatctgccaaggcaacgttgtgccgatccccggagcgaagaacgcagagcaggccagggagttcgctggtgcgctcgggtggagcctgacggatcaggaggtggaagaactgcgttccatggcacgagagatcaagccggtcatcggattcccagtagagaagttgtaatttctagtgagtttttcttctactttgggtctccgagaacatcatttacataaatacacaatgatctagacatacatagataggaaccatgtgtagtctttggaactgaaaattaagatgtcttagaaaataaccaaaatttacagtctgagtagcgtacatgcatgtatgctcatcgaccatattacaactaagattggtaactggattatcttcaagaaaccaatgttttattttctctggaaaaagagaaaacctgtttgcaatgtaatgaatatggccagtggcgaagccaggatttgagtatgggggggggggggcaacaaacaagtgattacacttcacacgaggtaaaatatatgttatttcactttacactgggtttagtacatatttttactttgcatcagggtatatcaaaataatttgtgttttacactagattgcatcatataactgcaggaaaatcttataaaccacgtgtgaaacttgtgatatttttttaccaagtttcacaaagttttatccatattttgtaaaacttgatgaaatttctataggtttgattatgtttatcctggtgccaagtgaaacttatttgaaagcagctcggtaaaaagtgaaattgggtgtgttttacccgatgcaaagtgtaatttactccaaaattaacaacaaagtgcaaggattaatatttcagcgatttgaaactaaaatgacgtgagaaagtttcctaatcagcatgtgcaagcgcgagctggaaatacaatatatcaaacgtatacacagtagtagctatagacggcgacgtaaatgatccctgactaattagagcaagattaatagtatagccaattgctagctccaaatcatctatagttaacttaatagttaattcatacaatatttataaacatatactatacaattaatatctggtcccatctgtcatacacacatgcatcttgtagtccgtgctgtagctggttaaatctgtaacccgctgcttttctctctcttttttttatcttctcgaactgtgtttataactggcttatagtatactattgtacctgctcttaagcttaaagctttgaggggatcgagcaattagcaagtgtctatatgggtcattactgcgttttcatgaagttaataaaatt

SEQ ID NO: 90547 - DNA, 1199 bp, Oryza sativa
cgcgctgggctgggcatgggcagggacatctactcgcagctctggcacagcttcgccaatgtcgacgggcacgcggcgggcgcgctcgcgctcgcgacgctgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtgtaagacctcaagaacaccaaccaaccattgatggatagatggtgttgcatcatttgcaacaaggtgaatgttcttgattttttttgctgttcttgctgcagagaagaagggataggatcaatgagaagttgagagcattgcaagaactggtacctcattgcaacaaggtaaaataatttctgcgaaaagttgtgggaatttttgttatcctgtataatagtatagtgttcttggctattgccatggttgaattttgtggcaatttgatgattctagctgtttctcagactgacaaagcatccatactagatgaagcaattgagtacttgaagtccctgcaaatgcaagttcaggtttgaaatcaaactttccccatttctccacagtagcaatagaatttcaatccttctggatgaatcaaatcacggtgcctgattgtgagactgttgcttcatgttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttt

SEQ ID NO: 90548 - DNA, 1335 bp, Oryza sativa
ctaaataaaaatagagggagtaccatttatgtaccatacattttaagacaaacagacttcgtgtaccaatcagttcatacagaagccatgttcgaatcaataacgaaatatgaatgttcacctacacatcattagagatcactgtcctctcctcctccctgtcaaactcttttcctttgaaaaccaaggagaccaccatttcctttttgtgcagtactttgtacgagtactgatgggattaaccggataatatagacatatcacaataattaattctagtgtaaatgtgtaatgctgaatgcttgaaatttaataaacttttcttggaaggtttttggtaccgccacagctgaaataatttctcaagtatgttcaacattgtggttggaaagcagtactatagcgctatcttggagaaaaaaaaattcagcaacagttttggacgcatatatacatagcatgtcagagttaattaattaagtttctggtagtggtgaggaaatatatagttatgataattcctagggattctaccgttttctcagcaactttcgagatggactttgtaggattcgatttattcttgtaagcatttcctgtatgcatgttacattttgataagtactgaagaaatggttatgaatattccagtacaactcaatcaatttctctcatttattcaaaggattatttaaccttttcaaacaacatcgtgcccttcaaaggacccttgattatcaaaattccttgaccaattcatccatatatcacttatatttttcactattcatagacaatcacccattgtgaagttaagaacctcccaaatagcttcaggatgccatcattttagctcttttaattttggaaagatttcaaccattagcttaaaaatcatgtgaagtattctcttaaggaaaaagtacgaattacccccgaactatcgcggtcgaccgaattaccccttgaacctaaaaaccagactttgcttaccccgaacttttaataccggacgaattaccctcctcgacccaatccaaagctgttttgtcctacgtggcgtacatgtagcaatctagtcaacattttctttaaataaaatggtgggacccacatgccattactcctcctcccctctactctctctctcgctctctctctctctctcaggcgtgcgtggactagcagtgggcggtggcggcggcgcgtggggaacggacgtgcggtcagcggcggaagagcgtgtggatggcgcgatgggcggcgggcagcgccgaggagggtgttggaggaggcaggcagggccgaggatgagctccgcgtcaacggcgatga

SEQ ID NO: 90549 - DNA, 757 bp, Oryza sativa
cggattaccccccacccgaactatcgcggtcgaccgaattaccccctaaaccacaaatccggacattcctgactcccaactatgtaaaccggacgaattacccccttgactcaatccgcggtggttttggtttacgtggcatacgcgtggcagttcagtcagcattttattgattaaaaaaatgtaggacccactctcttctctctctcactctctgtcttctctctcactcttcctctctctcacgcgcatagcggcgaggacggcagcacgcacggcgcggcggcgcgcacgcacgcggccgggggccggaggcggcagcgaggacggtggtttgccccgcgcgctccatcgacctccctccgccccgcgcgctccgtcgacctccctggctacctcgatctccgggctgtgctttcccttccttcctttcaccttcccctccattggatcggtgctgtcgccgcaggagctcaccatcacatggcccgacgactgacaactccacctctgggaaggcgatgtcctctcagccgtgctccccgcagattggtctgctcggctcggcatcgctggctcgttttactggtgacgcacgcctagtgttcgatgtaatgtctcagtgaggtggcctgactgcttgcatgatcgttttttcatgttgttgggcagcgcgatgcatattgggaggccatgatgcccaacctgaagccaccggtgaccacgacggcacgagctttggagtacagggaggaga

SEQ ID NO: 90550 - DNA, 1963 bp, Oryza sativa
acgtgcagtgcaggcacagaatcaagtcaaacaacaaacaagatctgatgtttgttcgtttccagcttcttaaaaatagcagcagagtagaaacactcaaagcgaaaaaaggtagaagtatcctaaaaataaaacaggaatcctgatacagagaggtttcagagttttacagctcaaaaggaaaaacccattttatttcaggagaactaggtctgataagagtaactgcattttcgttcacaaagaaaacggagtaactgaatgatggtgcagatgaagtcatgaaactatgcagggggaacgcattggtgcttaaaaacagcaatacaacctatcatggtaacctaaacagcaaggcaacatataatggtaaccaagcatcatggaagtgtccattcttgtttttctctcaaaacaaacattggccatccaaggtgcagaaacaaaatgtcacaccagatgagcaaatcaagcactattattacgtataccctgattcctgataattcagttgatcagtacaggagtgaagcataacatttgccggaatgaccgaaggaggtcatttaatgtaattaagataagaagggagtgaagcataacataaggtggcctgcataatctagcagtccacatgaacaaaacaaatacctcacacaaattcatttgaagtcataatggagcaattcatgcatagatcactaagaaatgtgtattctaaaaaataaaacatatggctgagcggaccaaactttcaatcattttgttgtactgaacagcataacatctgcttattacagtgaatgaatttataaatctcactagcagaaaacaacaataatggtgtaataccaaaaggtacctcttctatctctcgatttaacaaggtatgattcatatgcagcaaatagtgcatatggtattgaactattgacatttggaatgacaaaataccaaatgtcctcaaaatttgtctcctaaaatacaaggagctctcctggatcccaattccattctaacaacttattattgcctgatgataaattacaaatggagatcacatacacctccaagaacacaacaaaaaatttgcatgcgcagctaagttctcatgatcaaactctcctcgtaaccaaagcacaaggcacactttgtcgaattataccgtgatccgtgaccaaaactacaacacggatcatatgcatcgctgagtttggaagggaaatttgtatcacctttttataccggattcagtcaagaaatccggtttgccggagaacggcgtcgcgcacgcggcggaggtcgcgccccttgagcgtccggccgacgccctcgagcatcgaggacggcttcaccggcccgccgaagccgccgccggcggacgcgcgcgccaccatctcgtgcgggggcagcatagcggcgtccccacggaggagctcctcgtcgtcgtcgtcgtcgtatccgtcgcctggcacgccggccagatggtcccacccgctcctccgcggcggcggcggccggacgggcaccttcacgggagccgactggtggtacggcaccgcggggggctgctccgggaggtggaacctcaccctgggggccgatgggatcgcgcgcgcggcggacgggggcgactgggtctgcgccgaggacgacgccgccgcctccgcggcggcgatggtcgccttgcggcggagcagcgccccggcggcgccggcggtggccacggcagcagcgccgccgcgcccggagagcttcctgtccccctcgtgaagcgcggcgaggagccctacgtggccgccctggacgcgggccggtttaccggacggatcgggaggcggcggcggcggagggtccgaggacggggccggcgcgaagaggaggtccccctcgaggagctcgtcgcccgccgcggtcggggaggtggggagagactgggtcggcgaggtgaacatgccgagga

SEQ ID NO: 90551 - DNA, 2964 bp, Oryza sativa
aggattgaattgatcgagttcatcttgatctcattcgggtggtgcaaatttgtgccgaattttgactcagagttttcttgaactttaatttgccaaaaggttccggatcttgccgtgtaccgcctgtacaagatgaggaaggaaggcagggagacgcctgcagacctcgccgccgacgaggccgcggccgcggcggccatgaacaaccgtggacaacaagcgtcggctgcggccatggcgctgccaccgccggcgacgggcctgcctgggggaaggatgatgtccatggcggacaaggcgaacatggcctcgacatcaaaggcgtacgggccgtcaaagtcaagctcatcgcaactccagcaggatgcggcggcggcggcggcgccaccgaacgcagcaggggctagcaactgggcgccgaggccttgcaactgccgggagtgcgcgccggcggcgggacactatggctacttcgcggccgcggcggccatgaacaaccgtggcggacaagcgtcggctgcggccaaggcgctgccactgccggcgccgggcctgcctggggtaaggaggatgtccatggcggacaaagcgaacatggcctcgacatcaaaggcgtacgcgacgtcgcagtcaagctcatcgcaactccagcagggtgcggctgcggtggcggcgccgccgaacgcagcagggcctagcaactgggcgccgaggccttgcaactgccgggagtgcgcgccggcggcgggacagtatggttacttcgcgtccatggttccacggccgtcgctggaccggaagggcaagggcaaggcgccgatggactgtgccgagcaggccggcggcggcggcggctgtcacgcggagtcaacgagcactccggcgccgccgaagggcgccgagtactacggatgcagcgtcgccgtcgaggatgatgacgaagaattgctgaagtttctgcaggcgatggtgaggggcgaggaggtggagggtgatggcgaccacgccatggccgacgagcgcggcccgcagcagggctcctccccggtggcggcggcggcggcctccggctccgcgcctgcaggtcatgacggtcgccgtggctcgctgcagggtggccaccatggatcctcctcccccacctcattggcggccgccgccgccaccggcgacgacgtcacatctgccgccagtgcaggtgacgacgtcagtggcagtcagcaggaagaccaccctgcgcgttgaacactgaaatttgaaatttgaatttgaaatctgggacaaattttcgtcgaatttgcagtgttcaacttcttactcttttctgatcatttggtgttgttacttcactagttctatgtgagagctgcaattctttactagtaatcctggtgatctattgttgctttacgatggtgatttgcttgttctagaatgctcgagattatatatttgttttgcctgagatgaattggttctagtgtactgtcactgatttggtatgaatgtttgacagatgaacaatcatatttaccatatctgggagatggatgaagggatttgaattgactgcttttatgctaacctgtagttttatgatatgaaagtgatatgcaaaagccatcctgtagttttatgaaatgtatgaagcagaggtctaagtttgaaatggacaaactgtattctgtatttctgttttaagcttatgtctctgtgtaataatggtgcaattgaacaaatgttgatctgcatagatgcaagtcttgatcactattttctgtgtggtgacacatggagcaattcttgcaccgtactactttaggcttagacgctttctctcaaaatatcatgttaatagttatgcaatattctcaaaatatttggcaatattcatgtgccacccgaatttcatatctaaactcaattcaccagagagaaagaagagacaaatccactaaatgaacaacaatgcttaaatactatattcacaccatggagtagtgtatgctggtgtactactcagtatcagctagtgcaaactcatggtaggagatcactgatcattggttacagagagatatttgatcaactcagaagatattctagctatcaaattctagattttacatgcaagctaaggccagtgcgtctgtgcgtgcatgattttgtccaaacactagatgctgctcctatacatgtaaaacatctagatcggccttcaaatgggccgggcccaatttgcgagagcaaagtaagcccattaacacccaactaaacacgtcttaaatcacggagacgctccattgatgccggccaaatcaatcgctagttttcacaaccgtcttacggcgatggccgccggcggcggcggcggcgacgacgaccaacgtttcgatctccccgacgaccctcctcctgcgcatcctccggctcgtcccatccaaggaggccgcgtcgaccggcgcgctctcgcggcggcggggctcgctctggcggcgccgtcaacctcgccgcgcgcgtctacttcgacggcggggtcagccgcagcgtcagcctcgacgaacgggaggaggccttctcctcccgccgcgacgccttcgtccgcgcctcgccaggcggcgttcgcggcggccgccccgccggaggcaacggcggctgccgcggcgtcaccaggctcaccctcgacgtgcaggcgaactgccctgcaactccttgatctccaagttcctgaacaatggcggcgagacgacggcgaggtggacgtggttgacctcgtggtctcccaccctgcggcgcgccgcgtcgaggatctccgcgtccgcgttgtcccctgcaggtaccgctcctactccgacgacgacgaggagaaagaggcgagatgagacagcggcgtgtacagcctgtcagcctcaccgtcgagtccgcgtgctggacatcaccgggtgcagtgcaccaggctcgctc

SEQ ID NO: 90552 - DNA, 604 bp, Oryza sativa
ggaaattttacttggttccatcattaaattgtaggaatgtcactattcagattgttctcattactatttatccttttcgatgattcagtgctaccaggaatgctgggatgaattcatattgtgataagaaagaggttactgtagcttttagcaaaactaaaaggcaagaggaggatgaagtgatttggagaatggtagaacaaggcgctacagatgatgaagagtgtggtggtaccaactgttcggctggcgaaaatagggatcctggttggcctggaacgagtgtcttcaggatgctgattcctgcaactaaagttggcgcagtaattggtcacagtggagaaaggcttagaagactgtgtgaggaaacaaaagcctgcgtccgagtaataggtggccactttgctgctgcagagcgagctgtaagttctccatttagtagtattattttttttcttgatcatccttgacttcccattactatttatactagaatactgtttccttttctgcctgcagtatgctagcatttttttttctttttggcaatgatgatcttaattgagtgcttgcaattaaattttatagcatttggccacaaaca

SEQ ID NO: 90553 - DNA, 1269 bp, Oryza sativa
tacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacagtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattc

SEQ ID NO: 90554 - DNA, 1835 bp, Oryza sativa
ctactgcaagtaatagtagatcactctttggctgctgcgctgcactgcaagtctgcaactactaaagcggtaagcacgctttaaataccttgtttgcactcgctaaagcggcatatgcatctgcaaagatcaaagcaaacaaattttaaagaaagaaagcaccacacgcgcatgctcgcacatacatctctctctctctctctctctcaaaggctcagagcacttgcaaataactagcttcaatttctctgtctcttcaccacaaatgcagcagcagcagcacaccatcacattagctttccctttcgactgcaggacagaagaagaagaagaagaagaaggtgaagaagaggaggaaggaagaagggtagtagagaggagcatgcagtacatggcatgattctgcctgtggcttttagtagagaagagtaattgagctcttctgcatctcctctctctgtctgtctctcctccatccaaagtctgcatgcaagaacatcttcttatgatggctctttccctcagtggaagccacactgcctccttccaaagcaaaggtcccaacttttgctgttgcatgggcaagctaaggagtactgtgtagcttagctatagctagctctgccttgcatttgcattgcattgcacttgtgggaaaagaaagggagaaagttatactccttcctagtacaatggtgctgtgtgtgtgtgtgtgttttctctctttattcctctccttttgtaattttgttttgctcttcttggatcagcctgaagcatgtatgcatgcacatgagatgtgtgagtgagatctactgctagtagtagcaaacaagatagagagaaagaacctcctgttccatgaagaatttttatcttcaaatgttggtgcacatttttgtaagatggtgctttgacaagtcttgccagtggctaaaaaacaaggggcttacataggtatactgcctgtgggattagatgctctgttccaccaaagcaatttttaatcaaaagaaagaagggggcatcttggtaaatgccatcctcaagaacaaaatcaagaatttgccaaaaatgccttgatgctctgttccttcccttcttgatgccctgatgcgacctcagtctcctggcttttcattgaaggcaatatgcattctttcccttttgtttctgaagagatggtcctcacttgttaattctctatattttcctcatataattcatgtttaatttgtagtataagattatactaatgtagttctccaagaagaataaaaagaagagagagagagagaacataaaaagaaaatccaaactaaccaaccatgcacagttgacagtacaaaaggactcaatttgatatccatgaaacaaatctgaaatcacataattggatcactcaaaaaagaaacagtgatcactagatgtctaatgcacatcaagtaatcaagcaagcaaacaaggagcaacacaaaacagagctccttaattaacacacaagaactaatcacacgcgcttaattagacgctaatctctagcctaggctcgaaggagaaagcggccaagaagtcgttgacctctccatcgccattgacgcacttggggagctcctcccactggttgctgccgacgtcgcacatgaagcagccgttggcctcgccggagctcacgcagaccatgaggcggccgccgtggccgacgcagttgatgtcggccttcttgccgtggaacgcgtgcgacatggccggcggcatggcggccacctgcctccacgcgccgcggcgaacccccacacccgcaggctcgccgtgtcgaggtactcccccagcac

SEQ ID NO: 90555 - DNA, 1611 bp, Oryza sativa
atatttaacaatcgaaagtagaaaactgtcaagatgaggcaccaccaactgtaagcaaacattgcatcaatgctgaccatttccttttttttatgcatagaattcatctgcataaaagaattgcgctgctggtacaaggcaagccccctatgttttagaaacggattgcattgggtccaacaggttctcatatttcatattgtgatcacatatttccaacaggttctctactagtgcttttcttctattttttcagtcaagaattcaagataatactagactcctttaccaacatgaagaatgtgtaattaattaataaaagcagagaagaagagtcttaaggagaaacaaaaacaagaggcacatttaaaatttgaatgagttggcgaatatcttgagctagattacaataatacttacacaagccagccgatctgttccaatatcaattgtatcctgatgcatacatagcattacctgccagagagtcacacctccctagcataatttggactatttttgttattatcataaactttatatgtttctcacaaaataattgtggttaatgttaaaaaggcatggtgtaatgggtatgattttctaagaatgtcaccttaaagggttacagcagaaacaaccttaacgagaactactaagttctatagtttctccatccaaaagagcctctttctactttaagctctatatttctagacattctggtagttcgaccgtgattttttttggtttcggtatctctggaatatgagtgggtgacttgttagaatttgctcctattgataatacatagaaagggcctgttatctctatcaagatgattctaattcgtcggatattatttattctagtatttggaacacgaaatagatagaatggatcaagaaaaaaaatgaaactatgattcatattaactattcagacctcacaaccagactgaaaaaaatcaagtagttcttaataaaaagaaaaaaagaaaaattcttccttccaattttgtttgcccaaaattgggattttgcatggatttgcttgatctagatgtaaactagaatgccttctcatggtaagtgcaaatcctcgaatgatgaatgtatatagtatctagaaaatacaaatgtcaacatgtaagcacttagcagtaaaagcccgatttatactcacagcaaggaatgcagtatcattccaaacggctctctctagcagccgctttgccttgttcccaacaaaaatgggggaggttggcatagcttcaagtaagttctgatcaagaagtactttattgctaccatttgagtcggggttatatcttgatcttgtagatccctttaaatcatacaatcttgtcacatgacgttcaaacagaagattttccatcactagaacatccatcttcatctcctttccacctttcaggctcttaacctatgtgacatcataggattagactcagtaaaaaaaatctcacaaaaggtactgaagattaaaacaaatgttatatacaaaatccaaaaacagcactttaacaagataactttaattctggatgcaatagtgagatgatgctttcaatcctttgaaatatatagg

SEQ ID NO: 90556 - DNA, 1529 bp, Oryza sativa
ttgtcagagtgctgatgtaaagcccgtgatatttcatcaaagagaacctttgcacggtcaataacctgccaagatttggtgaaaaatgaaaatctcagcaatctaggaataacaaggagcagttttgccataaggaccaacttttggaccaagaatttgaaaagaagttcagctaacttaggaactttagatttattttccaaacctactattgctgcatgctacgcacctcatttgcttctttttgtatccaatccaaaggctggtgactgaaatcaagtttataaggcggtacatgaatagaatgaacattaattggcgcatatcggaagcatgccaccatttttccaaacctgcaagcataagtatgtgagaaaccaagtgctcacaacattgaattccagatgagattttaagccactcttcaataaactaactgagtttaatcaagaaaactatatgtagaccacttacccatagaaccgaaggcagtccctatggagagagtgaccacaactggctaccctacttgcagctgcatgatttgaaaagctaagttccaaaaatttaccaagtgacagaccccaagcagcatcagacatgacaatccttagagttgctggtggaaatccattgctccaagggcactttagacatctgtgccacatccaaatcttcccatccctttcccctggcaaaacgaattctgtatgttttctaactgatatcgttagacttccctgctgatgtgtgtagcaatggacatgagcttcaggtggtttgtcgcaggaaatgcactgataaccctgtatatatccatactaagtactgtaagacacgtgcagtacagtaagcaagaagttagaacaacaagtataagaaagaaaaaagggggaaacctgattaaataggcagtcacgcaaaaaccttccaagaggcttgtcaaagttaccataatactttatgcgtaacatatgtgaacgctcacaaatagttcctttccagacacatcgtatggataatgcgactaagatgctctgatgatcagaagccataatttcttccttatttgatgtgctctcatgtccttgattagtttctcattttgtacagcagtactaggcactggttgcaccatcaccacattgctgtttgtgacattttccacattagccaaatcaattgaaccatcaaaaggctcctttagattagcaaaattagtgatgttggtgctggcctcagatgtgccatgatgacaactaccatttgagttggctaaaactgtcgtcattgtgttaacatctgacatggttgaaccatactcatgataatcaccacaataccaatttttctctagagtagaatatgtgtatgaatgatccataagtacaccagatgttgtagctgaagttgcagttgccttctctattctatcaactgtcttgctgttcgaactaccgccgtagcagaccaagttccagaagaatgagagaaggtagttcgagtttgagtagtgcattcattggaca

SEQ ID NO: 90557 - DNA, 707 bp, Oryza sativa
ctgatgggcagcatattctcctcaaagcatcaaattgttttgcatagtaacaaattacagtatacttcacttgtcctaaaggaccttcatctccaaaattcacctttatgtgacttgcttttctgtatgcgagtggatctgaaggggatggattcttgcctcctgacaaatagaggatattgtcctctgtagaaacaaaacttcttagaagttcagaagcagtttcatccactgattcagttaatgaagcacctctcaaatcagttactgagagtgaattatctgttgtgtcgctttccagttcatctgatagctgaagatgatattcatgggaagcaagcgcataggagatgatgctagtaggttcatcatcataaatcccaacaacagtgtcattaacaccaattggaaagagaaatttgggcccaacctggcgctccaccgtcctaagaaaagaaacatgaacaggagtatattcattgagagcatcaaacctgtttgagcgacaccactgcttgtttagagcacggtaaagttgtaagaaaggcatcccaagccagttggactggtcctctgcactatcgcctagcttgttcaggaagacagaggcatatgaaggtgtatcagtcacatgttcttctgaatcctctgaggatgccacacaatctggtactatcgcactgctagggacaggatcattttacctg

SEQ ID NO: 90558 - DNA, 955 bp, Oryza sativa
gattggttgcatgccgtggggaaaaagctagacacggtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcatggcccttaagaaaagggaattccgagagttgaagcaaggcaaccgcttcgtgatggagtatttgcatgagttcaacaatctggcccgttacgccccggaggatgtgcgggaagatgaggagaagcaagagaagttcttggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctccgcgccccgacctcaattcgtggtgcgcgtctcacagccgcagcaacagcagagtcagcaagggactcgtgcgccccgtcctcctacgccagccgtgcagcctggacaaggccgcagggatgctcaaggacaacaacgtctgtgcttcaattgctttgagcccgggcactttgcggataaatgcccaaagccgaggcgccagcaaggccaagcgcctccccgccccaacaacggtggtaaggatgtcattccgggtcgtgtgaaccacgtgactgccgaggatgtgctgacgactccggacgtcatcgtgagtacgttcctcattcattctattcctgctaccattttgttcgactctggagcttcccactcgttta

SEQ ID NO: 90559 - DNA, 1777 bp, Oryza sativa
tagggtgcgtgctcatgcaggacggtcacgtggtagcctatgcctcacgtcagctatggcctcatgaaggcaactaccctacccatgacttggagttagccgcggtggttcatgctctaaaaatctggcggcactatctcattgggaatcgctgtgaaatatataccgatcataagagtttgaaatacatcttcacccagtcggatctgaatcttcggcaaaggagatggttagaactcatcaaggattatgatgtgggaattcactatcatcctggtaaggccaacgtggttgccgacgctctaagtcgaaagagccattgcaacactcttaacgtccgtggcattccacccgaacttaatcaacagatggaagccctgaacctaagcatagttggtcgtggattcttagctgcgttagaagccaagcctaccttgctcgatcaaatccgcgaggctcagaagaatgatccggacatgcatggactcctcaagaatatgaaacagggtaaagccgctggtttcacagaggatgaacacggaaccctatgaaacggaaagcgggtatgcgttccagataacagagaacttaaacagctgatacttcaggaagctcatgaaagtccttattccatccaccctggcagtacgaagatgtacttagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaagctagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaatcagatcctagaagatatgctccgcgcatgtgtcctagatattgggaagacctgggataaaagtctcccctatgccgagttctcctacaataacagttaacaagccagcatacaaatggcaccttatgaagcgttgtagaggcagcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtataccttcgggtcacgccattgcgaggtgtgcacaggtttcagacaaaagggaagctcgcacctcggtatgtgggtcctttccgtatcaatgctcggcgcggagaagtcgcttaccagctggagctgcccgcctccttgggcaacatgcatgatgtgtttcatgtgtcgcaacacaagaaatgccttcgagtgccatccgagcaggccgactcagagcaaattgaagttcgcgaagatttgacctacgtggagaggccagtgaaaatcctggacaccatggagcgcaggaccaggaaccgggtaattcgtttttgcaagg

SEQ ID NO: 90560 - DNA, 507 bp, Oryza sativa
taaattccaatataaaatggggcaagataaaatttcgttaaatactttgcttaattctataattcctagatttttctggggtttatttgagctaagaaagtatttttaataaatggaattgcatttaagaaataatttaaattgaaaaaggttttaaaaagtcttcttttggctttgggccgaaagtcggcccaaaacctctcttctctctcctcggcccagccggcccagtccgccgcccgcgcgcgcgccctcgctcgctgacaggtggggcccacctgtcagtcgtcgtctaccttcggccgccgccgccgaaaccctagtttcgcgccgccgccgtttcctttccaaatccggccgttcctttccttctccggccgaattgttagaggggaaacaatctccgggatctcctctaccttttctcctttggaatcatcggctaattcgtttcggaagttcgtggaatcgagttcgattcggatcggcctcttttcttcaagcccg

SEQ ID NO: 90561 - DNA, 5591 bp, Oryza sativa
attgactcttcagtcacctttggtatggctatgcacttctataatctataacatcgaggggcccagagatatctctccataggaggggaaaatcccatctttattattcatatcccactacatgtttcgtagcatacccgaagaatacttttataactacccaattacggagcatgctgcgtttagcagttactaagtaagctactacacatgttgggagtcatgataatctaagatctaaggactcaacaccaatactaaatgaaatcattgatgacacggcacatatggctcttgcactgtctcatgttggggctatccaataacatattccccaacatgtgtccatattattaatttaatatctcaataccatgatccatgagacatgatcatcaattaatacatgtgttgatcatttaaacatatttgttccatatatgatatttgatcagcgatcctttataaatagtaacatacaacataaagattctcatgaaagaatcacatattcattaaccaataatgaattatctatttcaaaaaacaatgtcggataaatatgtaaacatagtatgtcatacaatcacttttctccatggtaatgcgcatgactagtaaaaagaaagaaacattatacctacccgcacaatggttgttagagtagtgtgtagaattaataaatgattggctggagtgtccatgtactactaatcaaaagtctacttcgaaggagagatttaattggtttctagttatctaatttaatttaataattcactaatacactgcgtcacatatgtaacgtccttatacatgcatgttcgcttaaaaccagacatcatatattaaaaaaaaataaagcctaaaattgcacactcctaagtctaaaattgtacttggtatgcgtgtgtatgtttaccttttttaacagtacttatgatgttagatatggctttactttatttttatctaagattgaactttttgtaactagttttgtaaaggttatgagctgtaatttttgttattatttctatatgttaaaatatattgttcatccttttcgataagaaaaaaaagatgaagcaattgaaatcattgaatgtcatgtgtgagaatcacctagacagtcctaaaactaaaaacactactttacattgtgaaatggagcgagcatatataattaattggatctatgaacaatataattagatctgccttttgacgttaccttgtcacaaattatggtgcaaatatacggatcgagctacaaagcactactgtccgtctgccatccctgaccatttctttattgtccttagccggctggtgacatatttggtgacgcctaacaacaaattcaggtgatcaccctactgttcatcaagacactttagcagcacacactacagtgcaatggcgctgcatcttctctcactacgggagaaaccatctttggtcggtcaatcaaattccacaatagttccggatgcaataaaaaccgggactaacgatattctttagtctcgatcaaaaggttagagctactttttttataccaatcaagactaaagatcaatttttagtcccggttaaaaaacggtaggcggtgtcagacccctctattatctttagtccactaaagatctatttctagtctcggttgctaaacaaccagaaaaaaagattggcatgcgcggagaggaccaggcatgcgcgcgtgatcgaggaggaggcgcatgggatcagttaataagttagtctccttctcctccctcacatttatctcctcctctcctcactcaccccatcttttcctcttcctcctccggatccgccccctcccctctcctccccctcctcctcacatatcaggcggccgggcggtgatggcggtggcctcgcgtggcagcggccgggcggcggcggaggcagcctcgcgcggtggatccaggaggggaggcggccagaccacccccggcagctgcaggcggcggccggcacggaggcgcgcggcggcaagcggtggaggccggcgcggctacacggatttttttcttttttccttcttaaagtgtgattcgatctgtgttgagaatgaactatattgttctgaatgatttatgttgaactatgttgctgtgaatgatttgatataatgggcgtgagatatacaaaatagcaaaaaaaaaaaaagaaaaaaaacttggtcccaggtatttgaacttcgtagtccaggggttaccaaccgggactaaagatcgatctttagtgtcaagtatttaaaccttcgtagtctcgattggaaaaccgggactacagggggttaccaactgggaatacaaagcatttctccaccagtgtatgagaatgatcttttcttccgtggaattgctgtatatctgtcgacagatttcgatttcttcaccgtcaaaatgttctgaacactaaaattaatatatcttcctggcccatgcacatggataggatgtaaaagcacaaaaaaatgagtttgaaaagaaagtataatatatactcgctccacttttttaatgttggaccttaatttgtatatatatttaaccatttatctttttagaaactcacataattattatttattttgatatgatctagtttatttttaaaggtgctttaagcttggcttacaatttttacgtaattgtataaaagttttaaataaaatagcagttaaatgaatgaacaacagtcaaactgaagggagtatatcacagtccgcataggcagaaacaagtgctcaagttttcaacaaacttggatgtgttaatatgcagatgggggagctgaagaaactggttgaagagggaaagataaagtacattggactgtctgaagcgtcggcatcaacaatcagaagagcacacgcagtgcatcccatcacagctgtccagcttgagtggtctctgtggtcaagagatgctgaagaagacataatcccaacttgcaggtcaacataacaaacaatatatattaatctgcccagagtgaattttcataatattttcaattggacatatgtttctgaacatttcagggaactcggcattggaattgtcggctttttgtccagtggcccaaaaatagtaggcacaatgtccgaactagagatgaaaacggatcgaatacgctcggaaactagctctatcatattcgttttcatattttttctcgaaatcaaaatcggaatcggaaacccggatacgaaaacagaatcgaatattatcgaatacaaatacgaagcgaatatgaatcgaaacgaatacggtaatgtataattatcaaaatatcaagacccctcaaaataagcttcttaaaacgaggaagagatgtagccattagttttcaaaaacaaaacatcagtattctcaaattttatcagtattcttaaatgttatgtttattttccatacaaatttatgttatcatgaaacaaataaattaatgtgtatagctgaaattttcgtaagcacattgaaatttttgaaaattggttgaatattttaaattttgggttgaacatttcaattgaaagtttttaaaaatttgagtggttctttttcagaattgaatttttttatttgtttgtttgtggaccatttaaggacccgcatggaaaaatcaatttttccatacggatgacttaagaagccgtatgcaaaaataaaatttgaaaatttgaaactaatttatctcactcatatgaactccaaattggatgatttttttttcctaaatgtttttaaaatcatgctctatcatgttattgtgttcttactgctattattttggcaatttttttcttgtgactttattttatcaattaaaattttgaatttcaaaacttcaaataatattttgaagctgtaattaatttcagctgaaaaagtcatgaacataaaagttatagagctcatcaagacatacaacttttattttggtcatttcttcatccgataaagtgatagtagtattattcaaaaagtttacacatctctcttatagtttatagaaacaaatgagatagatgtaaattttatgaacaatgttactatcactttgtcggatgaaaaaatgaccaaaataaaagttatagatcttgatgagttatacaactttattgttgatgactttttcagttgaaatcatttagtatttcaaaatattgtttgaagttgtcatattttgaaattcaaattcaaacggttcaaacaaagtcatatagaaaaatgaccaaaacaaaagttgtagatgttgatgcgttatacaactttattgttgaaaattttttcatttgaaatcatttactacccgaaaaattatttgaatttcttatatttttaaattcaaattttatatggtttaatcaaactcggatggagaaatgaccaaaataaaaatgatagatctcaataagttatacaactttgtttttaacaacttttttcatatgagttgatttagtgcctttaaattcgttttaaagagccacatgtaaaatgaaaattgatttttacattaaaaaaatccaccattttcttcaccccaaccttatcctcttgactcttcctctcctctctctcacacacacactttctactctctctctctcacttcctctcatccacagggcgcaggtcgggtcgggcggcggccggccgagagcggtgcggagcggggcaggcggccggccgaatcggaaaattggtccggacagacggaaagtatccgaaccactttcatccctagtccgaacaagattaccggaaggtttcttttgcccatatatattttctctccgtgtttttaatagatgacgccgttgacttttatacatatatttgactattcattttatttaaaaattttatgtaaatgtataagatataaataaaactttaagcaaatgtataagatataaattatgcttaaatactttgtgtgataaaacaactcacaacaaaataaagtataatcagttaaattttttgaataagacaaatgaacaaacgtatgataaaaagttaacggcatcatgtattaaaacacggaggtagtatataacaatccatttgaccaccgtcatctctcttaaatcaatcatgacactatccaaaatttgcaaactcaatgaatggccattttctgtttcttccaggatctaccaagattccagccggagaacatggagaagaacacggtgatcttcgagcgggtgagcgtgatggcgacgaggaagggctgcacggcgtcgcagctggcgctggcgtgggtgcatcatcaggggagcgacgtctgcccgatcccgggcaccagcaccaccaagggtggccaacttcgaccagaacgtggcggcgctgggcgtgcgcctcgcggcggaggagatggccgagctcgagtcgttggcggcggcggacgtgctgcgcggggacaggtaccacgccagcttcctcaccacctagagggactccgagacaccgccattgtcgtcctggaaggaataagattgaatgataactacacaagtgtggctatgcctccattatcct

SEQ ID NO: 90562 - DNA, 2216 bp, Oryza sativa
ttggcatacacaagaagatattacgttttagattgcttcagcatgaaagagtaatatgatctagttattttgttgacagatatgtcgaacaaacaaatattccaagtttaccatggaccaggaaacgtccgttacgggccaactggggtagatctgtcagattttattgtattagaaaggggaattgatagaccggctgagagaagtgtaccttctataaaaggatggttaatgaggggcttgagagttgatccacagacaagtgacatatcaatcaatattatagtaagtcgggcaactgagggtttttattgggaactaatgccagttcaaaactctcgagtgtggaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccc

SEQ ID NO: 90563 - DNA, 6935 bp, Oryza sativa
atggaccgatgaagtttcagtcttcaaagtcagggcatctgtaaatccgagaaatgttggtcatttttttcaaggacaatagttcaaaagttctcagtcaggcgaaagtaagactacccactgtaaggggggtaggtctcagagatgagttttggtttacctcgtcggcatttcacttgaatgttcaacccagtgcagcaatttggttagtaattaaaggagtccgttgcgagccactagcagagtctcccaatctcaagtcaacaggttcaattctaatgtacacccttgaggccaggtcaacagttcagcttagagaagtagcatcgaggatggttgcagttcagacgaaagacaggtcaagcaggttttcctggaattacttgttatttgaattgggaccagtcgaagcggacatagggtaaatgatttataaatgccagattccattttcatcctcttatagccagcgtggtgaattctcaggttaccaaaattgctaacctcaacagttcagtccaaactaagtaagtttcaggagcatccgcagtcctagactgggtcagttcaagcagaaccagtcggtccagttttggcaaagcaaaggaacagaaaggtcgaatccagccagttcaatcgtgcaggtttgatcaaccagtcaatcaatcagttcgaagcagaatgtggcagttcaaggtgcagatcagtcagaccgcccatctgcaccggctttctttctagccatcccagaatctcgggacgagattcctgtaaggggggtagatttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccctttcggcccaattccccccccctctctccctctcgggccggccttctccctcggcccgctcggctctctctctccctcaagtctgctttgcctccccgtcaacccgaggccccacctgtcatcttctcccccaaccgtctcctcctctctccttccccccgagccaccgacaggtgggccccaccagtcagggccatccctaacctccggctccctcagccgaaaccgccgccacggcctccccacgtcgccgccgattccgcctcctcctccacccgcgcgctcgccccgaccgcgggaccgcgtcaccccacctcctccactctcctcccccacttttccccccctccaaaaccggcgccgaaccaccccactcgcccacgtcgccggcgcctcttcccccttcaaatccgcctctcccggccacgttctccccctccaggacctatataaacgactcacgtgcctcccttcatccgttttcccctctccccgagcaccccgcgccccctagacacctccccaccgtgctccctctagccgccgctcgccggcgatctccagccgcccgccaccgccgctcccgtcgctgccgcgctgcgccgcagccacctatagcatcacagcgccccaccgcaccccggcattcactccatctccctcctccaccgccggaaccaccctcccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacacctcccccgtcaacccgagccaccaccaccactggccgactccagccgcgtcgcaccgctgctacagtcattgcagacccacgccgttgcctccctcggctccacaaggacgaggagaacctcggccatctcttcccatcgccggaaactcactggacgtccagattcccgtgcgccggtgagcccttcctcccttcccttcctctccagccggccatgtcgccgctccgtcctccctaacacctcccctcccatcctagggtgcagctgccgctcatccgcctcttcccgagcgccgcccgtcgtcggagcgtcgttgtttccgtccgtcccgagctctgccgtcaccgcctcgcgttgccatctcgccgccggccacctccttccgtcgtatgctactcggtgagctccccctcccttttcccgccgcactccgccgctccccggtcggccggtcggcgagccggctcgcgcccgcctgaggccgcccgatgcacctcgagtgaatctgggccgtccacgtggccgttcggcgccgcccgcgtcggtgccctcgtggcgccacgtcggcgccacctctgccgcatgtccgccgtggccgccacgtggccgtccacgtggtgcgcccgcgcctgtgccgcggtggaccgagtccaccgtgggccgcccccttggctcgctgacgtgtggggcccgcctgtcggcgccggccctttgctgacgtcagcacttgtcatttcctttgagaaattaattattaattgcgcaataattcggtttaattctagaaattcatttaaatggctcaaaatttctaaaatccatatctaattcattcgaactccgaattgagccattcaacttgcaaaattcatctaaaattgagctctacatgtttgtttagtttttatgtcctgtttccttggtttttattagagttttttctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgtctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgcggttgatcggcttccggattcaccgcggcacgaaagggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccacggttatgggcggtcgaccagattcaccgtgattagtctcacacttaataaatcgacctaatacactgtagtttagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaattctgcatgaaccaaaagagaaatgggccaaggcgtatgacacaggtggtgcatcatatggaataatgacaacaaatttggcagaagtttacaactgggtgatgcacggtgttcgtggactgccactagttggcatagtggagttcattttacatgggacatgcagatattttagggatcggttccaggcaattcttccctctatgccgaacaacagcattttgtttggaactttcatgcagaaaaagctagaggagttgcgtaaaaaggccatgaaacatcgagctctagtgcaaggtactcaacaacaaaggtttgagatactttgtcaagataaggcaggcaggggtatctaccgcaagagagtgaagcaggagtgtgttctcaaagccaacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcagcgagatttatgggttcggcatagctggggagttcacagagactaacgatgaagtactcaatattcctgacccatcgaagctccgaggcaaggctagaaggaggaggactcgtcgcatccgcaacgatatggatgagtcggatgctggtagggtgaagcattgcagcaaatgcgatgaacgtgggcacacctacaagcattgtcctaaagacaaggagaaaccaaatgcggcggaggcaggactatcaggatcagcagtagatggagctcgccctacgggtgaagacactacctacactcgaccacgtcctaggcgtcgtcgtgccacatctggctacgtggtgtagttcttatgttctatgttggcatgtggctttgcttgtaatttgtttcgaacttattgatgtgtttatgtttcgtcatgtaatgtcagacttcggcatgtcatgtctttaggtctcgtgatgtaacgtcagactaaggcacctagtgtgtttaggtatgctgatgtaatgtcggacttcgatacgtaatgctatgttatgttatgttatattatcgaactctacatatatgttaaattgcacgtcatcgttatgtacccttagtaacgtttgctatatttaaatagcctgtactcttgttgtacataattattctcatgattttattactatttcataattttacaacttatcttttgttttacattactactttttgaattgttctaacacgaaacactatatttttcagagatggcacgtcaggatacacctcagttgttggacccggcgatagatcaccgacaccggtctcaccttactgcggtacagggggctcagattgggacgttccgggcacggacgtgcggtgagctacttacggttcacgactcctttgtcgagaggtacaaacagtgtattactataaattagttgcgctgtaataattattataatgacatgttaatttgttattgcaggttgcgtgaggccggcctcctaccgatgtgtcggctggtggaggctgccgccggcgacgtggacccggccagacgatggactgtggaccggtccctcctagcagctttggtcgaccgatggaggccagagacgcacacttttcacttgccgtgcggtgaggtagcccctaccctacaggacatatcgtacttgttggggctaccgctcgcgggagacgctgttaggccagtgaccacgggtgtggactggcaggacgatcttacggcacgtttcgcactagtacagcgcgcaccgcatctcccgctcgagccgttggcacaccaccgcaacaccggacctacgaagaggtggctgcttcagttcaccgtgagtgtttttgtaccgaaatgacaaccg

SEQ ID NO: 90564 - DNA, 936 bp, Oryza sativa
cgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggctcggcacgaggggtctgaacgaagcaagtccacgccagggactgacgaacaagctcgggcctggaggtgctcttgcgggcggtgatcttctggctgcggcagacgcggcgacgcttggggcgacagacctctccctgggcgatcttgagctgatgcagctgcgcctccactgcgtctaggtccttcttcagctgcagattctcctgacgcggctccaggatcttcatgttgttctcgaccatcccacggcgcaccatctgatggaagtcgatacaagtcgcgtcgtacgcctccaccatgcgcgccaggtgcatgatggtagcgtcatcctccgagctagcatcccggaaggtggcgaagtcgcgggctcctccgtggcgagggtggtagcggtagggcgagtgctgcaactcgtccgggtagcgctggtgaagagtgacgatggcgaggagagcgtcgttctggcaagcggcggggaaggaatccccacccgcggtgactgccagcgaagtccgctcgggatagccagagaggatcactgcagtgacctcccaaccagcgtggggctccgcgtcgtcaccctcctgctccggaagcggcctggcctggtagtccactccatgtgggtaccccaagaccacgcatatgccccgcagctccaagacgaagccagtcatgtccaaaccacgacgggtgacgctgccggccatctacaaacaaaaacaaaaagaaaaacaacattttaaaggtcagattttggcgataaatgaagcagcaagacagagagagactagacag

SEQ ID NO: 90565 - DNA, 704 bp, Oryza sativa
atcatgtgtaccttcgtgtcacgcctcttcggggagttcatcgttttcacaccaaaggaaaattggcaccgcattttgtgggacctaataagattgtcagtagaagaggagaggtcgcctatcagttggagttacctcaatccttggcagatgttcataatgtgtttcatatgtcacagttgaaaaggtgtttaagggtacccactgaagaagccaatcttgagtagatagaaatccaagaggatctgacatatgttgagaaaccaatccgtatcctggagacagatgagagaagaaccaggaatcgagttatccgtttttgcaaggtccaatggagtaatcactcagaagaagaagctacttggaaacgagaagatgaattaaagtcagctcataagcatcttttcgccagctcttccgaatctcgagaacgagattctgtttaaggggggtaggtttgtcacactctaaaaatcctgaatttataaattgttgtttaaatggaattattagaaatgatttaaaaagcctagaagaaaagatctaattttaaataataaattccaatataaaagtgggctagataaaattttattaaatacttctatagttcctagatttttctggaatttatttgggccaaggaaatatttttaataaatggaattgcatttcatgaataatttaaaaaagaaaaaggtttt

SEQ ID NO: 90566 - DNA, 738 bp, Oryza sativa
aatagctgagctaaaaaagaatatgagggtcggaaaagcccgagagttccatgaagatgagcatggcacaatctggttgggagaaagattgtgtgtgcctgacgacaaagaactgaaggatctcatactcacagaagctcatcaaacccagtattcaattcatcccggcagtactaaaatgtaccaagacctcaaagagaaattctggtgggctagcatgagaagagaaatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcagggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcaaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctctta

SEQ ID NO: 90567 - DNA, 667 bp, Oryza sativa
cgtcaactgttcgggatagaggtattaacggaagcagaagagaaagtcagaatcatcagggaaaggtttaggattgcccagtctcgacagaagagctacgcggataaccgccgaagggaactcacttttgaggcagggattacgtgtatcttcgtgtcactccgctccggggagtacaccgttttcagacgaaaggcaagttggcaccacgcttcgtgggaccctacaaaatcctggaacaaaggggagaagttgcttatcagttagaacttccatccaatatgatcggcatccatgacgtgttccacgtgtcccaattaaagaagtgcttaagggtacatgaagaacaggctgattcggaacacattgatatccaggaggatctaacctatgtggagaagccggttcatatacttgataccagcgaaagaagaactagaaacaaggtcaccaggttttgccgagttcagtggagtcaccattcagaagaggaagcaacctgggaaagggaagatgagttgaaagccgcccatccgcacctcttcgccagctcctccgaatctcggggccgagattccgtttaaggggggataggtttctcacaccctgaagttctcctcctaagcctaaaagtgaattaataagagaccctaagaaaataccggtg

SEQ ID NO: 90568 - DNA, 2063 bp, Oryza sativa
aggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgttgacatccatgagggcgattgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgcagagatgacctcgactacttagaagagcgaaggcggcgcgcggccctccgagccgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgcctaacccatggaacatcgaacaccttcgtcgcttctacccctgaggagggggggtcgggtgtcaggttttggctcaggccaaccccgcacccccctcgggtgtgtagggttggccgggggctaccacacatgcattacattcttatttctcttttttcaacatttcaatagaagcagtttcaatttcctaaaggttgtgtctgtgctgttctttccttttgaagaatcttggcttaaaataaggtcactcgtactcaaccttgccatcgggggttcggtccggtcagctaaaatcgccaaacggggcccagaaccgagccgtgccccggggcgtggtgaactccgggggggaatcgacaaaaacccacaatcgggtcacccatacccctcggtcaccacgttcccggcctggccagtctcgacatgtggatctccccaggcactagccccgacccgagccattcgaggactgggacttgggcacgagcccttatttcaagctaagacgcaaaaggaccacggcacagatcatcctcatctcgtatgtatagcaaaataaaactaacacaaaaattttttcatcatttctgattgcagattaagttaatttgtacacaaaagaggcatgaaggccttagaagaaagaaaaagaaaaaagtaaagattggcgggggcccgggggctcattccgacgcgcccgagtcgacggcctcgtcaccaccatcgtctgcactgctggtgttgccctcctcgtcggagctgggggcgaacgcgagccgaggggccgacccctcgaagcttgcat

SEQ ID NO: 90569 - DNA, 2643 bp, Oryza sativa
ctctcccgtgacccgtagagccgtcgccaccgtgcaagccgccgccgccgtcgcttcttcgtcgccggccgtcatccgtcgtcgttcgtcgcgttggtgagtaccatcgggttcgtctcgtcgtcctctacgtgtacatgccctccttttccgcagccggccgctctatctccggcgaggtcgccatcttggttcggccatgggtgatgtcagcatgacgtcatcggtttatctttttcccgtagattaaatcttcggaaaatcataactaaataaccatagatccgtttcaggtggttcaagttgctaaatttttctaaaataaagatctacatattaaaattatccataaattgaattaaatttatttaattctttttaaatgggctttaattagatttaatcttgtaaaattcataataaattcatttgaagtcagaatgaggccgttcaagtctcataattcatctaaaattatgatctacatgtttgtttattttttatatactgtttatttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaaagttatatatataattgcttagcaatgcttagaaacattagctcactaatgggatgaatcatatatactacattattatttatggttatatttaatggtagctcacgatggttaatcgtgtgatgttaattaattgataattaaaacctggttaaggtgggttgtgagcatatggttttgatggttgtgctcatgacaattaaggaccggttcgcgagctactgttgtgagacattaaccgtaccaaccacaagccagcgtgggcaacggctttatcctttgtatagcatggttcattatagtgcgccagactgagaagtggcgagaagtccacgggggtcgctggggagtccatgccttgtttataagggggtgattatgatccaggaacggtgcactgttttgagttgtgttgtgcaaagggtattgttacgattttcccctttgcaatgccgtggtggtatttcggggcatggcaacatgtgtggaaccgtgccttgtgggtacagtggtacacctctggccagagtaaaactattcgaatagccgtgcccgcggttatgggcgagttgagcaatgtttttcgtgattagtctcacacctctcacaataattattgatgattaactggtaataatttgcttagctcctggtttggagttagatctgttcagccgggtatggttgttcaggatggttgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattctgtatattaaattgtcagtttgtgtacctcggctgattcctggacgagggttctatgcacaaattagttcggaaattactagtgaatttccgggcgtgacaagttggtatcagagccatctcgactgtaggataagccaaatggtcaaaccttaaggactaattttccgaaaacataatttgtgaaaatttctcctttcttccttatctagaattctttgcaaattgtttcattgtctactctcctctctcgttcaacttgaagtagttctgaaactagtggttgaaacctgaagacgccaatgaggtctactgatggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacagatggtgaacactcacgctagtggaagtggaaacaataacaatgaagagaacccaacccttgctcaagtgctggctcaacagacccaattga

SEQ ID NO: 90570 - DNA, 746 bp, Oryza sativa
tccccaaccgggagtaaatatcttttcccgctatttcgaaattctttttaaacccggttagggttaagaaccgggactaaagattatagcactgcatataattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatatatatacttagcatatatatgaatgatattattatattggtaaaaactctaattaaatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgtta

SEQ ID NO: 90571 - DNA, 776 bp, Oryza sativa
ttcgctcatagtccgatagcttgatggcctccttgacaagtgcagacatacccctgaagaagttcatgacactggggtctataggaatcttcttttctggacttcgaggcttgaattgtctcttgacttctgacgcaacgtaagcgtcaagctcctcttgcgtgcaatcgtaccccgggtccttgttcttggcggcgtcaacttttgccttcttcgttgcccttgtgtgggcaggcggtggagctgggggggcctttgactttgaaggtgccggaagaggagcttgcggaggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatat

SEQ ID NO: 90572 - DNA, 1483 bp, Oryza sativa
aattacacatcaacttctacgtagctcaaattatagtccttttaggtatgacgagtaaataatttccaataggtttttatcaagctttcctagaaaacaaatacttctaaattctccactgtaacgcacggcccattcactaataactaaatattctctaaattatctttactaactgtagagcgaagatcgaaaaacatattttggtagttgtatcgtgcacatacacagatttgagattattacagtggtttgtttctgtcctaaagggcacaatcaattactttcatggtatatatttacttattatatatataaatatcaaataaatactctttttttagataaaggaaatgaataaacctggtatctacatccacaagacatgtacaaagacaaagcaaagaaagactcttactgagaaaaagctttgagctccttcaagtggacatgctgcagaaggttaaattccagctttgcaagatctaaaagaacaacaatacactcttcctcctgtccgtactccagcatgtaatgcaacatttcaactctcttgtaggttctcggtaatggtaagtgtagggcaccgttgatttgattatctagaggggccttgagcctacttccatccctcattgattcgaggtggtgccttgcaaaagacatagcttcttcaagttctggctcatcatggacaaggaggtgagctgcattgtacaaacttaataatgcccttggttcatcagctattgtattgatgaacctcccatcctctcctttgaatttttcgaatacatctgcaaggcagctaaattaaatgtggatttttccttccaaaagatactagattcccttttcatacaattttttaatacatcggatattcttgactaatttttatgtatatatatactctaatttggatttatattgaaaaattgtttgacacaaaaaataattacgaaaatgaatgaatacctacaatacaatgacttaaaattttgtgatccaaagaaaaatacaaaaatttgtatatgcaagtcatcaccaatataagaaatactcgcactattgaaaattgggcctatctgtcatgcacacagtggataaattgttactccctccgtttcatattataagtcatttgacttttttcctagtcaaacttctttaagattgaccaaatttattgaaatgaagggtgtattttgtaataaacttgtttggcattattgtagtttgtaaaatacatagtaatggttgcagtgagatatttctgaccaagttgcaattttgtgaaaattactctgcaagttatctcctatagtatttattagtacctggagatacccaaatgccatgctccctaagtaagcgaaagtggagagcaacctcgtggaggctagagctagtgaattcactttctttgatgtcacttattacattgtttatctcatcttggaaaaggtgatctattccaaga

SEQ ID NO: 90573 - DNA, 1321 bp, Oryza sativa
caaggaactggagtcgcacaagcgccgcttggcgaatttccgcaatcaacagggtgctaaccaaagggtccgctacaccaatccctatcccgggggatcctcttcgcagcagcaacaacagcagcagcaaccccgctctgcgccccgacctcaattcgtggtgcgcgtcccacagccgcagcagcagcagaatcagcaagggactcgtgcgccccgtcctcctacgccaacggtgcagcctggtcaaggccgcagggacgctcaaggtcagcagcgtctgtgcttcaactgcttcgagcccgggcactttgtggataaatgcccgaagccaaggcgccagcaaggccaagcgcctccccgctccaacaacggtgggaaggatgtcattcggggtcgtgtgaatcacgtgacggccaaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaatttggatgtgattcttgggatgaattggttggctcaattccaaggagtagtggattgcgcgagacgcaccgtcactctgtaccgagggccggaacaaccggttgttttctttgcacccccaacctctgtcagtagttcagaactgcattagataggactgtcagaaatccccatcgtcagggagttcggagatgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccctggggtgctcctgtgatttttgtggagaagaaagcaagacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaagatattccgaagaccgcattcaccacgcgatacgggctgtatgaattcacgg

SEQ ID NO: 90574 - DNA, 2185 bp, Oryza sativa
gccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtggactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttacttttagatctagcggaaacttttgagaacctccgctccgcccgcataaagctgaaccccgataagtgtgtgtttggtatacctgcgggcaagcttctcgggttcttggtctctgcccgaggcattgaggccaaccccgagaagattcgagctattgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccactctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccacacttaacgccctttgaccccgaggctaaccctgtgctgactcgacccgggaaagagcagggagaagaggcccccgagccgaacggaggccagaggcccctgacgaccggagttggccctttgcccgattgtccgacgatgccaggagcccccgacccccaggacggccccgaggccactgagggaaggacgcccctttcatcatccgaccccgaggtcatcggcacagaaaacaagtgcgcccccaaaggccacttgaacgaagaaccccccgggggtacggcccctagcagagaggatcagccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtataggacgggtggtaaaatgggcaatcgagctttctgagttcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgaccggagacgtccttagatatctggtccgcctcgactttcgagcgaccaataata

SEQ ID NO: 90575 - DNA, 868 bp, Oryza sativa
atttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcctatggcatcgacacgaacagcgctgttttggttcgtgctcttcatgtcttgggctctcgtgtagaatgtgtacccattgatctcatatctctggaatgtcgcgatcgacccagacggtccccttgccaggaaggcaagtagttggttgatcgactcgttacccatgagatgttgtcgtagccacgtggggaaagtatcaatgtgatgccgtgtaatccatgcatcggacttaccgatgttcctggcgcgaactagagccaagtgctcctcgatgtaaagagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctatgcaaaattcgatgacctcctctgttccataacccttggcgatgcttgcctttggacgagcacggttacgaacatacttcttcagaatgcccatgtacctctcgaaaggaaacatgt

SEQ ID NO: 90576 - DNA, 1121 bp, Oryza sativa
ctcccactaatcttctggtatacacaaggctcttcttcatttttgacaaagcccaacaccttggctacttcattaaaacaaatattccaactccgagatgcttgcttcaacccataaatggatttctgcaacttgcatattttttagcttattgtggatcaacaaatcccttgggttgtgtcatgtacacatcctcatcaagatttccattaatgaaagttgttttgacatccatttgccatatcaaaaatcgaaataggcagcaatcgctaaaacaatccgaatagattttagcatggcgactggtgagaaggtttcatcataatcaacaccttaaatttgtctaaaacctttcgccactgtcacgcgcggaatttctatccaaaattccaaacgcttacatgtgtgtaaaccctcgtacaagaatcagccaaggcacacaataacaaattgataatagagtgcaatcattactctaattaataagcgaatataaagttattacagaggtagatagttcctctcaaacaataaaaatccatgcagcggaaaaataagatgaacggcgcagacgactccatcccacaagcagcttgaccagggctacacctaatcctccacaccttcagcatcactgtagaactcttcgtctgatgaatgattgcaaggtgagtatatgacatactcaacaagtcacgcagcaaatatgcaagtgcagggaataacaaagaatggcataatatagtctcatttgcataaatggcatttaataaatactccagaatttaataaaatagtaaagtatttaattaaacagtattaatccaacgctatacaacatacccgttgcataggcccaaccattctgaacaaccaatcccggctacacagttctacctccaaaccaggaatataccattccaaaccaggagctaaacaaattattatcatcatcatttaatatggtgagaggtatgaaactaaacattattagacccgcccataaccgcgggcacgactattcgaatagttttactctggccatgtcgcgcccggaaaaattaccttttcccaaacgctagtgtattaatccccgtcccaggaaaagccgaggtacacca

SEQ ID NO: 90577 - DNA, 1533 bp, Oryza sativa
aaaaccacctaatgttgcataattaatcagcgaagaatctacctaaattcatactagtggaaccatgaatagagtacccactagttggggttttgtttatcctagggtgaacaaggtaataataacaatagcaataataataaggtcataacaaaggtaaataggcatggctaaataatacagtgataacgcgggaattgaaataaagcgataatgcattaatttaaatcaaaataattttataaactaggattcaatatgctcaatgatgatgtgacttgccttgctcaaagagaacggccttccgaaccttcggcgacgatcgcaaaccacgcttcgggaacctccggaacgatagaagctacacgaagcacaaaagcaaagctacaaggctataaagaagcaataacaatacataaaaaggaagtacatggttctttaggttataacaaacattaggagacttgaacgggtcgattcagagttcgtatgaccaaggtatgatcattcgaagtttaatgctgttacatggagattgacggattattgtgattaggttttccaactataaaacatgtgtaagcgctagcctggaaaatacaggaaggctgcgctgttgacatgcagactccacatgtcaacctaaaggaccacagtagaccgagtacacagagacggtccacgggtcgacggaagcggatcccgtgtgtcaaccgaggcaagcggtcgacaaacggactccactagacaccacacgggctgcacacgtggaaaccacgcggctaccgagcgggcacactaacacggacactacacacacaagcgaatgactaccgacaccagtacacgggtaccggggtcgacaaccgcacaacgggcacgggcgacaccgaaaggattaggacggggcagcgagaggatggatccttaccaccacgcgacgaggcgtgggaacgacgacggagaacgggcgcggcggagacagacgggaacgacggagacgaatggcgaggggacgacttcggcagtgatccttggacgaaggcgagacgcggccggcatgaggcctgacgacgtggagccgaggacgaaaacgacgatggggctgcagcaaccttgacgaaacgcgggcgacgatcagcacggcttgacggagggacaaacgcaacgacgaccgagaacgacgggaggacgacgaccggaaccggcgaggaggcgacgagggcagccggcagcagctgcacggagacaaggacggcatggaacacgccgctgcgatgccgacgacggtggcggcgcagcgagacgatgagccggcgaggatgaacggtgaagacgacgacggacaccggcggtgttccgccgatggggaggcgaggccaggggcgaccttgccgctgcgacgctggaggaggagacggcgacgtcggccaatgcacgggcacggcgggaggggctgccggaggcgacgtcgacaatgaggaggatggataggccggcacgggtgacggcattctggtgaaacagaggagc

SEQ ID NO: 90578 - DNA, 3716 bp, Oryza sativa
caccggaattcgcaccccctcgcgctccggtgagttcaaccgctatcgccgccttcggccatgaatgccgggcgtcgtggttcatctccctctctctaatctctctctcttccttccttagggcaccccgaaacccgtccgccggttgccgtcgtcctcccgtggcttgcagccgccgttcgccgtcgtcttcctccgcgccggccaccctcggtgaggtttcctctcccatccattcccctccctctcttcctagccgccgcttagtgccgccgccttcgcgtcgcctttgcgccgtcgcctccgccgcctgatgccgtcgccggcaacgcgttcgcgcgcgcacgccgtcgccatcaccgcggccggtaggccggccttgagccaagccgagccgggtcgtcgccgcccgtccgatcgaccccgagggcgatctaggccgtttggactagagattggactagggattgcttagccatgcttagttcaactagtgcacaatggggagaatcctattaatgtttagactgttggttctaatggtattgttggattagtgccaccgctttggtgttggttaattaaaataaatcacatggtgggctgtgggtgcatggttttgctggtcgcacccatggcagttaaggacaggttcgtgggatgccctggaagaacttatcgtacttaccacaagccagcatgggcaacggctgggcttgtaacgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggtgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggttgaggtttgggcctgttgcaatgtgggatagcgttggacagtggatagttaatattaattaattattacaactgtttaaatctttcaacttctgttttttttaatgctcgctttatgcaaacgaaccactttagctcttctttgataattccctgcatcatgcctctattccggtatgacttgctgagtacagtgggtagtactcagtcttgctctatttttcccaaccccagagtacgagtatgtgtcagatgcaggtttctctgaggagtaggcttcgtccgtgccgtcaaggatgcctgtggagtggtgttccccctgcagttctagtcaaggcttagctcctgttttctttctttctttccgctgcatctacgtgagactcttatcatgtttgtaagacgtggatctgaatgtccacattgtcgtttgtgtaccccggccggtcatggacggggattttaatgcacattctgcttggaattgtattcgggaatttctgggcgtgacatctatccgcctcaacagcaagtccaatttgtcttctattgccatggcaccctacttgatgagaactttctcaactagaccaagagctagatgggggaaaccaggctggctctgataccagattgttaggaacccactacttccaactcaacaacaagcatccaccatagaagcaacaactgctttggggacaagagaagaagaagctatggaatacaagtgctggaaacttctagaaccgaggggggggggggaaggctggagattggaggagaggtagagtagagagatcgacgagggtgcccaccgaccgcccaagtcgccgccgccgccaggagcttcagctccgccaagtccaaatgatctttcgatgccccctagtgttgccgatggtgccgcttatatgctgctcccttccgtttgcttgggcctcttggcgatgggctgaccagcccgtgtgcggcccacccgggatcctgacatacattcattgtggattaggtgcaagaagaggccgtaagtcaagcaattcgattaagatgggggaagtaggaagatacagtaaacccattcatcatgagcagagatgaccatttcatggttattgagatcgtagagagtaatcaaattagttcactcagatcaaacacaaagacaacaggccgtgtaggatatggaaaaatggtgtgcccattaatctaatcattttatcgaaaggagtaacgaattaatttatactgcgaaactgttgtttcagaacaggtccatatcctgtcgtgtggtaacacaactggatggaatcataagatgaaaaggagcagcaagaccgtcttgccggaaattttctggtaatttctgaacttatttgtgcataaaatcctcgtccaggaatcagctgaggtacataaactgacaatttaatataccaatccatcataataatatcgttacatacttacaaaagaaaagaaaagctgcggcggaattacggtctagcgaaggttcggctccactcccacaggcagctcaattggggtataagccaaacgttttctccctctggatcattttaatttcttcaactgaggttgattgattattgcaagatgagtacgtggaatactccacaagccacacagcaaatatgtgagtgcacaaggattccgaaggatggcataatataggctcatttgcaaaagtagcatttagcaaacatttaggagtagtaaaacaatagagtaattaatcatcaatattaatcaacactgaacagcacaaccatgctgcacaggcccaaccatcctaaacaaccatacccagctgtacagatctaattccaaactaggagctaagcaaattattacctgctatagcatcaataattattatgagaggtgtgagactaataacgaaaaacattgctcaacccgcccataaccgcgggcacggctattcgaatagttttactctggccagagatgtaccactgtacccacaagacacagccccacaacatgtcactatgtccctcagtaccaccacggtacctcggaaaggagctgtgacaatacccctcgcacaacacaatccaccacagggcacctttcctggatcataatcacccccttataaacaaggcatggactcccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgagctatcattaagccatcattaaataatagtgaatcataagttatcccaatcgctgcactgcacggtgtctagctttttccccacggcatgcaaccaatccaacgcatccacggggttgttggagctagagaaggtaggtggacggatgcggaggaactcggcgagtttagagtgttgtgggggtggtggtgga

SEQ ID NO: 90579 - DNA, 2115 bp, Oryza sativa
aggggcttgagagttgatccacagacaagtgacatatcaatcaatattatagtaagtcgggcaactgagggtttttattgggaactaatgccagttcaaaactctcgagtgtggaaatggtatgtggaaaatgcattgcaacgcgggtggcctttagctatggttccgtttgttcacccgaaggatccaggtgtgcagatgaacatggatgatggcgagggaccaagtgctgaagtaaatgagacttctgtggaggaggtcaacgcacgagaggatgggggcgtagtagctccagtaggcattcaaccaggtggagtggccgacgagggggagactgtcggtgccattgtggatgaaatagacagggaggattctgacaacgagcgtgtagagaaaggtgattcgtcagatgatgagacggatattaatccagcagaatgggctagtgaggatttttctgagatggtcgtctctgaagaggatagtgtgagatgggagtacaaagaaaatgaggttattcagggagcgatttatagtagagcagaagatatgaaggaggcggtaaaacattttgcagtgtcaattcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgtttagaaataccacaggaacattacatgtgcatttgttgcaactgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaaggtggcattcatgaactgtcgtcctgttctctgcattgatgggacattcttgacaggaaagtattggggccagatactaacagcaataggggtagatgggaacaatcaggtattgcccttggcatttgcttttgttgagagtgagaataccgacagctggtactgattcctgaaattagttaaaacaaaagttgttggtatgaggccaaatgtgtgcctgatacatgataggcacgctagcattctacgagcgatagaagagttgcagtttgggagtatggaacgaggataccctggtgtttgggaagatgtacagagtaggtggtgcatgcgtcatatgggagctaatttgttcaagcaattcaagaacaaggagcccatgaacatgttcaagaggctatgcaatcagaaccaggagaaaaaattcaatgagctttggaagagattagatgagttgacagccaaatgtagtgatcagcgtgcaacggctccatcgaccgccgttgctgaccctcctgaagctcttggacctctcccaatgaatagtccaacattggttagaagaactggattggagattcggaaattttctcagtggattcttgtaacgccccgattttcgttcgggattaaaaatcatttaatgatgcatttcctagaaattgaataaaaagttaagcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaaacctccctcctctctttgggcccctttcggcccaattcccccccccctctctccctctcgggccggccttctccctcagcccgctcggctctctctctccctcaagtctgctttgcctccccgtcaacccgaggccccacctgtcatcttctccccc

SEQ ID NO: 90580 - DNA, 706 bp, Oryza sativa
tgatcggcttttaatctcaataagggtgtaaaaggttccaatcttccagacagattagaaataaatcttcttacaaaatttatctggccgatcatctcttgtagctctgtcttattttctggcggctgaatcttcttgatcgcattaacgctccttcgagtcacttcaatccccctctcatgaacaagaaatcccaaaaattggccagccgacacaccaaaagcacattttgtcggattcatcttcaagccatactttctggttctctcaaaaactttccttaaatcggctatgtggtcctccacctctttagatttaacaaccacatcgtcaatatagacttcaaccaaccagccgattaaatcatgatatatataattcatggccctttgatatgttgctccagcactcttcaagccaaaagtcatgacgacccactcaaataagccaattgcaccagggcatctaaaagctgtcttatggatatcctcttcagccataaagatctgattatatcctacattcctatccataaaacgcaaaattttgttccctgatgcagcatcgactaattgatcggccactggcattggatattcgtcctttggtgtagctttattcaagtctcgaaaatcaatgcacaccctgaccttgccattctttttaataactggaactatgctagaaacccattcggcatatcgac

SEQ ID NO: 90581 - DNA, 1164 bp, Oryza sativa
tgcattaatttaaatcaaaataattttataactaggattcaatatgctcaatgatgatgtgacttgccttgctcaaagagaacggccttccgaaccttcggcgacgatcgcaaaccacgcttcgggaacctccggaacgatagaagctacacgaagcacaaaagcaaagctacaaggctataaagaagcaataacaatacataaaaaggaagtacatggttctttaggttataacaaacattaggagacttgaacgggtcgattcagagttcgtatgaccaaggcatggtcattcgaagtttaatgctgttatatggagatttgtggattattataattaggttttacaactataaaacatgtgtaagcgctagcctggaaaagacaggaaagctgcgccgttgacatgcggaccacctaagggaccacggtggaccgggtacacagagacggtccacgggtcgatagaagcagatcccgtgtgtcaaccgaggcgagtggccgacaaacggactccactagataccagacgggctgcacacgtggaaaccacgcggctaccaagcgggcacactaacacggtcaccacacgcacaagcgaacgactaccgacaccggtacacgggtaccggggtcgacaaccgcacaacgggcacgggcgacaccgataggatgagaacgagggcagcgagaggagagatccttactaccacgcaacaaggcatgggaacgacgacgaagaacgggcgcggcggagacagacgggaacgacggagacgaatggcgaggggacgacttcggcagtgatccttggacgaaggcgagacgcggccggcatgaggcctgacgacgtggagccgaggacgaaaacgacgatggggctgcagcaaccttgacgaaacgcgggcgacgatcagcacggcttgacggagggacaaacgcaacgacgaccgagaacgacgggaggacgacgaccggaaccggcgaggaggcgacgagggcagccggcagcagctgcacggagacaaggacggcatggaacacgccgctgcgatgccgacgacggtggcggcgcagcgagacgatgagccggcgaggatgaacggtgaagacgacgacggacaccggcggtgttccgccgatggggaggcgaggccaggggcg

SEQ ID NO: 90582 - DNA, 2922 bp, Oryza sativa
gaaagatacactggaagcacgtaatgatctgaagcatatggaacaatgcggcgaccttcacccggaaccaaaggagaaaggaagccattacttgagtccagccagctacactcttagcaaggcagataaggaaagtatgtttgaatgcttggagagcataaaggtaccgtctggatactccacaaatatcaagccaataataagcacgaaggagaagaagttcacaaacctaaagtctcatgactgtcacgtgttgatgacacaactgctaccagttgtaataaggggtatccttccagacaatgtccgggcaacaacaacaaagctatgtgcattcatgaacgcaatttcgtagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcattctgaagaagtatgttcgtaaccgtgctcgtccaaaggcaagcatcgccaagggttatggaacagaggaggtcatcgaattttgcatagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctctttacatcgaggagcacttggctctagttcgcgccaggaacatcggtaagtccgatgcatggattacacggcatcacattgatactttccccacgtggctacgacaacatctcatgggtaacgagtcgatcaaccaactacttgccttcctggcaaggggaccgtctgggtcgatcgcgacattccagagatatgagatcaatgggtacacattctacacgagagcccaagacatgaagagcacgaaccaaaacagcgctgttcgtgtcgatgccataggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatttaattagagtttttaccaatataataatatcattcatatatatgctaagtatatatatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaattatatgcagtgctataatctttagtcccggttcttaaccctaaccgggtttaaaaagaatttcgaaatagcgggaaaagatatttactcccggttggtgagaacaaccgggagtaaagatccgggggtatatatattcccggtgcgccctcgtcttcttcaccaacacttagacgttttcggccgatcgatctttctcggcctctctttcgccgccactgcctagggcaaatccccgcgccgacgccgccgtatctcgccgtcgtctcgagctcgtcgtcctcgccgccgcctccgctcctccgctgccgccgcatctctggggtgagagccgccgccgccagatctcccttcatctcgatctctccgatctcgatctctctccgtcgcgccgcccgccacgagacgccgtgccacgacgacgacgcgccacgcggacgccgcgccaagccgccgccggcacgccacgccgccgccttcgccggcgtgcgc

SEQ ID NO: 90583 - DNA, 4502 bp, Oryza sativa
agacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcctccgcaagctcctcttccggcaccttcaaagtcaaaggcccccccagctccaccgcctgcccacacaagggcaacgaagaaggcaaaagttgacgccgccaagaacaaggacccggggtacgattgcacgcaagaggagcttgacgcttacgttgcgtcagaagtcaagagacaattcaagcctcgaagtccagaaaagaagattcctatagaccccagtgtcatgaacttcttcaggggtatgtctgcacttgtcaaggaggccatcaagctatcggactatgagcgaacgctgaagaaagcatcttctggaaagtccaaaccagtccctcagcttggagagcaaccaaaccaggagatcgagccgttggtgaccgggaaagacatgacgatagaagaatttattattgacaccggtctaactacggatcaattgctaggagttgaaccaatagaaaaggcggaattgaaatacatgtacgaactcggtaaaccgcttgtcaagcctgagctggtgcagtccctacccacacaaatgtacaagttccatcagctgtacgtggagatgagcgccaccggtagagagatgatcggagcgaggatcagggacccggacttcttgcaaggagatgatattctctggatcaatttcaagggaatctacgaagtataccagctggacgccctcgatgtctctattatgagttgctggactttgtaagtatattgttcaattataattcttaattactatgtctcctttaattaattaggtccttgtatataagtagactatataaaataaaatactcccttttatcgttgtagaatggagattcaaagggcccgacggcggagggttttcgatactggattcatcgaccctcggagagtaaacgttggaatgctcgaccaatatccgcaggaaacagaggacaatctcgtccatctcctgaaggcgcagcattacaagacgttcatactgttaccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaatgtatatgactcaatggataaaaaagagtctacgtttgacaaggttttcgaacttatagacaggtactggcataagtttctctgttaattaagaaattcttgttatgttaattatttctactacgaatcatatctttaaactccatgtagggcttggtatcggttccgtcatttggtccgcggcaactggagagaaagacttaggcggaggttcaaatttcctgtgagtacacatgctctacatttatatttctccgattcaaattaatacatacaactgtatattaattagatctcacgccgttaatttgtcatttatttgtaatgcgcaaagcaaaagcagggaactaacttgtgcggctactacgtgtgtgagtattgccactgccttgcagaccaaattatcaccacagagagctcgatgtacgtacaaataaattcaaaatttcattacgtaacgatttcttgtttaattactaatcaatttcatacattcatatagtttattcgcatgagggataacctgaccacacacaaggaatttatcgcagcggttcaataacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatgtatatatatatatatatatatatatatatatatatatatatatatatatatatatatattacttcacatttatcctaatacatctttttgtatcttgcagaaaagacgtgttgtcggagtcgtccgtcaagcctgagtggaacagctagccctagaaggaattggagcaggcaagtgacgtaataatataaatgattgttatatttgtaatgcaattaattaagattattagacctgtaattagacttatcatataagattgcgtagtgttctaatattatttgagttttaatataagattattttattgcaaattagacttagtatgacattattgactacggaattggtgcgactcctagcaattgactattgtagtcttaattagacttagcatatacacacgaaacacttagcatacatgactattttagtcttagcatgcaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattactttatttataattagacttagtatgtaattattgactacggaattggtccgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattggacttagcacgtaaggttgtgtagggttctaatgtacgacatttacattagcatacaagacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagtgcacgcggagatcatgagagctttgtcccagattcggagaaagagatgctgtggaccagaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagaagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattgatttcaaggaggacatccacacgtacaggagtcggatgaggagcaagagagataccgaggcgaagattgcagacccagagttccgggtatcgag

SEQ ID NO: 90584 - DNA, 2938 bp, Oryza sativa
tggtcggttttcgccgtcgtcttcctcagcatcgcagcgccaagctgaagcccggccaccggttttccttcgccgaagatcgccaaaatgtcgccgtcaccgtggaccagtacctccacgccagcgtgggcaacagctttaccttttgtatagcatagttcgttgcggggcaccagactgtgaagtagcgagaagtccatggggatcgctgcggagtccatgcctctggttattgagggggtgattatgatccaggtatggtgcgctgtggtggattgtgttgtatgaggggtattgtcacagtcccgtttcgaggtaccgtggtgatactgagggcatggtaacatgttttggggctgtgtcttgtgggtacagtggtacatctctggccagagtaaaactattcgaatagtcgtgcccgcggttatgggcgggttgagcaatgtttttcgttattagtctcacacctctcataataattattgatgctatagcaggtaataatttgcttagctcctagtttggaattagatctgtacagctgggtatggttgtttaggatggttgggcctgtgcagcatggttgtgctgttcagtgttgattaatattgatgattaattactctattgttttactactcctaaatgtttgctaaatgctacttttgcaaatgagcctatattatgccatccttcggaatccttgtgcactcacatatttgctgtgtggcttgtggagtattccacgtactcatcttgcaataatcaatcaacctcagttgaagaaattaaaatgatccagagggagaaaacgtttggcttataccccaattgagctgcctgtgggagtggagccgaaccttcgctagaccgtaattccgccgcagcttttcttttcttttgtaagtatgtaacgatattattatgatggattggtatattaaattgtcagtttatgtacctcagctgattcctggacgaggattttatgcacaaataagttcagaaattaccagaaaatttccggcaagacggtcttgctgctccttttcatcttatgattccatccagttgtgttaccacacgacaggatatggacctgttctgaaacaacagtttcgcagtataaattaattcgttactcctttcgataaaatgattagattaatgggcacaccatttttccatatcctacacggcctgttgtctttgtgtttgatctgagtgaactaatttgattactctctacgatctcaataaccatgaaatggtcatctctgctcatgatgaatgggtttactgtatcttcctacttcccccatcttaatcgaattgcttgacttacggcctcttcttgcacctaatccacaatgaatgtatgtcaggatcccgggtgggccgcacacgggctggtcagcccatcgccaagaggcccaagcaaacggaagggagcagcatataagcggcaccatcggcaacactagggggcatcgaaagatcatttggacttggcggagctgaagctcctggcggcggcggcgacttgggcggtcggtgggcaccctcgtcgatctctctactctacctctcctccaatctccagccttcccccccccccctcggttctagaagtttccagcacttgtattccatagcttcttcttctcttgtccccaaagcagttgttgcttctatggtggatgcttgttgttgagttggaagtagtgggttcctaacaatctggtatcagagccagcctggtttcccccatctagctcttggtctagttgagaaagttctcatcaagtagggtgccatggcaatagaagacaaattggacttgctgttgaggcggatagatgtcacgcccagaaattcccgaatagaattccaagcagaatgtgcattaaaatccccgtccaggaccggccggggtacacaaacgacaatgttgacattcagatccacgtcttacaaacatcataaaagtctcacgtaaatgcagcggaaagaaagaaagaaaacaggagctaagccttgactagaactgcagtgggaacaccactccacaggcatccttgacggcacggacgaagcctactcctcagagaaacctccatctgacacatactcgtactctggggttgggaaaaatagagcaagactgagtactacccactgtactcagcaagtcataccggaatagaggcatgatgcagggaattatcaaagaagagctaaagtggttcgtttgcataaagcgagcattaaaaaaaacagaagttgaaagatttaaacagttgtaataattaattaatattaactatccactgtccaacgctatcccacattgcaacaggcccaaacctcaacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcaccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgttacaagcccagccgttgcccatgctggcttgtggtaagtacgataagttcttccagggcatcccacgaacctgtccttaactgccatgggtgcgaccagcaaaaccatgcacccacagcccaccatgtgatttattttaattaaccaacaccaaagcggtggcactaatccaa

SEQ ID NO: 90585 - DNA, 2049 bp, Oryza sativa
ccccattgtgcactagttgaactaagcatggcaagcaatccctagtccaatctctagtccaaacggcctagatcgccctcggggtcgatcggacgggcggcgacgacccggctcggcttggctcaaggccggcctaccggccgcggtgatggcgacggcgtgcgcgcgcgaacgcgttgccggcgacggcatcaggcggcggaggcgacggcgcaaaggcgacgcgaaggcggcggcactaagcggcggctaggaaggagagggaggggaatggatgggagaggaaacctcaccgagggtggccggcgcggaggaagacgacggcgaacggcggctgcaagccacgggaggacgacggcaaccggcggacgggtttcggggtgccctaaggaaggaagagagagagattagagagagggagatgaaccacgacgaccggcattcatggccgaaggcggcgatagcggttgaactcaccggagcgcgagggggtgcgaattccggtgacgaaactcaacggggaaggagcggccggggtagagcttagcctcgcgaacccgacggcagcgacggcgcggcacggcggcgaccctagcggcggctagcggcggccggagtagcggaaacggcggcggcgggtggttgcacggcgcgggagcgatggggagcacgagggagttcggcgagatgggcaaaaagcgagagggggtgacggggaagcctaaatagtggaggggagccccggatgtggctggaaggggcgggatttcgccggccaacgtggggagtgggggaggagagagaggcgggattcgaaaatcgaatcccggccatctcgggcgcggggcgcgggcgcggatgggagtgagaggggagaagtgggtgcgggagatgcggcgcacgcgcggacgtggctgacgtggcccggagaaggcggaggcgtgggcgcggcggcggttgcaggcgcggcggcgccggctggaggaaggggacgggtccaacaggtggggcccacctgtcggcgtcccggggagagagggaggtgcggcttgggccggcccacaaggaggaggacgcgcgtggcggggtggactgggccgacggcccaagaagaggaaaaggaggaaaagaatttccctggaattgaaaaaaaaaaatttaattttggccaaggcctccaattttaaaaatggttaaaattatttcgagagctctgaaaattccactaaaaatcctattagtgaatttcgacatgtagaactcaagaaaaattccacatgccaattttgattattgtttgcatttctttaatagggtttactcttgctttgcaccggtattttcttagggtctcttattaattcacttttaggcttaggaggagaacttcagggtgtgagaaacctatccccccttaaacggaatctcggccccgagattcggaggagctggcgaagaggtgcggatgggcggctttcaactcatcttccctttcccaggttgcttcctcttctgaatggtgactccactgaactcggcaaaacctggtgaccttgtttctagttcttctttcgctggtatcaagtatatgaaccggcttctccacataggttagatcctcctggatatcaatgtgttccgaatcagcctgttcttcatgtacccttaagcacttctttaattgggacacgtggaacacgtcatggatgccgatcatattggatggaagttctaactgataagcaacttctcccctttgttccaggattttgtagggtcccacgaagcgtggtgccaacttgcctttcgtctgaaaacggtgtactccccggagcggagtgacacgaagatacacgtaatccctgcctcaaaagtgagttcccttcggcggttatccgcgtagctcttctgtcgagactgggcaatcctaaacctttccctgatgattctgactttctcttctgcttccgttaatacctctatcccgaacagttgacgctcgcctgtctgatcccagaagagagaggtgtgcggcacttccggccgtat

SEQ ID NO: 90586 - DNA, 654 bp, Oryza sativa
tgatccataacttgagaaactgtgtttattttgtatctttttgtggcaatggattgaaagaatttggtgttttcttctcccagcatcatccatttatattagtacatctttttttccaataaattttcctgaataccaactttctcccagaagttttaagatgtggtgcttaactgcctccccgaaattctattcaagtaaagaaaggcatctttcttcctctagaagatcaagaaaatcaacgactttattacaatttgtcaagagaagcatgagtctggacaagttcttactccaaaggatcagtttcttcctgagaattttaagtttgaaggaattgcattttgcaggagcatcaaagccaggatccaacattcaaacttgctggacaatatcaaagaaaccttcagcttccacccagaaattttcaaatctgaagattggggacttaaggatttttgtcaatcttgaccacacatggaacatgatcagagatattcctggtcaaagggaggacagttgtgttggcgaaagataaagtccaagatgcagatgtaaatacccaatacagtctttccagtaaaggatcttgttgcatattactccatgtgaacctctcccttttaaagggatttcaagcaaacctagggaact

SEQ ID NO: 90587 - DNA, 4966 bp, Oryza sativa
ccatcacgctcacccgctcgaagatcaccgtgttcttctccatgttctccggctggaatcttggtagatcctggaagaaacagaaaatggccattcattgagtttgcaaattttggatagtgtcatgattgatttaagagagatgacggtggtcaaatggattgttatatactacctccgtgttttaatacatgatgccgttaactttttatcatacgtttgttcatttgtcttattcaaaaaatttaactgattatactttattttgttgtgagttgttttatcacacaaagtatttaagcataatttatatcttatacatttgcttaaagttttatttatatcttatacatttacataaaatttttaaataaaatgaatagtcaaatatatgtataaaagtcaacggcgtcatctattaaaaacacggagagaaaatatatatgggcaaaagaaaccttccggtaatcttgttcggactagggatgaaagtggttcggatactttccgtctgtccggaccaattttccgattcggccggccgcctgccccgctccgcaccgctctcggccggccgccgcccgacccgacctgcgccctgtggatgagaggaagtgagagagagagagtagaaagtgtgtgtgtgagagagaggagaggaagagtcaagaggataaggttggggtgaagaaaatggtggatttttttaatgtaaaaatcaattttcattttacatgtggctctttaaaacgaatttaaaggcactaaatcaactcatatgaaaaaagttgttaaaaacaaagttgtataacttattgagatctatcatttttattttggtcatttctccatccgagtttgattaaaccatataaaatttgaatttaaaaatataagaaattcaaataatttttcgggtagtaaatgatttcaaatgaaaaaattttcaacaataaagttgtataacgcatcaacatctacaacttttgttttggtcatttttctatatgactttgtttgaaccgtttgaatttgaatttcaaaatatgacaacttcaaacaatattttgaaatactaaatgatttcaactgaaaaagtcatcaacaataaagttgtataactcatcaagatctataacttttattttggtcattttttcatccgacaaagtgatagtaacattgttcataaaatttacatctatctcatttgtttctataaactataagagagatgtgtaaactttttgaataatactactatcactttatcggatgaagaaatgaccaaaataaaagttgtatgtcttgatgagctctataacttttatgttcatgactttttcagctgaaattaattacagcttcaaaatattatttgaagttttgaaattcaaaattttaattgataaaataaagtcacaagaaaaaaattgccaaaataatagcagtaagaacacaataacatgatagagcatgattttaaaaacatttaggaaaaaaaaatcatccaatttggagttcatatgagtgagataaattagtttcaaattttcaaattttatttttgcatacggcttcttaagtcatccgtatggaaaaattgatttttccatgcgggtccttaaatggtccacaaacaaacaaataaaaaaattcaattctgaaaaagaaccactcaaatttttaaaaactttcaattgaaatgttcaacccaaaatttaaaatattcaaccaattttcaaaaatttcaatgtgcttacgaaaatttcagctatacacattaatttatttgtttcatgataacataaatttgtatggaaaataaacataacatttaagaatactgataaaatttgagaatactgatgttttgtttttgaaaactaatggctacatctcttcctcgttttaagaagcttattttgaggggtcttgatattttgataattatacattaccgtattcgtttcgattcatattcgcttcgtatttgtattcgataatattcgattctgttttcgtatccgggtttccgattccgattttgatttcgagaaaaaatatgaaaacgaatatgatagagctagtttccgagcgtattcgatccgttttcatctctagttcggacattgtgcctactatttttgggccactggacaaaaagccgacaattccaatgccgagttccctgaaatgttcagaaacatatgtccaattgaaaatattatgaaaattcactctgggcagattaatatatattgtttgttatgttgacctgcaagttgggattatgtcttcttcagcatctcttgaccacagagaccactcaagctggacagctgtgatgggatgcactgcgtgtgctcttctgattgttgatgccgacgcttcagacagtccaatgtactttatctttccctcttcaaccagtttcttcagctcccccatctgcatattaacacatccaagtttgttgaaaacttgagcacttgtttctgcctatgcggactgtgatatactcccttcagtttgactgttgttcattcatttaactgctattttatttaaaacttttatacaattacgtaaaaattgtaagccaagcttaaagcacctttaaaaataaactagatcatatcaaaataaataataattatgtgagtttctaaaaagataaatggttaaatatatatacaaattaaggtccaacattaaaaaagtggagcgagtatatattatactttcttttcaaactcatttttttgtgcttttacatcctatccatgtgcatgggccaggaagatatattaattttagtgttcagaacattttgacggtgaagaaatcgaaatctgtcgacagatatacagcaattccacggaagaaaagatcattctcatacactggtggagaaatgctttgtattcccagttggtaaccccctgtagtcccggttttccaatcgagactacgaaggtttaaatacttgacactaaagatcgatctttagtcccggttggtaacccctggactacgaagttcaaatacctgggaccaagttttttttcttttttttttttgctattttgtatatctcacgcccattatatcaaatcattcacagcaacatagttcaacataaatcattcagaacaatatagttcattctcaacacagatcgaatcacactttaagaaggaaaaaagaaaaaaatccgtgtagccgcgccggcctccaccgcttgccgccgcgcgcctccgtgccggccgccgcctgcagctgccgggggtggtctggccgcctcccctctggatccaccgcgcgaggctgcctccgccgccgcccggccgctgccacgcgaggccaccgccatcaccgcccggccgcctgagatgtgagcaggagggggaggagaggggagggggcggatccggaggaggaagaggaaaagatggggtgagtgaggagaggaggagataaatgtgagggaggagaaggagactaacttattaactgatcccatgcgcctcctcctcgatcacgcgcgcatgcctggtcctctccgcgcatgccaatctttttttctggttgtttagcaaccgagactagaaatagatctttagtggactaaagataatagaggggtctgacaccgcctaccgttttttaaccgggactaaaaattgatctttagtcttgattggtataaaaaaagtagctctaaccttttgatcgagactaaagaatatcgttagtcccggtttttattgcatccggaactattgtggaatttgattgaccgaccaaagatggtttctcccgtagtgagagaagatgcagcgccattgcactgtagtgtgtgctgctaaagtgtcttgatgaacagtagggtgatcacctgaatttgttgttaggcgtcaccaaatatgtcaccagccggctaaggacaataaagaaatggtcagggatggcagacggacagtagtgctttgtagctcgatccgtatatttgcaccataatttgtgacaaggtaacgtcaaaaggcagatctaattatattgttcatagatccaattaattatatatgctcgctccatttcacaatgtaaagtagtgtttttagttttaggactgtctaggtgattctcacacatgacattcaatgatttcaattgcttcatcttttttttcttatcgaaaaggatgaacaatatattttaacatatagaaataataacaaaaattacagctcataacctttacaaaactagttacaaaaagttcaatcttagataaaaataaagtaaagccatatctaacatcataagtactgttaaaaaaggtaaacatacacacgcataccaagtacaattttagacttaggagtgtgcaattttaggctttatttttttttaatatatgatgtctggttttaagcgaacatgcatgtataaggacgttacatatgtgacgcagtgtattagtgaattattaaattaaattagataactagaaaccaattaaatctctccttcgaagtagacttttgattagtagtacatggacactccagccaatcatttattaattctacacactactctaacaaccattgtgcgggtaggtataatgtttctttctttttactagtcatgcgcattaccatggagaaaagtgattgtatgacatactatgtttacatatttatccgacattgttttttgaaatagataattcattattggttaatgaatatgtgattctttcatgagaatctttatgttgtatgttactatttataaaggatcgctgatcaaatatcatatatggaacaaatatgtttaaatgatcaacacatgtattaattgatgatcatgtctcatggatcatggtattgagatattaaattaataatatggacacatgttggggaatatgttattggatagccccaacatgaga

SEQ ID NO: 90588 - DNA, 1851 bp, Oryza sativa
tagtattgccggaatcttgttttgacagttggcgcgccaggtaggggttgcgccatgtttttcgccgactagtgtgatgggattcgtttcgggcatcaccgacttcactttccctcccgggcagacgtgctggttcggcggcccatggacctcatcagccacccgtacatgcatgcaaagaagacatcgtacgacagatcaatccatgattataaatcaagctaataatactatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagcgacggcgctcttcggcttgacgacggcgacgatgctccggcggtcttcgacggcaacgaaggagcggacaaggacggcgacgacttggcgatcacgacggcggtcttcccgagcgacggcgacggctgaaacgacggcggcgcacggctggagcggcggcggcgacggcgaagctagggcacacggcgctagagcgattccgacgacgagaggcgaaggcgaaggtggcgacgggtagaggagacaccgggggtccttttaaaggggctcggaggcggcggcaaaggcccacggcgacggcaacggcgaaggaaagctcgggcttgaaggaaagaggccgatccgaatcgaactcgattccacgaacttccaaaacgaattagccgatgattccaaaggagaaaaggtagaggagatcccggagattgtttcccctctaacaattcggccggagaaggaaaggaacggccggatttggaaaggaaacggcggcggcgcgaaactagggtttcggcggcggcggccgaaggtagacgacgactgacaggtgggccccacctgtcagcgagcgagggcgcgcgcgcgggcggcggactgggccggctgggccgaggagagagaagagaggttttgggccgactttcggcccaaagccaaaagaagactttttaaaacctttttcaatttaaattatttcttaaatgcaattccatttattaaaaatactttcttagctcaaataaaccccagaaaaatctaggaattatagaattaagcaaagtatttaacgaaattttatcttgccccattttatattggaatttatttattaaaattaaatcttcttttcaagacttttaaaattatttctaaaaaaattccatttaaacaacaatttatatattttgaattttcagggtgtgacattagtttatttataatcagtataatcttagtagttaaaccttctgggatttgcattgatgctggtataatgtctgattaccaggtcataagtctgctctggctaggccgagaactatgccccggggactcagatgctctacaccgattgcaaggctgtagagtaataagtagtaacttaagcatggggtttaggttatcacttatcattattttgggatatattcaccgggagagtagcaggccgctgatggtgacagcttaatacgtgcgtcttccccacagtttatatttctacgtacaatttccttgggtaggatacacctttgtatcctactttggtttgagggttatgacaggttgtcataagaaactcgtcaaccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaata

SEQ ID NO: 90589 - DNA, 835 bp, Oryza sativa
gggataactacgtggcgacccgtctagatgcaacggaggttacttgggcagagttttgtcaaagtttcaggaaggcacagattcctgaagggattatggcacaacagaagagagagttccgtgcgctccaacaaggaaccatgtcagttacagagtacttgcatgagttcaaccgccttgcacgctatgctcctgaggacgtgcgcaccgatgctgagaagcaggagaagtttttatttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgactacaacggtggcaggcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggcccctttgctggcaagtgtccgaagctgaatcgcactggacccaggttcatccaggcccgcgccaatcatgtgtctgcagaggaagcacaggcagcaccagaggtcgtgtagggcacgtttccagtgaactcatatccagcaacagttctctttgattcaggtgcctcgcattcttt

SEQ ID NO: 90590 - DNA, 665 bp, Oryza sativa
ttgtccaggctgcacggctggtgcaggaggacggggcgcacgagtcccttgctgactctgctgttgctgcggctgtgagacgcgcaccacgaattgaggtcggggcgcggagcgaggttgctgctgctgctgctgcgaggaggatccccctgggtagggattagtgtagcggaccctttggttagccccctgttgattgcggaaattcgccaagcgacgcttgtgcgactccagttccttgtgcttggcttccaagcggatgctcttgtccaccaaacgctggaaatccggataatccccggagaccagacgcacggacagctcagggtccattcctgccaagaacttctcctgcttctcctcatcttcatgaacatcttctggggcgtaccgggccaggttgttaaactcatgcaaatactccatcacagagcggttgccttgcttcaactctcggaatttccttttcttaagggccatgactccggcgggcacatgggtcctccggaaagctgcggtgaagcgggcccaggtaataggctgcccctctagctgtgtagcctggaagtggtcccaccatagagatgcgggcccctgcagttgatgggcggcaagatgactttctcctcatcgttgcactgcacggtatccaactttttccccac

SEQ ID NO: 90591 - DNA, 1148 bp, Oryza sativa
ttttcgagacaagagggcgtgtcgacttatgagcacatcagccgattccttgctcagtgcggtgaagcatcggctgtagacaccttgagagttaggttgttccggttatctctgtccggatcagcttttacttggttttcctctttgccatatgggtcgatcaatagttgggccgatttggagaagcaattccacagctatttctacagtggggtccatgagatgaagttatccgacctgacagcgatcaagcagcggcatgatgagcctgtgcacgagtatattcagaggttcagagagatgcggaacaagtgctttagcttgagtctgactgatgctcagttagccgatttggccttccagggtatgattcctccaatcagggagaaattttcatccgaagacttcgatagcttatcgcatctgatacagaaggtaaccttgcttgagcataggtcggcggaagtcaggaaaagctcaaagaaagttaatcacgtttgtccatatatgtatgggtcggatgacgaagaagatgattctgaaatagctgcagccgaatgggtaaggagcaaaaaaggttataccatgccaatgggtaaagagtcccgggaaagaggagaagtatgactttgatatcaccaaagctgacaaaatttttgatttgctactccgagaaaagcagattcagctccctaccgatcatacgatcccatcggctgaggaattaggcaagaagagatattgcaaatggcataattctgggtctcattctactaatgattgtaaggtctttagatagcaaatccaggttgccattgaagggggaaagattaggtttgatgattccaagaagccgatgaaggtcgattggaatccttttcctattaatatggtgcatacagctggtcaagcagccgatagagcccgtgcaaagggttttcaagtaaattcggctaagattatcaacaagtatcagaagaagtatgacaagcagcaggagaggagttatgaagaatacgacgatggttttgatcctcattggggttgcgagttcttcagattctgctggaatgaggggatgaggttgccatccattgaaaactgccctggatgcagtgatatcatcgagagctcaagccgcacacata

SEQ ID NO: 90592 - DNA, 1149 bp, Oryza sativa
agatgttgcaggacgctagggagaactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactatgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgcccattattattcaaggccccaagcaacctggtaacgacatcgacgtgtacctaagaccactggtcgaagatgttaaacagttgtggaagaaggaaggtgtccccgtgtgggacgaggacaaacaggaggagtttaacctacgagcgctgctgttcgtaaccatcaatgattggcctgcacttagcaacctatccggacagtccaacaaggggtacaaggcttgcactcactgtatggatgaaacagaaagtacgtatcttaagcactgtaggaaggttgtatacatgggtcatgtcgattccttgcagcaaaccacccggtacggaagaaaggcaagcacttcgaacataaggctgaccaccgtacgaagcctaaacat

SEQ ID NO: 90593 - DNA, 4373 bp, Oryza sativa
agggctcgtgcccaagtcccagtcctcgaatggctcgggtcggggctagtgcctggggagatccacatgtcgagactggccagcccgggaacgtggtgaccgaggggtatgggtgacccgattgtgggtttttgtcgattcccccccggagttcaccacgccccggggcacggctcggttctgggccccgtttggcgattttagctgaccggaccgaacccccgatggcaaggttgagtacgagtgaccttattttaagccaagattcttcaaaaggaaagaacagcacagacacaacctttaggaaattgaaactgcttctattgaaatgttgaaaaaagagaaataagaatgtaatgcatgtgtggtagcccccggccaaccctacacacccgaggggggtgcggggttggcctgagccaaaacctgacacccgaccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcaatcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctataccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggctgatcctctctgctaggggccgtacccccggggggttcttcgttcaagtggcctttgggggcgcacttgttttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgtggccttcccgcagtggccttggggccctcctgagggtcgggggcacctagcaccgtctgacaagcgggcagagggccggctccggtcgtcaggggccgtaggccaccgtccgactcgggggcctctcctccccgctcgctcccgggccaagttagcacagagtgggggtgcacgaaatgaggattgtcttcatcgcgtccacaaccaatgctgcactaactacttgggggttcgccgctaagtaaagtagcaggggctcatttggctccggggcgactagaaccggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcaatagctcgaatcttctcggggttggcctcaatgcctcgggcagagaccaagaacccgagaagcttgcccgcaggtataccaaacacacacttatcggggttcagctttatgcgggcggagcggaggttctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtccacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaagtgccaagcctctcgtcaccaccctcgggcttggtcgccgcagcgaggtggtccgcacgctgctccatgcaagcg

SEQ ID NO: 90594 - DNA, 696 bp, Oryza sativa
cacggaaccctatgaaacggaaagcgggtatgcgttccagataacagagaacttaaacagctgatacttcaggaagctcatgaaagtccttattccatccaccctggcagtacgaagatgtacttagacttgaaggagaaatactggtgggttagcatgaagcgggaaattgcagagtttgtggccctatgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaagctagccgagctctacttcgctaggatcgtgagtctccatggcgttcccaagaaaatcgtatctgataggggaagccaattcacctctcacttttggaagaagctccaagaagagctgggtacccgattaaatttcagcaccgcctatcacccgcagacagatggacagaccgagcgtctaaatcagatcctagaagatatgctccgcgcatgtgtcctagattatgggaagacctgggatcagatgtctccctatgccgagttctcctacaataacagttaacaagcc

SEQ ID NO: 90595 - DNA, 962 bp, Oryza sativa
agtgggcggtggatctcaaccacaagcctctgtaggtggtgttgctagcattccttctatagtggcacaggtaactgcacaagtagccaatgcattgagtgcaaatcaacaaggccaggtttcatcatctgcgcagaacacagtagatcagggatctcgctcggtcacaactaatggagttgacaatgtggattctctggtatcagcaagtacgcaactgcaaaatgagctgtcagattctaacaatggacgcacttcactaaatgcacaatctcttgtagctggagcaggtgcctttacattctttttaatgtatcgaacattttctctaatggaaaatgtactgaattgttcaccattcctgtttgttttaatttctctaatcaggtatttctccttcaaacacatctgatcccaatttagcatcggaagacagcagcactgaaaatgctcccaacatcggcagtattcaacaacatccagagatggaagggatccatgcagataatgtcagaaaaccttctgaggaatcaacaacagccaacttagtggggcagatcacaaccacctgtacagatgatatttctgtgaacagatcagcagaaaattcttcacagaagaacattccattggatggagtatctgcacagtccattaagccatctgcaagtagtaggtctgaaccagtaggtcttggtggaggtttgcagcctaaggtattagttaattattttagtgtttactttttagtaataatgtttcctgtaatttgattgtttagcctgcattttgttatccatatcttagcggggttagaatttgccatggttggcagcagtttagttgattggtttaatcacttcaccatttggtctgaatgaaaatggcagacattttactgttgagaaaacgtagtatgccattcatacatgattatttgtcccaaatatgatatgatcccc

SEQ ID NO: 90596 - DNA, 6233 bp, Oryza sativa
caggtacaatagcaggcagctgcaaacatattttaagcagataaatgagaagagagaatgacagcgggctacagatctgtagccagctgtaacacggactccaagacgcagtgtgtgtatgacaggtgggaccagatattaataatgtagtatgtaactatcgtatgaatgagctattagattgactatagatgaattggagccaatagtgagctatactattaaacttgctctaagatagggtactactgcttcctcgaaagaaaaaaaaaagggtgtagatcgatcacttttgttgtgtgcgcgcgccgtcgtcgtcgtcgaaacagttgtttgttgttgttgggctcaagaacagaacaaagtagtccgggtgacttgtggtgaagctgattttatgaccagactcgatgtgtgtttctgtagcaaaacggtttggtgaggttccagtttgagaaaattccctatatacccctgaaaatttactcaatcccttcaatacccctgaatttgacattatcccttatatacccatgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccaaaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggccctttcagttttcagttcagagtcggccggtccggcgtcagacaccgagcaatgcggcgttcttctccagatgcttaaagatatgtggttccagtatttctgggtttcattttggttagccttgactcttgactcgtgtgtttgacaagttcatcttctgaccagattaatatactcgtaagagagagaaagggggaagcgccacttttatttgaggtgatcttgaataatgttgctagggggtctgatttcatcaatctgccgttgtgtggtggcactattctatttattttttaaatgttagtacgtatttgctgctctaatgttagatacttactggtatattgtattggcgttattgagtcaatgggtttttactattgtttctaagcagatttacttttgaaaaaaaatcgccaataaagaatattatggaagaatgaattatcttttatttactgccagccattctctcaacataaaaccaccatggcttgatgttggctttctcttcttgagtattgttccatgtctctttgagttcgagcataactctttattcagctggtattttcagattttgtattgccatccatgccgtcaagctttaataatttggaaataagtagatgcacggtatttataatttgccaagtaaaaatgaacaatagatttctcttaaaaacatatttctaggacattgtaatgaaaaaaaattatgagaccacataattaaaatagttataaaccattataacatataaattcaatccctaataccctacagatattacacacttaatatgagtttttttagtgagactaaaaatttatcgttggtcacaccctgtcgtgggttttcccataaggttcttataataacctattataatttaccataaccattaaactattcatattatctatactatccattcgttttattatagtcttaactagttcgaccctataacacatccatcctgaaatcttttttacttccatccttaatatccttgtcgaaggctaaaatcattaccccatctatttcatatgaaaccggggagtatattttaaaacgaaggaagcagcgtaatcttagattgagttattttcagcaactcaaaacaacaaatttctcatttatggttagcacgtttatcaatgatgtattttgtgtaaaagaatatgtattttttaataaataaataaacatattttttcaacttttaatagttgttttagaacaaacttataatagttaatattaaatttatgctaacggttattcttgttttacgtgtctcggaaaagcaagccagtatgtttactcaccctaaagtgatacggtcaaaggtacgaacaggacacggtgtccacgccttaaacaagcattaaagaaactgatgacgacggttaattgtataatttcaccgcgcctaattaaagaaacagcaaggcagcaacgcctatccgatttttattactcgcgccacgccagctttgggtagcaggaagaacccaaggatagatacttcggctggcgtcaacgtgtaacgtatgtgcagtgcaaacgagatcctgacacgcatggataacgcccctgactgacgaccgggccacagacagcgggccctttttaccctctctggctgtagtcggaagaaagcaacgtctcgggtggttgccgtgtgcgcccgacgcagcagcagatgcaaacgcagcctttgtactttcgggaatacccatgagtgactcaacccccccaatcccccccagaacaccaaacctcgtaaactacttgaaaaaaagaaaaaaaaaacagaagacggtaaagccgccaccacgggtgccacggcttttgatacgagagccacacgccgagaccgagacgacgccgttggaacggaacgcaacgtgcggagagagagcgagagagaagcacatggcacgacgacgccgcgcgccccggcaccggagagaatcgaaccgaccagccaaccaaccgcccgcggcaggatcgcgctcattcgcccgtgagatcggcccgaaaccacgtaaaacccccccaccccccaccacctcgcgccgcaaccgtgcccaacggcacaagcgcagttacgccgcgcgtgatgcgcctcccaccaccaccaccagcgcgcgtctccgcctaaacatagctatctccactcctacttcccggtctcgagctacaccaaacacaacgggtcatttccctccattttgatccgggagaatagcaaagcaaggggcgggggtggggattgtctatatttaccgcacacgcgtcgttggcgaggcgggggggtagctgctacctttgggagttgggtggcgccatggcaacatcttcggtggccgccatgccgcacgactccacgccatggagggacccctccagggcatcctccaggcagcccgccagggggttcttcaacatcctcgtcccgccgccgcagtcgccgcgcccgcgctgccccgaccaccaacaccaccaccaccaccaccaccaccacgatgctgctggtggcgcggcggcggcggcggcggcggcggcggcggagcccacgccgaggcggcggaagcagatactggatcggtgggcggcggcggcggcggccgcgtccgccacggcgtccgccgaggcccccgcgccgcaggagcagaggcggagggcgagggacgccgagctgtccgcgctcgcgtcggccacccgccccgtgaccgcccgcgccgccgtgttccgggagccgtccccagcgccgtcggacgcgtcgtcgggggcgggggcggggtgcgggggcggggccgggtgcggcgcggagctcccgcccgcggcgccgcgcgcgtcgtcgctgatccagcggtggcgggagatcgaggcggtggggcccgccacgccgcggccctgcgacctggcctccgactccgacggcggctcgccgcggggccgcgtggggtgcatcgtcaagaagctcagcggcacgtcgtcgatccccgacgacgagctggacgccgccaacaaggaggtcgcgatgtcgcagtccgcgcccccgtcgcccgcgccgatgcgcgccggggtggagccgcccaccaacatcgccggtatcaacgggtccaggccgacgcagctggtagtccgcacggtgcgtggccgccgcgcaatggaggagctcgtcgccatgatggcccattgccggaggtgcgagctcgccgcggtcgccgaccgccacgtcgtgtcgcggttctcgcacaaaggcaggatccaggtgaactccccattctctcatgcggctctcttttttttttttaggaaaaaaaaagaaggaaaaaccatatttgcaaaacgcaatggatatttggatcaaattacaagtaatcatggatcaaagtacttgtttgtcgattaaccaagtgggatattgttctgtttcttgatcgagaaatcattattttaagacgagccaagaagttagaagtgtgagttgttgattttgaccccgtagtcccccaaggatggggccatatggctgtttggtagatcatgttcccaactggcactgctgatcattgtcatgtgcaaatcacattatcatgtttcgttttgcaggttcgttaatatgctaggataaaccaaaatgtgataaaaaatgagctaaacttaggacttgattatcgcaaatagtgatatgctaatagccattgttgactggttcaatatgtagtagaacagcaacgaaagctctactagaagatccaagaatattttgggagctctattgctatacacgcaatgtccagtgtagcagagagggtaaatctagtggacgagatgtcacaagtgaataacatctctcgtttgtcttgtttgtttgctggcacgtccggaatctgacgtcctgtggagcttgtggatgctgcagagttgtggctaagaggccacacgaaacatatcacgtgactagacaggttgcttgcttgctatagtgtgcacttgttgcacataaatatgattaatggcagagcagtttgttaattggaagtacaacgcaaatttcaactgtttattaatggcaattgccttttaggttggatttttatgctacggtaccagcattacttgcaacatttttggatattcttcactccaactccagcgaatattaatgtgcatgtttcctaggaaagctgaactttttcctggagaatacattgccggtgtgtagctcaagtatgggctgtgtttggaagcaacaaatttgttttggccacaaatattaagcaagaatctcgattacttgatgcccttttttgcatatccaaggcataaattgtgtttttgttcttttctctgtgaacaagattattccttcctcttgtcaaagattggtaaatacaatagagattcaccttttatatggtacagccatcattgttttggctgctaagtgccaacacacatgcacaaaagtatgtattctctggtttatttcattagattgtatctatgcgaacacaagtactttttaagcttgtttgttccttatgtggcttccgctaatattgtcatgctctttgacaccttgcagtccatgcttcgtcttaggctgttgcgtcagggatttaaagttaaggatgaagtttggactctaccaaaaccagtcaggccacgccttccaaaacatgagcatgaggcctataccacaaggtattaatatgctctttggtaactaaaccatcatcttgtactagtggatgtgaaaatataacattacatgtgttcttttccactactttcatgtctgtcattcctagtccttttcagcttgtagtaagtttagaatattttttccctgaaaagaaacataagttcagaatgttttactacttccctttttt

SEQ ID NO: 90597 - DNA, 4369 bp, Oryza sativa
gcgttcttgctggcagatggccatcgttgccgtcctcaccacacttctctcttacaacaccatactccacggtggtgcgacggcgaagcttgtttagcctaggtgccgttgttggtctaacggcatctctctctctctctctctctctctgctaggagagagacaagggcaagagaagggaaacggagaaaaggggtagagagggaagaagagagaggatgacacgtgggttctactattttttatttttttagaggtttatatgtgagtcccacctttttaaataaaaaatcggactgagcatcacatagacaccacgtcaacatgttaaaacactactagctcaaaactgccattaaaatcgtttagagagatactccctccttttcaggttacaaggcgttttaactttggtcaaagtcaaactgttttaagtttgactaagtttatagaaaaatatagtaatatttataatactaaattaattttatcatcaataattgaatatatattcataataaattgtcttagattaaaaatgttactattttttttctacaaacgatcaaacttaaaacagtttgattttggtcaaagcatcttataacctgaaatggagggagtaaaatagatccgattttaatagttcatggagtatatgttttgaaatttggggatatgcaaattaaacttgccatagttgagggcggcgcaatggacttgtaccaggaatctgagagggtgaattacaaggcctcaaaactttgtccagatcaacttcagacgcaaatgatttaagcataaaacatgactctgtcttacactcttacaccatacaacaccatctcaaaggtagtattaccgaacaaattaaagtggattaagctccaaaacacaagcattttttttctcttgaggaaattaccaagaagccaaaatggaaaaccattgacattactcgcataagcaattgataatagatatcgatcgataatataattcgatatattgacatatatgctaatcagatcaatcaatcagtaggagttgctgttgatggcggagcacttgaggcggacctcgccttcgtcgccggtgagcacctgcgcggcgccgaggcggcgcatggagtcggcgaactggtgcctgatcagctccgggcgcgcgccggcgagctccctgacgaactcccccgtcctcgagtccggcagcagcttctggtccgtctccaggaggcccatgtcgcgcagcaggttcttgtagtagccgttgtcgaactccgtcggcgtgtcggcgtcgaggtagacgtacccgccgtcgccggcggcggcgcacttgcggcggaggaagtcgccgtaccgcgggctcatgctggcgtcgggcctccccgtgccggcgtagtcccacagcctcggcttcacggcggcgcacgtggcgcggccgatggtgtgcgcaccggagagcacggcgaggtccagcacggtgagccccctcgactcgaagaaggcgatgaggtcggtgacgctctcccgccccatgggcacgtactggtcggcgtccaccatgctcgacctcctcccgtccttcctcccgtacatcagcggccagtagtccaccttcacctgcacgcacgaacaccgttagccacgcgcgccgccgccgccgtacgccgccggcgagagtagattactagagtgtgtgagctgagcttgcctcggtgctggcgtgcgggcggcggcggcgaggatgtcggcgcaggagacggtcttggggcacttggcctccagctcggccttgatggactcgatgagctcgaacccgcgcagcgtcttgctcgccttggcgtacctctcgctccccggcgagtccaccagcacggacgcgtcgatcccctgcacgcaatccaatatccatcacatcgcgattagccgccattgccggaatggtggagatgtcatgtcaggctggcacggcgacggcgagctcgttcgtggcgtacgtaccccgacggcgaagtcgtggaagaagaggcggaggagggcgggggcgagggtggagtcggcggcgatggccttcttgacggctcgctggacgatgccctccatgtccgggcacgactggtggtagtagtcggccttcagcccggcggccggccgccggtacgccggctgcacgtagccttgttgtttctggccgtccgccgccaccagcgccgcgaggaggagcgccgccgccgccaccgagacggcgacgccggccaaggagagagacgccggcgtcctcgtcatcttgatcgatcgaaagggaaaacaattctgtgctgccgtgagctgtgcattattcatctgggtttctgcgtgagattatatagttttttgagcttgttttgtgacgaggacgacatggcgagcacgtagcgcagaaaacgagatgaattcgatcgatcgacgacgtgaggagagcaacacaagacgggattgtgattgaaattaattagtacagtagtatactcgctaattaataattgggttgcagtttgcacgtagggggaatctagatggtttaaatagttatttgaattgttaattttggtgtcaagtgtttgtttgcgcaggtaaatatatgcgtgtattggtcaatcgatcgagtcggcgtaaacatatttgtgcttggcatgtcgagggcaaacatgcaagcatgcaaccatcatatgacaacatcaagttatcgacatacatggtcacggtacaagatttttctatttgatcttgcaaatgattggatgatcgactttcaaaaaagaaggaaatgttgagaaatactacttaattcatctgggtcaacaatcaaccaaatgacaatcttttttttggcactaaatttgggttaggtatgagatctcacaaggtttcatcagtcttaaatctgctactaaaaacagcagtgttcatttgttcaaataaacagaaacactgtaacctactctaaactaacatagatatttgaacagaccctcacccacctccaaaacacacacagaaatgaagttgactttacatggtcaacatacagtggaaactttgatcacaacagtgttgtactaatcaggcaacgaattgatgcttcatcgtattttaaccccaaaattatctcgggggaatttctcaaacaaggactccaacttttgtcaggctcactcactctcgattgccacgcgattcgctggtagcaaatcgttccaagtatctgtttgccctcgcaagcaccaatgcatgcaatcatcatgcttcttccaaccagctgttgaaggatgagcatcagctccgaattcacacatcattcgagttatattcagaacactttaatttgaaagtagactttgaaagtagacttttcaagagccctcaccaagacatctgttagaataaatgggctaggcacaatttaattcaattaaaatctcaacagcccacaagtaatgttagagacaataatactgccttggaaatttaggtgaaagaacctcaacttaaatagggtaatattggggatttcctgttgaccggttgaggtgatggttggactgccacacgcatgcgcgcgcgccgagtcggcctcagccgttggcgtagcgaggcgaggcagccgaccgagccgagcctgctgctcttccgttttgtaatagacgagaataaagtcaccattaactaatgaaattcattgtgttgtaaactccataacaaacactacaagaggtatgtggctttttgacattttattatgtcataatatgtgaaatttatgtcaaaaattaagatttatgacaaacagttcataatttcaaacgtcaaaaagccaccgtcataaattcatcatgtgatgtttgtacattcattgtcacaagcatatgacattgctttattgtcacaaaatcttggggcttgccacatggcagctgacatagcagttgacatggttcaaaaaaaacgtcacaaaataagattcggcctgctgaagcccatgtagctcatgggccaaaaatatattttttctagggttgttgctagctggcccaacatattttttgcttgtttgtttgagtgcagcctatataaattttcggcccacaccaattcagcccatatgatttttccaacccgcataattcagcccatatgatttttccagcccccacaatttagcccatataattttttcagcccacaaaactcaactgatattttttcagcccatacaattcagcccagatacaatatttcagcacatacaaaatcaaattcaaatgaattaacattccacaaatgattgcaatgtcacatgcatttcacattccacaagtcttaaaatg

SEQ ID NO: 90598 - DNA, 986 bp, Oryza sativa
cttttcctgttaaataccttgacattccaatgcattttaggaaactgggtaataaggattggaaagttattgaacaaagaattgagaaaaaacttagtagttggaaaggtaaacacatgtctgttggaggtagactggttttgatcaattctgtcctttcaagtttagctatgtttatgatatactttctttgagataccgaaaggggttcttcaaaagattgattattatagatcacgtttcttttggcaaggggatgatcataagaaaatgtataggctagctagatgggatattatttgtcaacccaaagatcaaggtggtttgggggttcataatttagagattcaaaataaatgtcagttgagtaagtggttatataagttaattaataagaatggtgtttggcaagatttattgaagagaaagtatctttataataagtctataacccaagttgataggaaacaaggtgactcccattttttgtcaggactcatgaaagtgaaaaacactttcttaagtatgggttcctggattgtgaataatggggaagaaacaagattttgggaagataaatggctaggtaatatggcctttagagataagtattcatctttatatgctattgtcagaaggaggaatgcttctattgctagtgttatggcctctattccgcttaatgttttctttaggagagctttagttggtcagaatctaacactttggcatgagttgtgtgcttctattgttcatttccagttaaataattcttctgattattttagatgaaattatcatcaaaatggtcagttttcggttaaatcaatgtacttagctttaattaataatggttacattgatagaaataagtttatttggaagctttaagatgttgctaaagattaagttctttatgtggtacttgcttaagggagttgttttaaccaaggataacctagcaagacgaaattggaatggcagct

SEQ ID NO: 90599 - DNA, 845 bp, Oryza sativa
catcaatgcaaaggatgaggcaacggtgcacaaatgctaggatgcaagctgcaaaagagaagaatgctttctgcagaatgcttgcattgccctcatcattcttagctgatgaatagtgctgaaggtcgatacaggtgcctggattcctaaactgaattattgctagcaatttcagcaagttatcataagatgctttgaatgtgccaaaccttgtctctatagccttctgttttgccctatatgcctttgcatagctgatggtgtgcttgtatttttttttcttttatgtgcataatgattgacattggttcaaagtttaggttcttcataacatggccatacacctcagctgctatggatgctgatgtaatattacggtagtacttctccactccttataagtggcacacatgcttcgtaacaatcgagaattgccagcaatccttccatttacccttgtatgcgtgaacctgccatggacagtccacctccgtcacacacctaacctcatacatagttttgcaagacttccctaccctaaactctccctgcaaagaaataacaaaatgtttcaccgcctccttcaaatcctccaatctagcataccgagcaccttgcacgacctcattctccttatactcccatggcatgtgatggccatctgaaataatcaggcaagaaaaatccttgttgcaaaccatgggaatatcctcgtcagacgatgcatctccaacatccttctcgttttccgcatcctctcttttcatcagattcataatactaccaatcctcttgtcacacctcgattttcgttcgggattaaaaatcattaaataatatatttt

SEQ ID NO: 90600 - DNA, 629 bp, Oryza sativa
tgaagtaaatatggattttagcaagtagcacgaacatgttccatcagctttcaggacacactcttgcaacgctctcttacagttgataccacgccttgatttatccctacattgaatatcatacaaatgcttcgtcgtaccatgaggcattgttagatgattccgagccttctttatatcctcatcaatgtactcctttactttgtgggcatatatcaacccattgtctaacatggaaggcccagctgttatcaaccaatccctaaagtacttgcaagtgccatgcaaaatgaactcaacgatgccaataaatgggagcgcacgtgtgtctggcatgacccagttgtatagctctgccaagtttgtagtcattacattgtagcgtgaaccatccttatcgaacaataaagcccacttctcctttggttccttctcaatccactctgaaaatttagaaatttctgatgctttcctcctcttcattcgtggtggaccatttgtaagatgaccaactgcctctggagcatcatcaccttcaggctatggcttcgatctgttctcatctgcttgcttagctgtcaagtcgtccaacctgttccacaactcattaaacttcttctgctggtttt

SEQ ID NO: 90601 - DNA, 1363 bp, Oryza sativa
aattgcagttgcagaatggccaaaaagatcacagcataacaaaatgtcctgtgtggctatgcttgaagttacttttttcagaaatttattctatacaaattgagcatagcattttatgtaacaagcttctctggtgcatcaaagttatggtttccataacaatttgatctcctgacgtccatataccattttctagagtaagacataaactaatgtgaataacataactattgtttgccatgagatgctatgctaagcttcataagtgacataacagtgtactactagatgtaaatatgcaatggtaaaaagtgaaaacactgtaaagtgttgtttcatgcagtaaaataaatatgagttccactaatccacaagctgcattaaccaccgatgtcatttggacaactacagaaatgataacacatgcacacagtcctatctaattagacaagcagttcaaagtttaactatatagtacaagtaaaggtcaacaaattgtgccatcatacatagaagagtagaaacataatacgtcaaatgatgcctagatcagaacaggggaaacaaaaactgaaaacctctaataatacaaatcgagatcaaagtgatcttacaagactaccaaacccaacgtatatgggcttgtcaccagcttcaagccattttataagtggttcaggaggcacataattggaagcaagatcaagaaagcaaaatccaacaacatcaatcttagggccccaatctgcaacagaatagactatgtaattcacagtagaattacagacaattaacaacaaaaattgctcagttaacaccaaaattgagcaggaaacttcaaggttttttccttaacagttaacgcactaatatatccatatcttacaactcatactattgaaaggatatgatagttccttatacacatcagtgattactgaaaaagcataaaatagcttaacaagcattttcctaatgatatattttagaaagaattggatatttgccaccagagtttgcatcagtcatcggtctgccatcggaaatgagcttattgctacagtgccattggtttttcggtggttttgatatatttgctactcctacagcattagaaaacaactaactcctttaggccagcagcctctaaccatcaaaagaaccccggggataggtacatgacccaaaaaaagaatgctctccacacctttcttcatttctcctctctactctctcccatattttttcctctcacatcaatcggctgcactcattgccaaccatgcatggcactccttgtcagctgaggatcccctccatgggtcgtggagctatctccatcagccatctccacctttgaaag

SEQ ID NO: 90602 - DNA, 4067 bp, Oryza sativa
acgggggcaactgttcccctctgcatctggggcgccctcgaggctggccgcgcggaaggggggctgagagcagcccccagtcccgcggggggtccagcagcactctgtcatctcgggggcggaccgtgactttttcttccctgactcccgcgagcatagagccactcctgtaggtgctcgccgccgccgactccatcgtctgggaggggctcaatgcccaagttcaagccctggcggacgagcgggcggccctagaggcggagtgggcgcagctcgcggcggaccgcgcacgggttgacgaggggcgccgcgccgtggacgacatggtggaggtggggcacaaaatgcgccaagcccaaccggcggagatccaggcgcgtgaagagacgctggactcggtcatgcgggagacggaggaggagcggcaggcggcgctcatcgcctcgagcgtcttggatgaggcgctgggcgacatccgtttgcagtacgagacccacgccgaggatctggcgaagagagtcgaagacacccgcggagtcctcgacgctgctgccgcccaagagcggcgggcgtcggaggtcgacgcctcgctgcgggctcagtcggcggcgctcgaggccgagcgcaaggtcttagacgagcgtgcccgctccgcgcaagagttcgaggccacgatccatcgacgaattgaggtccttgaccgtaaccagcgcgagcaggacgagcgcagctggaaacaggcgcagcaagcccgggagcttgaggagcacgctcgggcactggaggagcatacccgggcactagaagagcgggcgcgcatgctagaccagtgcgagaccactttggccgcccacgagagaacggcggccgaggcagagtcctcccttcgcctccgtgaggaggccgcagccgagcgcaaccggaccacccttgccgtagaggcttcggtggcccatcgcgcggaggagctgcggcttcgagaggaggcatgccaggaacgggacgccacgcttgccgtacgcgaggccgaggagaaccgccgtggggtggcggcgcgctggctgggtgagcaactcgcgaagcgcgaggaggccgttaccgggcacgaggcccggcatctagaaagtgcccgcgctgagcgcgaggcaatggcaacgaggtcttccgagctggaggcccaggagaaggagctagaggtaggcgggcaactcgctggcgcggagttggtgagccagctcaccgcggctcaaagcactctcgccgacctggggcgcctggtgcaggaccaagtcggggagatcacagcccttcgcctcaccaacgagattggacctggccaactctccgacgccgtcgaccggctggggcgcgcggggcgccgaataggcatctccgtgcgccaggacaggaaactcccgcccacacagccggcagtcgtgctccggctggatgggatggcggcggatttggagaggctagaggaggaggtcggcgaaaccgtgaagtcgtcgtcagctttggcgcaggctatggtggagctggtcctcgcaagtcatcaagctcgtgacaacgacttcctcccgtggcgcgcgctcgaggacttccccccggggacctaggcgagggctcgggagcaagtctgggaggcggccgacgtaatcgtctccagcttcgacgggtcggcccctcggttcaacctcgcgcttgcttcagacgaggagagcgggagcgaggacggtggtggcgatgatggcggcgaggactgggacgaggtggtcagcggcgccggactcaggggcccgggcactccgtgactatccccgcttttcttctttcatcgtggtgatgtactcgcggtgaacgcttcaaactttatgccatcgtgccatcctgtttgcaaataaagcttaccctcgcacctttacgtttttgcttccgcctttcaatgtctgcggcaaggagagaaggaaaaaccaaagcgaacgtattcaattaactttcttatgattaagttgtcgttcttaccccctttatacccccctcgggctcgttctggtgaaaagggaaactcacgctcggtccgtggtacctaggtggcgaggggcaatgccgtcgccccgagaaagctgcccagcgggtctggccaaaccggggctacgcgaccgggggtcggggatggccgtgtgaaggcccttccgagcccccagggttcgccgcagcccggggcgcggcccgcgtttaggctccctttcggcggttttcaggccgcccaatgccacttagggtccggagtaagcgcgaatcgtcctttaaacccggacaagccataggaaggagtaagaaagggtacacaacggcttccacttgagcagaaaaatttattgctggggaaggaacaagatacaacatatttaacagtggtagccccaggccaagcccgcacaagccgaaggatgtgcgggggttggcccgagcaccatgaaagcgaaagacgcgcgaccctatggatagaaacggcggaggttttcgatattctaggggttaggcaaccccgtgccgtcctcgtggttagtcgaacggagcccggccggggaacgccaacactttttatggcccttcccacattggtgagagcttgctcagtcccaagcgcgactgcacgcgacataggacgaggtcgccgacttgtagtgatcgggccaggacgtggcgctggtggtagcgccgctcgcagggttgcacgccttctgcattcttctaaatagtcgagatcgtcacggcgaagatcatcctggttggcctcatcgtacagcacgacgcgaggcgaacctagggagagctcggaaggtaggactgcttcggcaccatagaccaggaaaaagggcgtttccccggtggggcgacttggagtggtccgattcgcccacagcacggcaggcagttcctccagccatgaatccctgtgcttctttaggacgttgtacgtcttggtcttgaggcctttgaggattttggtgttggctcgctcgacttggccgttgctcttggggtcaccgaaaagctcattggtgaactaggtgccgttatccgtaatgatacggttgggcaccccgaaccgggatgaaatgcccctgatgaacttcagggcggaatgcttgtcgatcttgacgaccgggtaagcctcgggccatttggtgaacttgtcgatggcgacgtacaggtgctaatacccgccttgggccgctttgaagggtcctaggatgtctagccccaagaccgcgaaaggccaagagagcgggatgacctgcaaggcttgggccagctgatgggtttgcttggcgtggaactggcacgccttgcaccgccagacccattctggggcatcttgcaacgcggtcggccagtaaaaaccttgtcggaaggctttaccgaccaatgtgcgtgaggccgaataggccccacactcaccctgatgagcgtcggcgatgagctcaacaccttgctcccgagaaatacacttcaagagtatcccgttggcggcacgccggtagagggtcccttctacgagcacgtattgcttagagatacgcgtgagcttctcaggttttgcgcgaccctcaggaagagtattattgtcggatgcccattccggccaccgccctcaatcctgctaggagtccttcgtattccgccatattgttcatggctcggaaatcgagttgaacgacgtactttaggacatccccgcttggcgaagtcagcgtgactccgacccccgcgccctgaaggtggagggagccgtcgaagtgcataacccagtacccggcgcgaatgtcggcgtttgggtctcctccgtctccggggaggaagggaacattagacggaacagggtcgtccaccggggtccactccgcgatgaagtcagctagaacctggtttttgatcgcgtgccgcggtttggagtgcaggtcgaactcagcgagctcaatggcccactttacgacccgaccggtcccctcccggttgtgaaagatttggccgagagggtaagatgtcacgacggaaat

SEQ ID NO: 90603 - DNA, 1273 bp, Oryza sativa
ccttgggttaagcaggttcgtgagggttcacggccttgattaataatactgtgtagctctaggatcgtctttataaaatggctttggggcaactaagtgacttttaaatgccgtttactgcaaaacttaacccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttatgtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtcggggggctgggtcatgagccagccgcgcgcctgacccttgagagccatggggaaataattcgccatgacctggtcgtgccccccccatccccccgccgccacgatgatcatggtatagatctggaggaactcggagtgattgatgttgccatcatacttctccgtgaggttggggcgaaacttcgggggccaccggacattccggagactcgcaacgaaggccctacaaccagtccctccaaggtgaacgtggggggcgggccgcctcgcgaggaggaacgtggcactctagacgaggaggcgccttctcccatgcgggcagcgcggcgctcatcccggcgtcgctcgatgttgattcgagcgtcctgttccccgtagaggccgtcgtgatgtcttcgacttcccgaggcccccggcgacgttggggccgtggatcgcctcgaggccgtggccgaccgatgggccctcctccttgctgacgaggagagggtggtgggggtacgcgatgtaccagcagcggtgggccggccggccgcggccaactgccgctgggcagtggtgactaggttggccacgtcgtctaaccatcgctggacgggggtctctggccctgagttcacggggggatgccgtagaagggcacccgccgcgtgaagcgcgcctcggggcgagccgccgtcgccataagtgaggcggtgtcgcacccgacgcgacgtggcttccccccgcccgtaggcggggagtgggccgagccacccgac

SEQ ID NO: 90604 - DNA, 1660 bp, Oryza sativa
tttttaaacctgcctgcttatttaagggggaggtgagtgcattagatgctctctcacaagttaacggaccaatacacggcaactaatcggcgcttgagtacacgagttgagtccagccgcagaagatccacccgcccgaccaggtttcgtttcgatttttcttttctgggtccttcattctcttctgggcggcaccatgtcgagcggcggcggcgcggcggcggcggtggacccggaggcggcgacggagctggtgcggaagggcgccacgctcctcctcctcgacgtgccccagcgcaccctcctcggcgtcgacacccaggttggtttccctaaaccctaaaccccaccttttctcctcgctaggctaattcttgcgtgctgctgcttttgattcgattcggttcaggtgttctccgtcgggcccaagttcaaggggatcaagatggtgcctccggggccgcatttcctctactactgctcccccaacaggttgcattgcgtcatcccatttctctatttcttagatttatcacaccgtcagtcaacttgtgcagagttgtttagccagcaagtgctgagtgatatgcatgtaaggttgatttttttttaaaaaaattattaaaagaaccttgctagtgtactagtgtagcatcatcaattggatcggatagctcgattctaccttccattttgacaagacaatcttagcgaagcgtaattaactacctagtgcttctttgggtcacaacagtttgtgtactgatcagtgttttcaagtcgtccgattagtcgcgactaatcatgattagttatccttatcgctaccctgacctcgatcatgaactttgaagcgattagtttgaccagaaaacttatcgtccgactaatcacgactagtcatgagagtcgatcaaattagtcgtggatgactagtctgttagggctaaaaatatgtgttggactttacacttcagtggcaggccttttgcccagcccaagaaggcctgtacccctcatctaaccctaaccagccatctagatctagtcacgagagagaggggagaaaagatgaaggacttattgcaactaggacaggtaaatgatttaactttaagaccttatgtcaagtgtgaactgtcaactgtgaaaatctgattatccttagtttgtactatactatactagtatactatggtaattaatacttataaacatctgtacattatcctgcatatccctagcctatagtcaccgactaatctatgactagttgcgactaatcgcgattagtcgactagtcggtgcccttacgactagtcccgactagacgacttgaaatcactggtaccgatcttgattaacatttgtaaaccggtcttgatatatatcagtagcagcacgtttgattacttgatctggagttatggcattcagaaaaccatgttaagatgatgaaaccacttgtgcctgttttacgcattctgttccatttcgcctgcatggtctgtgtctttcagttatggccaaaacaacttacatgagaagccacatattgattattcttccacaatctgtgatcctttcaggcacgcaaatgagttcgcacctactgtcggattctttcttactactcacccatctgaggtactctttcatg

SEQ ID NO: 90605 - DNA, 606 bp, Oryza sativa
cacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattagctgccattcgataaggtctcttatggatcggagttgttccaggtaccaaatctattctgaactctatatcccttttaggcggcataccaggtaaatcatctgggaacacatcagaatactcccggactataggaatctcttccaaagttatctggttcagtctctgaccttaaagactcagatgaca

SEQ ID NO: 90606 - DNA, 2276 bp, Oryza sativa
ggcgacggcagctcggtggcgcgaaacgagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactgtaattagctcaaataaatcccagaaaaatctaggaattatagaattaagcaaagtatttaatgaaattttatctggcccaattttatattggaatttattaattaaaattagattttcttttcaagactgattaaattatttctaaaaattccatttaaacaacaatttatataattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccacgggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcctttggtatgaaaacgatgaactcctcgaagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctaaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcaactattacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcgtgagcttctttcagaattgcatcctttaaatctttgttgtcggggacacagattctctcacccaaccataccgttccgtgctcatcctccaagaaaccaatagcttttcctcttctcatattcttcttgatctcttgaatatcaggatcattattttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagtt

SEQ ID NO: 90607 - DNA, 712 bp, Oryza sativa
ttacagaagcacggtagcttcttcatcaaaatgtgtcctgagcagtttaatcaacctattacatgtctcacttcaaaaaagaaatggaacctctagccatctgggtacaagcgaagctctatttttgcagaatgcagatgcaagcagccaccaaaaaaatgctcaatgacactattttgtgcactctgatttttctgttttgatagaaattagttagcatgtttaaataaagagtagcactattgagtaggcagtacaccatcgatgaagcaaaacatgtacattctatccatcaatttgtgaagatgcagtaaaagtgctgcttaatattaacagaaagttgagataaattagtacttacagcttcactacagctcaaaagaagactaactaatgctttccattgcataaaagcctccagtgactgccccatctaaataactcaaaaatgttaagagaattatgatttattgaatgtctttaaagaagttggtttttttcagtagtaccataaatgctatgaaagcaaactgcagctctcccaagagtaaatcctcttggccttggtaattcttggccaaaacactctccagcaagcatgtctgagaagtataatagcttcatcagcaaataataatacaatttttcgatttggtgcatttacatgaggcatgtgtgaaaggaatcaattcaagcaatccaccattagtag

SEQ ID NO: 90608 - DNA, 682 bp, Oryza sativa
cgtgtaatttacctccatcctgacaactccaaacattgtggcagtggcagagccaaaagattttgtatatctacttgataactgcccccatgactggctcttcctgcagtgtaaagcagtggtaaacattttgcttgtcattcttggcatgaagtagatatctttaagtttaactttcagagattactagttattacttcttaatagtttttagtactccctccgtttcataatgtaagtcattctagcatttctcacattcatattgatgccaatgaatctagacatatgtatctatctagattcattagtatcaatatgaatgtgggaaatactagaatgacttacattgtgaaacggaggaagtactgattagtgaaattataaaccaaaatttaaattttcagttattgattatgagtagctttcatggcgtaagtacctgttacggactaaaacggtacttagaaatttatctaatttgattgaaagaacttatgatgttaagtttgcatgtgcgttcagggagaggctagctcactctttgttttttttacttctgtaggtacatcatggcggtgctggaacaacagctgctggcctcaaagcagcggtattccctctctcccttcttagcccttctccctcctttctctctctcaaaagaaaaacctggcttaac

SEQ ID NO: 90609 - DNA, 547 bp, Oryza sativa
cacaagcggccgcatagaacctaccgaccccctcgtacagaaaaacgatttttgtagtagtggttgccgccgcaggtgcagaagaagccaccgccggatgccgccatcttcgaggggatgccgacgcgagtcgcggtggcgagacgcaggcgacccttacgcgtgcgtgggcgcggcgggagaacggcggaggccggtgcgtcgtggccggcagagagggcgtggagcgcagcgatggatagtgcggtggcggggccgaggatggcgaggacacggccgttctcgtggctcgttttcttccttccgacggccaaccttccacggcggtctcgatctccgccgccgccgccgccgctccggccctcacccgcacgcctccgtcaccgctccagtgccgctcctgggtctccgtcgccattggcccccgtcccacactcgcggagagaaagagaggggaggatatgatttatatgagccccacgtgtcagtgggacccacccatacttttggtgaatgattaatgggtcccacatattttttatttcta

SEQ ID NO: 90610 - DNA, 1284 bp, Oryza sativa
aacttcgttgtacccaggttgcgagcaggggcacaaaagttggatgccactctagagttgttgcaatggaaggcaaaaaatggggttagtgacaaggcatttggcgatttattgaaactcgtcaagaacattcttccgggggaaacaaattgcccgagacaacgtacgaggctaagaagatagtctgcccgttaggattggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggagaagtttaacctacgagcgctgctgttcgtaaccatcaacgattggcctgcacttagcaacctatccggacagtccaacaaggggtacaaggcttgcactcactgtatggatgaaacaaaaagtacgtatcttaagcactgtaggaaagttgtatacatgggtcatcgtcgattccttgcagcaaaccacccggtacggaagaaaggcaagcacttcgaacgtaaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttg

SEQ ID NO: 90611 - DNA, 1414 bp, Oryza sativa
acggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaagacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaattatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagtaatttcgaaatagcgggaaaagatatttactcccgg

SEQ ID NO: 90612 - DNA, 3171 bp, Oryza sativa
ttttagggtcgttttgggacgcgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgtgacacatggaacacatcgtgcccgttgcccaaggaggcgggcagctccaactggtaagcgacttcttcgcgccgagcaatgatacggaaaggacccacgaaccgaggtgcgagcttcccttttgtctgaaacctgtgcacactcgcaatggcgtgacccgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaatagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcatgagcttcctgaagtatcagctgtttatgttctctgacatccggaacgcatacccgatttccgttccatagggttccatgttcatcctctgtgaaacccgcagctttaccctgttccatattttgaggagtccacgcatgtccgggtcgttcttatgagcctcgcggatttgatcgagcaaggtgggcttggcttccaacgcagccaagaatccacgactcactacgctcagattcagggcttccatctgttggttaagttcgggtggaaagccacggacgttaagagtgttgcaatggctctttcgacttagagcgtcagcgaccacgttggccttaccaggatgatagtgaattcccacatcgtaatccttgatgagttctaaccatctcctttgccgaagattcaggtccgactgagtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgggaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgactgtcttgggttgcttccaatcagtgacggcggtcactgttttggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagtaatgtcatcaatgaaaaccacaacaaacttatccaagtattccatgaacactttgtgtcattaagttcatgaagaaggcaggagcattggttaacaccgaatgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgttttttatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtatagaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggctgttctggccctgggtacagagtgacagtgcgtctcgcgcaatccactactccttggaattgagccaaccaatttatcccaaggatcacatccaagctcttggtgtctagcagaatcagatccgagggaaaaggaatccc

SEQ ID NO: 90613 - DNA, 878 bp, Oryza sativa
gtctggagttgtcagcacgtttctcggcgtgtcacgtggttcacacgaccccgtaatgacatccttaccaccgttgttggagcggggaggcgcttggccttgctgacgcctcagctttgggcatttatccgcaaagtgcccgggctcgaagcagttgaagcacagacgctgcggaccttgagcgtccctgcggctttgaccaggctgcacagttggcataggaggacggggcgcacgagtcccttgttgactctgctgctgctgcggctgtgggacgcgcaccacgaattgaggtcgaggcgcggagcgtggttgctgctgctgttgttcctgctgcgaggaggatccccctggatagggattggtgtagcggaccctttggttagcaccctgttggttgcggaaattcgccaagcggcgcttgtgtgactccagttccttgtgcttgtcttccaagcggatgctcttgtccaccagacgttggaaatccggatagtccccggagactagacggacggacagctcaggatccattcccgccaagaacttctcctgcttttcctcatcttcccgtacatcctccggggcgtaccgggccaggttgttgaactcatgcaaatactccatcacagagcggttgccttgcttcaactctcggaattcccttttcttaagggccacgactccggcgggcacatgggttctccggaaagcagcggtgaagcgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaacc

SEQ ID NO: 90614 - DNA, 1708 bp, Oryza sativa
acacacttaggtaaaagaataatagtaccaaagttaagcgagaataaatgtaaagtaccattatgaaactccttaaaaaggtttattaaatcaaattttataacatcttagaaaacttgataaaattcagcaggaaacccatcaagacctggtgctttgttatgttccatctggaaaatagcctccttaatctcctcttcagtaaattccttgtgttagagcctcattctccaaaagagaaacttgaggaatgtcagtaaatttactctcatcaaactgaagaggagaatcatctggaggaccaaaaagacccttataataagtggtaatatgcgatttcaaattttcatcaccatttattaattggtcaccatcttgtagttcaaaaattctagttttcctatgttttccatttgcaaccaagtgaaaatactttgtattagaatcaccctctagaatatccttagatttggccctcagataccatttgatttcctcctctctcataattgaagataatctattcctataaaaccatctaatatccaattcctcctgactcaaaagaatatcctctttgtctcccatgtttcttttgatttctggaagtgcgtcattgcatgtacaagggcaaagtttcatgggtactggctccatcagtccgccgctgcttccactcaaaagctctgttgggcgacacgggcagcgaccgccgcttgcacctctaccccccacctctctccctcccgcctcaccgccgccggagccagacaccgaaaacgtacggcagcatgaatggcggcggcgagggcattaacgctctcctgcgcgggatctaggagctagcggttgctaagaggacaacggtgacgattgccactgctggcagcgtcgggcagtcgcggagaagttcaaagccaccggcgagagctcagaagcgcagtgggaggatccggcgaggaggaaaggcaacggcaggcggatccggtgaagagggcgatggggcggtggctcgcacgtcgtcagcagcctggcgctgccggcggcatagggttgtccaaggggagacatcttcgaccctcgtgactgcctacgcgcaacccctctttgccgccggtgaagctggacctgttcattcgcctccttggccgatttgtctagatccacttactccttggccagatctactcggttggggctgggaggtcggtggcagcggcgccctgacctgcccatgggggcggtgtgtgatggtgtcttcaagccgctagcgtccgtgccgccgccgcgtgagctatctgactagtgtcctggctggctttaccccctgctctgggttgaaaaccccttttggtttccacagcgtacgatggcgtcttctttcttgttgtcgtccttcttcttgaaggcatcatatttggaaatcccctgccataaccctcgggtggcttcttctcctcgtcattgttgtgccctctacctgtttgtcccctggcatccatcgtgtcctgcctacacctatcctcgacgcctttggtccaccttgccttgtcttttcatctaaccagtgttagtgttcctcctagtttccttggtttgagtcattttggttgttgtttcttgccttgcttcgaccaccttcaccttgatccaccataaaccacgagtatgcagtttcccctttcctcctcagatttcttccattttg

SEQ ID NO: 90615 - DNA, 5530 bp, Oryza sativa
cgtcgatgaggccagcatgggcgaagagaatggccgacctgctacgaccggacggagagctcatcaccctcatgtatttggtaattaatcgacggtatcaacatgtctaaagataataataatatcagccccgataagaactaaccaaaattaacctgattttctaaatttgttccttcattacatatttacatatgcatgcaggctgaaggacaagaggccgggccaccattcaatacaacagtgctcgagtaagatcatgcatattgatctttgtacaaatgaaaaatgaaaaaaaaatagatgtcacttgatcatcagaaaaataaatccgctttcccatatagttatatgttccacagacacgtaactgttctccagtatatagaaatctgatcacaagtctgctataccatgcatcatgcagttacaaggaggtgctgaacccgttgggtttagtcattacttctatcgaggacaatgaagtcgcagttgaaccacgaaaggtgattagttaacaaagaacatgaattattacatatcaccatattgcattaacattatttgcttattaaaaaaacatttcggttctactttactcaactcatggcctataacatctgctgtatgtatggagtagtagttactactccctctgttttagattataagacattttgactttagtcaaaatcaaattgttttaagtttgactaagtttatagacaaatatagtaatatttataatactaaattagttttatcaaatcaacaattgaatatacttttataataaatttgtcttgggttgaaaatgttactactttttttataaaattggtcaaactttaaacactttgactttgactaaagtcaaaacgtcttataacctgaaacggagggagtagttagctagctatgtaccacagtaaacccaatctgatgatactttaacctcgattaatttccaggggatggagaaaatcgcaaggtggaagaggatgacaaaatccgactaataagatagtggaggacgcgcgcactccttgttcgcagcataatatgtctacgtcacccgcacatgtctctaataaaaagaaggaaagaaggaaaaatgaatttaatgggcctgattcgagcttgtgcatccgtgtaaatacataatatagtgtaattattctatacatctctatgcaaaatgtatggcgtggcttaattgttacagtaaattaattacttttgtcttctattactactctcgaatagatctctttccctgtgaattacaccattatttagctcactcctctttctaaatctgtttctcaaaaaagaaacttcttttccctttcaactgattggattttttaaaaactgaattggtcgtcaattatgtggcactcttatggagtaaatatttgccttccaataaataggagtatgagtatactgtttccaaaaaagaatagtataagtatgttccgtatgctattgaactgcgttatagatctgtcatcttctttgacaatacattgatgaatttagacacaaatgcatagagaatggagcaaactgccatcagaagcaggtaaggattgccatacaggcgcaacaagttgatctcacagccacaaggccacaacaaacggtgtttcagtctgcttccaacaagcaatgcacatttttcctaggtcggtttccttgatttaaacaaagggctattcacacatgtaatctacatcaccattggggatgtccttgggaagtagccatgttaaaaagccctcattggtgtctcctcttagcctctgggatgaatactccacaagcatgtcccacaactcgccaaccgtccacctatggcgcaatatccactgggtcacctgtcgcagtatgatggggcgaaaaaaaaagagaggtatgaacataagaacaccagaggcttagcaaagaattgctgtatggattaacataaattggaagatcatgtctccaggttgaacatcacagtaattgtttttattgtgcaaattattttattaaactttctaaatgtgcaccagaccacatcaatgactgattcaaggagacactctattggaggatctacaccccttaaccccaaaggatatagggtttttaagttttaccactaaggccttgtcaagagagagggattacaggagattgaggggaaataattcaaaaccacgataggtgtcgaataaatcccctctaattccccttcaatcctcttgggaaaggggttgaatgaacaaggcccaagagaattttcatctcgttttgtcactaagctgaacatccctctcactttttccactcaattgaactagccccagtggctgaaacaaaatagacggcaaatctgagatatcataatttcctagtggcaaaagcaaaagtatccaaaggctagaaatcatagaatacattcacagagccatggacagcacaagacatggagcttacaattattcttaagattttactgctaaaatgaaacaagtactttcgtacagcaaacataaaatgtaggaagggtcgaatagacatgcattacctcttctaatcttttcagtgattcggactcaaaagtgtagtagttaataaaagatcggagtgcctgaaaagcaagaacatacatgaacactccaatgatgtaattacatgaaataatcggtaaaaatttaaattatcgaacattttcgctgtacctgtgatgcagcaatccattgaatcatgctcttgatttcagggtttccaccaaaagccccgcaaccccagtttccagttgaaactcctatgcattcatcaggaatgacacttggacagttatcctttgtatttaaatcctgaaccatgtgaagaaagttaagacataactagaacagactgcttaagtacttctgatgccatgatatgcattaagttactgcatcaatctgaacataatactgagcatattatgtcaggtcttatttaagatcatataatcaggcaacagagtgtggatttgtttgaatcgcccttaattacttcaatggtttacagacagaacaatgtgatagggacaagcagattccgataagtcaatttaacttaagcagagaatgcaacgttgactaatagaccatgatgcttgtcacttgtcagtgcttgaattaaaaagtgagttttgttaacagcaaactcctgaggtatcattgctcaaatacctggacaagctttgcacagagctgatgatttgattgatccaaaaatccacaaaaagccttgttcacttccctgcgtacagatttaccataaataaaaatagtagaagaatgctaaaaatatatagtatttttcttagagaggctgtgaatagttgaaatgacaggtagctagtaaaatatgaaagttatacagatttaagtgaaactgagtgaaacaagaacaaggcataccttagaagaccactagattcaaactgtaacctagttggacagtccaaagcatcaattgccactatcctagttttccgtctacccatcgcatcaaagggtttgctatctaagtagtcaccagtaaaacggaatgaggaaccatacctgtaaaaagcaagttaagagtttataccacgtaaaaatcatcacaagttgtaaagaaaagcatccataaatcacgccggttgataattgatatatgctgtggagtttatttcaaccaatgatctagatcaagaaatggtggataagtgtttaaaactaaccccatgtactgtgagaacctttctgcaccaacaatttctatagcttcattatcttccattgaaaccatgaagagcatgcccacgatcaattctgggtttatcatgaaccggatttcttccttcagcacagaaaatacatcattcataagggaatctcgaaaacatttatatgaatgtcattttttatacaaaactgagggcacttcaattcacatcatacacccatgcaattaaaaatcagttatgaagcgtcgtgactaatttcccaagtacacataatatgacagataagctacataaaagaatgcagcaatgtgctgtacaactgaatgatttgggaataaacaccacataactaatgcaaggcaagctccagatggaggcacttttacagagttgaagatcaagggagtaagatctgcaaaagaaagaaacctgcacgcagcctctggaaagtgcgccacctcccaaatatctatttgcaaagtcaacttcaagggcttcttgttcctcatcttctatcaagcctgaggaaaatacctactaatgaaaataaacaaaacaatcagcaggtttcatcacaccagttaaaacatttgagatgtttgaataatcataaaggcaaaggaacgcccaatttttatcttgataatcatagttttatatgatataaaggattgttgatgggttaactaatttaccatctcttcacaagatttacttcttatgtaacaaaagaaagaagtcagtaaaagggactctaaattttgaaacgcacccggaatgtgcaaaggggaacaccagatttcatccaagtatccatgtcagggtacgtaatgccatcagattcaggacggcgaggaagaaccttacgctcaaacgaaacggaaccagtaggtgtagaagcggtcaccctgtcaaaatagtgaacaaggcacctcaccttctgctcctggctttgcctcgaattataacacagtgccctatggatcaatcagtaaaccacaaaagcataaccaataagctcgaaaagttcaatcatttagcccaaatgtaccaactctaagaaaactagatcaaaatggcagtggaattacgcaaataggctatcgaaattgatcgccgggaggcacgcctcggccctatcggcggtggggaacaggcagaagagcgcgcaggcgagcagcgcggcggcgagctcctggctgaggagcacgagcccggcatcctgcgagctcaggatgcggagcccgcgagcctcgtcgccggcggcgcggtagtggccctcgagcagcgtggggaggcggaggaggaggcgggcgagggagggggcgacgtggtcgaaccagtcccgcgcctgcgcccgcgacaggaggtcgtcgaagaagagcgcgaagccctcggcggcgcggcgcgggagtgggtcgaggttgagcgcgaggcggaggtcggtgagggcgtcggcgaggacgtcgccggaggagacgcggctcacgtcggggcccagcgccagcgccttgagcgcctcctgcgccgccggcggccagaagagcgcgccgccgcggagcacgacggggaggtagggcaggatcgagcgcaggtcgccgcgcgcctccattgctgctcctcctcgagctcgaccttgcaatttgcatgaaccccccggaaatcgaaaatattttcgaatcagtctcgcttggatctaaatgcaattttcgtcacagcttatccgttccctcttcgccatgggacgcaatg

SEQ ID NO: 90616 - DNA, 10121 bp, Oryza sativa
cttcgctcatctcggcattctgccggacggcgagtttgagctagcggcggaggctttgatccagatgttgaagcagggattgaagccaaatgagcacacaatgacaaccattttgacggcatgcccaagggttctcggtcagcagatacatgggtatttgatcaagaaaattggtttgcggtcgcagagcgtctactcgtcgactgcactgatcgatttctattcgagaaacggtgagttcaaactggcaaaggcggtttttgacagtctccactgcaagaacgtggtttcatggtgctccatgatgcagctatacatcagagatggaaggctggaagaggcattgcaagtgttcggtgatatgatttcagagggtgttgatcctaacgagtttgcactatcaattgttcttggagcttgtggatccattggtctggggcgtcaactgcactgctcagcaatcaagcacgatttaatcacagatatccgggtgtcgaatgctctactgtcaatgtatggtagaactggtcttgtcgaagaactggaggccatgctcaacaagattgaaaatcctgatcttgttagctggaccactgctatttctgcaaacttccaaaatggttttggtgagaaggccatagcattgctttgtcagatgcattcagaaggattcacaccaaatggctacgccttctccagtgtgctgagttcttgcgcagacgtggcatctctggatcaaggaatgcagttccattgcctggctctgaaactgggatgtgactccgaaatctgcaccggaaacgcactgatcaacatgtactccaagtgtggtcagatgggctctgcaaggcttgcatttgatgtcatgcatactcatgatgttacatcttggaactcgctgattcatggccacgcacagcacggtgatgcaaacaaggcactggaggtattcagcaagatgcgttccaatggcatcaagccagatgattcgacatttttgggagtcttaatgggttgcaatcactctggtatggtagaggaaggagagctgttcttcagactgatgatcgatcagtacagcttcacgccagcaccttctcactacgcttgcatgatcgacatgctgggccgaaacggcagattcgacgaggcactgcgcatgatcaatgacatgcccttcgagcctgatgccctgatatggaagacgctgctggcatcttgcaagctgcacaggaatctggacatagggaagcttgctgcagacaggctgatggagctttcagacagagactccgcgagctacgtgctgatgtcgaacatctacgccatgcacggagaatgggaggacgccaggaaggtgaggaggaggatggacgagaccggcgtcaagaaggacgccggctgcagctggattgagatcaacaacgaggtgcatacgtttgcttcaagagacatgtctcacccgaactctgattccatatatcagatgctaggagagcttgttgccgtgatgcaagattttgacgaacttgaaccgtttgatgtacatatatgctgatttagatgccactccagatagtatcaaagaaagtaaagtttctttcttttcggatcaagaaagttttatgtgctgtgtttgctaaataaaagatgtataccaattttatttaggtaaggggagggcgtatgatcaaattgcccttgtgtatatatcaaagcccaaaggtttcctcttttggcaggcggcaccactcctcctcatcttcctccattaatagcggcggcggcaggaggacgcacgttgccgcggtgccgccttcacttcttccccaacaccaacagatcgagaatcatggttttccaatgttgctttactgccatgggaaagatgcggaaatctaagaggacggctgatataatctcacaagaagctccaagaacgaaggagagataagcagtactaagtcattgatctcaggtccgctggttttcctattttctgcatatcttcttgtaccgtataaccctatttgagtactaacacttgtgttgtatgtatatatggcgttttaaccaggcgacttaaattcgggctctaatcaagatgtctgggctattctcagtgttgaagttgcatcaaatttgtctaaaagcgttgtctcactcaccttgtctgatggtaattatatgttttgctattgttatacattgtcaaatttatatttgaacaatgtcccctgttataaatggtttaacctgcgatcttgtgtaggaaacacactgatatatgcatgctcgggcatagctatcgagtgccaggaggggtctggtacaattttcctgacctcggctagtttggtaacagctttctatgatactgaagaagtctatgataacttaaaggtggtgcttgttgtcatcctttactaatttttgcttgtttgcttaggatattttgtgactcctttcttgctttgccattatagattgaagtgcgccatgaaggcaatgaagtgctcaagggttatttggcaaaatatgatttagacaagaactttgctgttgtctacaccatggaatctcttgatgttcatattgtacttaccgaaaattcgagggataggtatatcaacaaaaagttagtagctgtagggcgtgacaaacatggcgtattaatggccaaaagtgtgatggtggctggttgtcgtgattcaaacagatctgaagatagcaaagaaattaggttgatctctgaggtaaactcgcataatgatacaagcacatcttaacctttttctgtactatatctatatgcactaaactttattatcaggcctgtaaaagtggaattttttttctatgtgaatgttgttcaatatcacttcctttgttcaaatggagtccttgttgaccatcactttatatttgtgttaggactgggaaggtggaccgctttttgattttgatgggaaatttgttggcatgaatcgtttttcggttatggatagaacatctgtcctgtcatgggtctcaattctcattattttgaagcattatttgccatccctgcaaaacaggattcttaaacggttacaaaatgtcaaaagagtcaggtatgtctttgcttatgtttgatcctcattggttcacccactttattaccctgcatgtgttcatacggtaggctggtttgcatgtcaaacaacatatgagcgaatttgttcttcaatgatctggattgttagctgctgttcctttttataggtcctcaaaacttcagatcctcttttttatctttttcctttttctccttgcctatgatgctaccctgtaggtgttggcattgtgttatgcactggtatgacccgttttacctttgggttggtgttcttctgcagggatggagagagacccacaggtgagctacctgactatcatcaagaaggtgagcacagtgccatagtgccataccttggcaccaccaaacatgcatgcaaattttggttgtatgtaatggtatctatttttaatattagcttttacatttgaactttctaattttacatgaacttatcgcatttagttagtgtatctcagcgctaatcacttggccttgtgcagcaccagtacatagatgtggtctcaacacagaacagtttgggtatctaaactccatgggttatcccaagccgccaataaatgtgttagacggtgagtcattgtttgtaaatttgctaacttatcgcgcatcacatctttctacagtttactactacgaattaatgactattctaccatgtatcttctaccagatggtatgattttggctaattcttttgaagagacttttggagatttatgtggtgaagatctttggagtgaaatcaataaaaaggttccttgtgacatacatcaaaatgttgttgcacttgcttcattcaaaggtgattttacactaattaatgtgctatattgattttcccatttcatatttgtattcggttgtcactaataaataataatcaaatgtatgcatgataatgcatggtatgcaggaaaaaggaggtcttttgcatgcacggtttctttattgaatggaagggatgtacaactattctgacatctgcgagcttggttagagagtctgatgatggaaacaagattgatgaaaacttgagggtgggtgctaatcatgtagctcctcctaattattttgctctttatttttaagtctcactcacttattcatcaatttatttgcagattgaagtgttgcttccaaacaaacaacttagagaaggaacactacagcattatagtttacactacaatgttgctctagtgagtgttaaggacaaggatttccatgctcgtccagcaaatattcagcttgatcataatcatggacctggagtagcagccgtagggcgttgcttcgaatcaggcaaattaatggctgcacggacggatgttgttgattggtcgggcacacttgattgtgagatgttccttatacgttcctcatgcaaaatcactaaggtacataccgctagatagctgttgattttaaatctctagcatgtttttacatgcacggtgaaaatttataaccatcgcgttggtttgtaggcagggattggaggacctcttgttgacttagaagggaaagttattggcatgaacttctatgataagaagataggaaccccttgcctgccatggaatgtgattctcatggttctggcatgttttgagaaagaaaagtattcgtagatttcttttctttttttttggttatttaagtgcttgcaataaaatctattcgattgtgtgtttgacagtagcggtggtgaagttggcagtggtagtgatccatgtggtgcgcctggctggaaaatccctcgagatgagagtgtcaggctaaacaggttggttttctgataaatctcaacagttaacacttaacactaccaatttacagggtctcatattattttctgatcgcattgcatatattggaactaaactaataggtggcctgtgcccctgccatattggcgtcctcatgacgatgtggatgaacaagaacccccagaaggctgtgagcacatctacacatacataaatggtgaaagatattgttacaggtagaatctgcttcttctactctgtctgttggatctactacgacgccgtttgctagcggagcttgctgccgtgattcaagattttgatgagcttgaactgtttgatgtacatatgcagatttagacgccagatgtaatatatattactaaagaaagtttattcgaatcaagagatctttgtgttgtgtgtttgcttctgcagaatttcctggtatttcgggattcctaattggatgtggaaaacgatcaggaaccctaattcttgccggcccatggtcatggagcctgaatctgaaacgcataagatgtggatgcgttatatgtggagttaatttagtaccacaacgccaaatcaggcgggaggttggacgtccgggggtataaaggaagaggcaagggtacctctgctgcatacttacctggacggggtcgatgggtgatcaataaggcccatggcctgggctaatggcccacattgcacttggtggatgcgttggcctaccatctccccaagtgggagagtggacgtcataatttgtggtagagggggtacgcgttcgcgcggccccttccaaatttatacaaaattttgattggcttcattttgaatcaatcccctaccaaatttatctaaaattttgattggcttcattttgaatcgaaactacttctgcttttcttggctgaattttgaatcgtttaagactaaagcttgtgctctgaaaatacttaatgggatcataggactttgcataatctggagaccggaatgcacccaactgaggataggatgtaccgtacaatgcatccagccataataaaattgcaatcttggaactcgaaagttcccagtttcagtttgaggataggatatatcatcaaagattgtcgcagccacatatgaaattcagaacatgttgcatctattgaaagttcaaacgatgtctggagtatttgacacctctgaagtgaagctgtggaaaagagaggaagcagtattcttgcacctacagaccaatgtacagcacaaatctcaaaccgcaaacctaaggtagcaacaaaaggcaaagagaaatccatgtgatctgcatccaacagagaaccccacaaaagaaacttcttaaaccaattgcaattacacacagaatgcgctgattacgaactggcatgtgccgggaggtctaccatgagctaacatcttaattctcagttgctggcgccggctctgaggcagctggcactgctggtttttgttgaagcagaggagagagcgccttgacaacaatgctcatgttgggcctgaactctgcttcgtattggacacaaagagctgccaccgcagcaagctgcagataagtgcaaccaagtacatcaacatgacattatttcaggactgctactccaaatgatgtaaaaagcatgtgcatcatagtgtgtgtatgtgtgggtgggtgtgagagagagagagagacgagagactgaccttagcaactccctttggaggatattcactctttaacctaggatctacacattgtttgaccttgtcttcgcttaatctaggagtagcctggagagaaaaagtacacaaacaagttaaatttggaacaactaccttttcttaaatttggaacaactaccttttctatctcactacgggagtagtctggctaattagatggaatcagaaaaggtgtaatatgtatttgagaaaaaaaaaggaaaaatgtaaactatttgagaaatcaaggttctctatagcaatccagatacaggttgttttttattcaaataatcaaatccaaagcgacctataaacctaactaattattatttagaaatcatttaagtctaggattgtcagtgtccagttagcagacagttattgctacgatttgcagtgctgattcattgaaccttcaataagttgatggactctgctagacgttcatagcggtatttcagcatgcttttgttggctagattcttttgtttcatgttcctcaatgatgtcttctcttgccactaattactttcttggtctttacatataaccagtagaaatgaagaaaattattataattgaccaaaaaaattagcaaccaaagcaaaaacaagataagaaaactagtaacatgtccgtgcgttgcaacagacgaatacaactgagaatgggttgcatgggcccatacgactgggaatgggctggatcgagcataaggcgcatacaactggtatttttctgttattttcaggcctagaaggcagtgcttgtgtgctttgtgacgcgtgggaaggagcgtatggacgactccgcttttaggtggtagagacaacttacccaagtgactagactttgctgtccccgaggcattgtgtggtccactggtttccttccagtcaggagttccaaaagaactacaccaaaactgtacacatcactcttctgcgtcagctggccagtcatagcatatctgcggcaagtagggttatataagttaagagaggaaatgcataaaaatacacggcatcaagtatttccacaactcatgccaagaacacttatcctcatttcgctgaaacgttcatctacctggacaaactagcaaacaaaagacttgtttctaaagaaattacaattaacttacacaagacggtgaaaagatcaaataacaacaaaacagataaaacacaaaattagtgtacagatttttcctttgtaggcagaggaaagtaaaggcattatgtttgctccagatataatagctttgcaggtagaagaaatatcgcaacaaacaaatataatatcataataatgctcaagaggtcagtcgtaaaaggttcctgcttaattcagcctaggtaatccaacatgatgttataaatcacttagatgcatcacactcattatgcaaattagcaatgttctgcataactttccagaatgaatgctgcatgcagatagtggttcacagaatatggagtataacatgtcagttgacttcccccaaaaagaaattaaggcactgcccaaatactggttgtgttgacagacctctctccaaaatggcatattcacacccaaaataagttggctttcccaaaaaaaaaatataaggcactatccaaagatagtggttgtgttgacagaccttaaatggcataatcacacccaaaataagtaaagttgttttttggcaacacctacatggtaccattgtcagctgtttttcaaacaaaaaaaaaaggttatgtaagaacagctacatgcataaatttcactacaacccaaaggcattcaatacttggttctacgtactatttgatgtttcctgccaaaccgattaactagatcagtttgctattctgctaacagaaaaatagcatacatagcttaaggcccaaataagtactacaatgtacaagacaactcaatatcaatgtataacaggatatcatactatcaaaatggaagtgtaatggccaagaaaaaaaaatagtcattgcttgattaaaacagtaaggtcagaattacttgtcatctcttggatacatagcgaacattaatttacttgccaaatgtgtaaaaaaaaactgttgcaattataaaaaccagacagatcttccacctcgtcaaggcccaggatcaccaagtcggccttagtttctaaaaagttatactatgaatttctatattcactagcctcagcagtttttcatgcaatcttgtgaaaaaagaagtcatcagtttggatcagggagttctttttcaaaagaaaaaaaaaaataccacaaccactcacactgtttggtccattgtcatttaggtcagtaagtctcacagtattgtgccatggcctccacatttgaggcttcatgcatgtggccctggtcggcagggctgccagccagccactgcctctggtgttactttggaggcactgagagtacacagttctgatcttaggagcacataagatagctctggtgatgtctattcgatatgaacctgaaggtatgtgcacccttgcccatgaatacaaccatacaagcacagcaaaaatatgaaagcaaactagacgaggataacctacgaatttgttcatccaaaaaaaacatatcagacctttgacatttcaaggcaacaatccttaaagatgggacctaccacattgacaagaatagacaccacagtgactctctcagtttttcaatacactatgtcagtattaacatattttagttggttcaaaacatatattttaactactgttgggctggattaaaaattgaagtaagacgcgatatagtgagttctatgaagaaatgcattggtataaattagacattactctggtgcatgatatccaaaggttcctaatacacgagttgaatgaaggcgtgctgccatatctggagcttgatttaagagattgaaatctgcaatttttgccttgaagtcctcaaacagaagtacattgcttgatctgatgtcccgatgaatgattgaaggctgaaccttctcatgcaggtactctaagccttttgctgcctctatagcaatttttaccctctgcgtccaatcaagtacaggaccaggctgcgcaccttgaactccttttcttcctgttgtgttaagagaagttgattataactgacctggatttgcattccacatgctaaagatagtaggtgctcaaggtcttaccatggagaacatcatgaagggaacccatggtcgcaaattcgtatgccagtatacgataattgccctctacacagtaacccaacatctccacaagattttcatgctttagccttgatgcctgggagacctagagtccacaaaaacataaacaaaagtaatagctttagaattgttgcactgtcatcaagtcctgagacagacaaatagacaatgtgaaatttaagctaagaaacctatgattctgcaagtgatcacctgtttcaaga

SEQ ID NO: 90617 - DNA, 1843 bp, Oryza sativa
ctccagcggaagtcaagcaattgcacgagctctacaggcaagtagtcaccagatatacgctgctgtctaaagctttaagaaagttatcggtagatgaggatcagctccttaattcagtagatgattgatgaagccatgtaaaaatgctgaccagagatgacatgtcctattaaccacataattgatcgagattgtacacgcacgcaaagttttccattgactgtaggaaagcaaacgagttccaggcatctgcaacatggttccagggattccaggatacactacaggtatggccaaatgatcatcagagttgagaatggattcttgtgcctttgcattgcaacttgcaagccctctgtaatagcgtccacttctgtaatttttagttcctgtctgccccactccttggagctagcgtagtctctaggtgtgcgtgaggaactgcatatggcacatgttgctgttgctgatcatgttcaaccgttctacctcgtacttcgtatgttatacagcaaatcttctgtgctgaaaggtatctgtttgccttggtgcaatggtgggtgaacgtggtgacattgtgagacatatgcatgatttgctcatgaagtcattatggctgtgttttgcaaaaagtttctatgggaagttgttcttaaaaagcatattaatctatttttcaagttttttattattaaaacttaattaatcaagcgttaatctatcgctccgttttacgtgtgttcccaaccccttcaaaagaacacagcctattatatccgagttctctgcttcattgttgagcagaacagtatactgatgctgccacaatctgctagtgcttgtgtaattaactgacaactggaagcatggggcaaccaatcatacatggcttctcttgctagaatagtaatatgcaaatatgactaattcagaatattcggtgatcaattctgagggttgagcttgaaggttttcttgtactcgtgaaagagtgattatacagtatcatgacaaaaaaaaaacagagacagtttgcttctgtcatgacagaacaaaagttcaaaaaaacgtggtcggcaggattcgaacctgcgcgggcaaagcccacatgatttctagtcatgcccgataaccactccggcacgaccaccttggggttgcaatcacatactttttttactaattgtttcatacaacaacactgcaatttgattcatattcgctacagatatcgtatcttttattcaaacaccgaccaaatcagttcatagatatcgcagtcaccaccagatatcacacagcaatatcatgcgatggcgcgaactcatgttcatacatatatcactgcatcgtgtcatctgcgcacagctgcacataacgcacgcagctagcactgtcgcccaaacttgtcgtcactccagcttgtgctgctgggcggcgcgcccggggctccgagccgacgggtactcgagcagcgggtggagcggcggagccggcagcgcggcgagctggtggcgacgggcgctcgccggcggcgacggcgatggcgtggacagcaggaggcggaacgtccaggcgaggacgtcgggcgcgaaggcgcggaagacaaggaagacgtcgtaccagttggggtgcttcacgtgggcgtcgccgcggcacgcgccggcgaccaccatcctcgcgtacgcctccacttgcccgccggcgagcggcacctaattacatatgattaatcaatggcaagttaattaatcgacgagcagctatagcatttgattgttgaactaatctttacctctcgctcctcccctttccattgcatctctgcgccttcctcgagcat

SEQ ID NO: 90618 - DNA, 1173 bp, Oryza sativa
tgtgtttatttgagcatcgcactgaaagtattctcctcgagctgcaacagaagaaaagaatgatgccaccaaattatttaaaagagaagaaaatgctaaacctgtttatatttggatttcgaaattggcagatcaacatcgttgcaagggaagctttttcagcacaagctgaaacctaaagtagtgcatgcattgaaagatctccggaataagcttgaagaagaagagcggagaaagaggtgactactgtgtgactgtatgacctagaggcatgaacaaatggctaacaaccgcacctgggcatgaacaagtttgtaaaatggctgacaacctcacttgctgccttgcattggatccgtagggcattgacatgatgtaagataggatctggttttttgtaaagaccccgtttggacttcgtagagagaggcttcaagaggttaggcatgcttttgcatcagaacaattttgcaagctgcagagaagaaaggcatgaactgtacaacaatgtaaatatcagcagattcctctaaatcaagctcaactaacgagatcttggcaggagatcagtgtactctgtttactttattctttttgtttcttcgaaggatgcaagaaaggaagaatacatgtatgcgtatatgattctggttttccaggaatgctactgtctgtcatgaaactctctacgattatacatagcgaagacggtagccagcaatgcagagttgcagacagagcactggcttgtcctgtccaattagtcaaaatctatccaaatcatccgtaatggagtagctaaacacaaaccattcatcacattcacactgatatcgatggatgaatgcaaggtggctacctccagaaccatcatttaatcagcaaaattgacaaccattcttcagtttaccattggaacaggttcctgaacagcattcgccctcacaaccagtatttggggaaaacataacgaaaaatatcaactgaccccacaaagaacaagggcctgttgattttattatcaaggtttccaccacaaattaagttgtcccgagtctaataaacatgaacaaaataacgggaggcagctagatgagtaacaacacaacacagcggctcagctcagataaggcagccaacaatagcaccatatgcttcagagcacagggcatc

SEQ ID NO: 90619 - DNA, 4274 bp, Oryza sativa
tcgtgttgtttggatgtagttcgcggcggattggcaggcggcgcgcgcggagagggaccaggggaagatcctgaaactgcaggtgatacgggccaacagcggcgggttgatcgtcaggttcaactccctccagggcttcgtgcccaaccctctccttagccccgcgcattggtgtaaaggtagtcagtttctctagtttgagttgtttgcagaatttgtccagatttttgaaccagctctagctgcaattgatcgccggattaagatgtgattgcagctgtgggctaccgtaactgaactcatggtggatgtatggttttttccttgtagaccccaaaaggcccattcaagatgttacaaaggaccttgtgggttcttccatttctgtcaaggtaattaagaggcttcaattaccttttgagctaccaattagattatgggtactataccatgcagtagtacaaacacatgctggttttggatcaaaacgctgatcaatgttacttttaggctgcttgtgtggcggaatttcagtattaaactgggtgtccctctccaaggaactgtgatattctttaactttgctttctaaactgcattatgattttttttcaagcacattctggcaaagttgtatcattggctttcaattctctattactatgggtacaatctaagagcgggcaccagattgtaggattcgaactttacacatttttcttcagaaactgaagctaattactttaggtggtcgaagtgaacgaggaagaaaggaagcttgtcttctcagagaaggatgcaagttggttcactcattcttctctagtcaagattggtgctatctatgatggaattgtcggttcagttttccactacggtgcatttgttcatctgcgatttcctgatggtacccattggcaacaccccttgtcatttttgttggtaaatgttttgttgattttctgacaaaatctatcctcaaacaggaaattatcatcttactggccttgtacatatctctgaggtctcttgggatcttgtccaagatgtccgggattttttaaatgaaggtgatactgtcaaggtcatagtggtgaacattgatatgtaagtatctaatacttctttactgtcttcctccacaattgtcagcatgtgtattcgcaatgtagtttctcgtgatctcattccatactttttcaagaaagtttgcaattatataatcaatgttgactgtaccaatgaaaaatagcatatgtttaattgaatctagcgatggagaatggcgcaatacaccttaaatctatatagattaggatttaacgatgcaataactattgagaacacagattgtctttaaggaataccaagttgatgcattgaaatagatcacttatgactcttgagggctgatgaataaaatgagaggagtttatgatctatttttttttcctatcattgctttcttcgcaatagggcaaatcagcatatgctggaagaattatcatgaatcagaaaattatgttacataatctgatactgatgcatttccttcacaaatagggagaagtcaaggatagctttatcaatcagacaattggaggaagatcctctactggagacattggacaaagttattcctttggttagtttgtcgaaagcacgtgtctttgtggcaggttatttagctttgttattttaaaggtcaactcatgcattaatattggtttataggaggctgatcaatcacctagtgctgggatcatatcatctgattcatctccttcagaagctgatcttcttccaggacttgatggtatatgtaatgaactattgcaagaggatgggtatgatttctgtttgtgtgtttttttttttttggtgtatggttttttgatgttgatgtactactttatgtgcccagtagctcttcttgactagagaacagttttgttaaccaggagggaacccatgaataggtttttacgttgcaatctccatgttttaatcagttctatttcttcacagtataacagacgtacagtttgggcgccgagcattggagaaacgtgttgtttcacaagatctggaactctggctttccagtgtatgatccaaaatgtctccaatttaaccagtcgaagctcacaagatagaaacatggactgatgtgttggatctcattgtgcaggtgccagctaaggacaatcagttcaagcttcttgctcgagctgggcgacaggttagtttcttcttgatatagcactgttttcttgttataaggagtttcattaggcaaggattgatgtttagtcggttttcagtcccaactgaacagaaaacaaaggtacatcctgtaaaaccaaaatatcaaacaagtcttcaaaatggttacaccggaagttagtacgacaagttttgtgaaagattgtaatggttgtctgatgagcgtgccgttggaataattgttgtagttgtgtgacagagtgtaagtaaaaaattataatcctttaaactggcaggtccaagaactatatttgacaaccagcctagaccaggagggcataaagaaggcggtacagagagtactaggacgtgttccttgagtttggagaacagcgagtatgaggcagcatgcctgtactccccccaattttctgaccaaccgactatagtgaaacaacagcacgagcagacaacctgaaaagttcgtcgttgtttcctcattctgatgctgagcttcctctcagctggagactacttaaccgaaaattgcaaattttgtcagtaatacaatgagtaggtagttatcttcgtgcatgcatgtacctatctgaaacctcaaggccacctgtatatatatcagtattcatcttcagtgtcatcaattcatcatatcttgttctggtaactaatagctagatatgcctttcttgtcaaagctgtttctgttcaacatgtaaatctactccgtaatactataagtccgttttccccctagagcgtatgaaccacttctttgtcccttaaaatttactgctaattctgtactgcctgaaccacttctttctacgtaccttgttacatgttctgttctgactgcaacatctgtaggatggtacaggcaagtaggtgagatcagcaattgtgtaagcacaagtactgctcttcttgcaaatatttttcgttacatattaggctgggcagtgaccactactgacacagttgaatcaaattgaatgggacatgcagatattatccaaattatccaaaaatgtcacacattgactcccctagaagtcatagaactaactataatgcataattgccaatgtgatggaacgcccatggtttcgtggcatttcgtggtgccttcttctgccttggctagtgtcaccatcttctcatcggttgatacatccaaaggcgagagaacaagaagccggcgatgaatccaagaagtaataaacagacaaaattctcaactatattagctcgaatccgccgcatcgagcaatctccccctcgcattgcctccttcgatcgatcaatcaacggcgacaatgtcgcacggcggcggcggcggccagccgtcgtgcgccgcggtgtcgcttagcaagtacctccaacgcaagctctggaagcgcatcaatggtggcaagccgaggaggaagaggaggcctgaggtgcggtcggcgtcgggcggcggcgaggtccccgtgtcggtggagctgatgactaccagctcgtggtcgtcgtcgacggtgaggtcgccggaggcggtggtgcgggtggtgatgcagggcggggtggtggaggcgtacggcggggtggtgctggcgtgcacggtgatccggaagcatccgccggggctctgcctcgcctaccccgacgtgttccgcaatccgcacggcgcccgcgcccgcccgctccagccgctcttccccggcgagaagttctacctcctcccggagcgcaccatcgagaggctccagcgccaaatccccgagagctccgtcggcgccttcgacaacgccgacgaggaggaggaggaggaggaggacacgcaggattacagcagcggcgcggcatcgtcgtcgtcggaggaggaggcggcgtgcgacgacgacgacggcgacgagtgcgccgcgcggaggtggtgctgcgcgagggagtacttcgaggcgaaggagcggtgggaggaatgccagttcaagaagatggtggcgcgggggctcgccgtcgagcagaacaccgagaaggagacggcgatg

SEQ ID NO: 90620 - DNA, 1920 bp, Oryza sativa
aagtcttataatatgaaacggaggaagtacttggtttcaatagttcgtagttataagttttactaccaaaatacttaatctttctcgtcaacatgtagattttgaagggaaaactgatgataaaatcaagaccatggaagtggtggaagaattaagatctaaaagggctgacatgcaggtattattttgaaagcttgaatatatgtgctctcgattctcatagtttgtgtataccagcacatgtaactaatagtaaataaagttttaatcctactggcatttttcttctttgttgcaggctacccttctgcttgatgcctttaacaaggacagagcttcattacctcagcctactccaacacctcaaatggcatcagtaccagcacctgctccccctgatgctcgcactcaagaaatgatcaacgaaaagataaagaaagctgaagagcttggtatgaaaagaaccgctctactttattactaagtagtatgcatgcgggttgttttcttctgtgaggttactggctcagttacaagggccaagatatagtttatttttgtagtttatctcagtttcactcactcagttcacagcacatacagtttctagtagcaatatgaactatttgctagtcaggcagcagtgctttttttttcccttttatacctatcaactccaatcttttcaagctaagatgctatttttgcagtgtactccatccgtcccactcactaaggcgcacacgcattttaagattcaaatctttaaatatttgaccaataaatagtttattataaattaaagtttatttgattaaagtaataattggactatcatttaaatttactttcatatgattatgattttgttgttacaaacattatagtatatgagaaatttaaagtcaaagatttgtcttgaagactatgccaagtttgaccgcgccttagtgagtgggatggagggagcatttgcattggttatggtgctagtagttttttaatgacataaagaagtttatgtgatataatcttgctcatccttttgttaggtgaacaagggatggtagatgaagcacagaaagttatggaagaagcagaggctttgaaaaaggtagatatcgtcatgtacactgactatattgtgtccatcctttcacagcctagtactgggttaatttctagcctttcaattgctggcagcataaatgataactcttatttttttaggacgttggcattttgtctatttttctgtggttgtgtagatcatgactaatgccttccattattgttgctgttgttctatgaccagttggcagcacggagggaaccaacttcggatcctactaaatatactgctgctgatgttcgaattgtgagtttaatcctaacatggttaattttatttgattacttatttttgttgtattaatttacacagtgctatcactagctttgccttctttattgaagaccagtagattctgcaatgcttattgtcgccttagacacacttggtttgctactagttattcaatgatattttttgcccaacacttgggttgctaaagagctttttttttttctataagattttactctgtactgggatgctgataaaaaatatgcatttcctggacatgtatttaaggacatttttataaaattctgtacattttgatagagtctgctattaagtgaaaactcatattttatgcattaagaaatttatgcttatcatgcgagctattgttgctctcaagggggtatgtatcattgtctggccatttgcacatatgttactagaaaagtgataagccgattattctataatcttggagtacatcttttgcaacaccatccccatagttcagttctttctaaaaattaccatgtccattcatcatatttagatgc

SEQ ID NO: 90621 - DNA, 1229 bp, Oryza sativa
aggaaatttctatgtcagttctatttgttgtgtgtatgagacgaggatggtctgtgccgcggtccttctgtgtcttggcttgatcaagggctcgtgcccaagtcctagtcctcaaatggctcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacctatttcaagtcaagattcttcaaaaaggaaacaaaagcacagacacaacctttaagaaatcgaaaatgcttttgttgaaatacggaagagaaaaaagataagcccccggccaaccctgcacgcccgggggggtgcggggttggcccgagcccgaaacctgacacccgacccccactaggggtagaagcgacgaaggtgtttgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcagacctcccctttcgggtggccagcgaaacgccctcgacggcgaggacatgaccctcgtcgtcggaatgggccaacctcttcttcctcctcctgtcccgccgccctgtctgagcagcggatccgggggcggccgaagctgccactccgggaccggaggggttccaggtccatgcctcctccttacgagccactcgatccgcaagctgaaaaagctccgcggtagtctggggctctttggaggcaatcttttcgagcatgcggttgtgccgcacaccccccctgaacgcgtaaatcaccgcgtgtgcagggatgcatggtatggtgttgcggactgacagaaccgctgaatatacgagcgaagtgactcatcatcccttcgttgaccgcgtgt

SEQ ID NO: 90622 - DNA, 1465 bp, Oryza sativa
ggcggcggccgggtcgtcctcgccgtcaagcgcctcaaccagcgcagcctgcaggtcagtacagtatcagttagctgtactcccatctctcctccctctgatttgcatttgctcctctcgaaaattcgccatggtgcatttgattttggctagatttgtcaaaacgtaccgaatttgttcatcaggacgattgaatggcaaaagaagaacttgaagattttgtcttttcagcttgggcactgaccacatggctgcatgttttttcagagtttcaaaaaagaacttcgcttttactttctctagactacattcaagactcgtagcgtacaatcttcacagaagattcagaaagacggcatgcacttaaatatatatttttcggattcacacattttggtatgctaacactacagatttactactgctgaaaatgttcttcaaccagcaatagttaccaacaagcgatcctgatttggatttggatcgagacctaaaatcaaactcaggatattgttcttttgcaccgaaatcatatgaaattcttagcctcgtgacaattccaacaaatagataaacacatcccgtaggacaaggacacccacacatgtcaacttcaaccacagatcacacaccaaaccacgtgaacaatggtccggacagcatcccaagtcaacctactaaattccagaattcagaatcacgttataaacaacgtaccaagcttaatcacgccaaaacttgatgccagattgccagtgcataggacaaaatccatgcaattttcaattgttaaatcaaagattgcatttttttttaaatatcaacagattgaaagttatgtttttctttttttttctgatttcaggggcacaagcaatggctggctgaggtccaattcctaggtgttcttgagcacccgaatctagtgaggcttgttggctattgtgcagtggattcagaaacaagcaagcacaggctgctggtctacgagttcatgcccaacaagagcctagatgatcatctgttcaaccgagctcatcctcccctctcgtggagattgaggctgcagatcatgatcggcgccgcgcggggcctagactacctccatgaaggcctgcaagaagttcaggtgccctccaaagcattgtcctcctctctgaatccataaaactcaaaatatagatgcctcacaggatacattgtctgaattctgaaactctgaactgaaccattagtttagcacctgcggtagctagtagtaagccttgtcctatctgaattctttaatgttcaagtatgatatgatcaatctggcatcttcccaatatctgaattttgaactctgaaactctgagctggaccattagtttagcacctgtagcagctagtagtagcattgtcctatctgaattctttattgttcaagaatgatatgatcaatctggtatctgtcccaatatctgaa

SEQ ID NO: 90623 - DNA, 1119 bp, Oryza sativa
aatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcaagcattgtggtccacagcatctctttctccgaatctgggacaaagctctcatgatctccgcgtgcccttgttcttcgccactacaccgtactgacaggcacgttatcccgcacaacccaaccgctgtgacgtacatagttcttggcggcttcggccggggcactaggacgtccatcttcttccacttctgt

SEQ ID NO: 90624 - DNA, 558 bp, Oryza sativa
gtgccttccaagactcggaatcgcaacagttggattcaggacgaaccgtttagggatagagaaaaattcacaaggatttcatacgaatacaaacatttgcgccatttttaacggataataaaaaggcaacggcccagagttgtgacgccacgctgacaaccaaatgcaagtaggttggatggatcaatcgaacgtaacacattaagcagtttatgcttgactgaaagataaatgatgcataggcatagcgatgtgtatgtaacaacaatgcactagctgatggaaaaacgaaacaaaagggtgacagaccagtggcttcgttcttattgatcatacaacatgtcgattgcacgttatcaactggaaaaagggaaattaagttgtttgcaccctggaggtgctaagttctgctcctagatgcagcagggctcctgttcatcagtcttcttttccatagttgtagataatctcgatctgcaggagtcatataatcaccttataaactgattgcgacactttgatgcacgaaacacaaaatcaaaggaaaacaatgtgaca

SEQ ID NO: 90625 - DNA, 1550 bp, Oryza sativa
cgtagccgttgccgtgggcggcgaggtggaagccgggcgggatgaggctggagacgtcgtagcgggagccgatcttcatcaccaccttgccgtcgatctcggcgacgtaggcgtcggcgtcgtgcagcatgatcttgagcgagctcgtcgccgtcacgccgttccgctgcctcaccgccaccagcgccgcgatctgctcctttaacccccaatcgaagaaatggtcgtagaactacatgtacatatatacaggcacattattgtgcaattttagatgactgatgagtgtatatatatgtacacacgtgcattatgcaagtttagtagacaactgataaataagggcaaaaaagtattagacggctaataaatagcaaaaaattgatgaagtattcaatattaaactttgactacttccttacttggaaaaaattacaaataattataaatatgttttactactgaagtctgtagggtcacaaatatagctattaccaaagtgtgtttcttaaaaaaatatttatagtcaactgaaatgacaataatcaattaatagtgcatgttattcgagagtcaattaaccaaataatcaattaatttatgtaaatgtataacatataaatcatgcttaaagtactttgagtgataaaacaattcataacaaaataaattataattacattattttttaaataagacaatggccaaatatgtgataaaaaatcaacgacgtcatctatttaaaaacagaggtagcagtagtaggagtacttacgatgcatgggttgccgggatgggtgaggatgtaggcgtagccctgcatgaccttgtcggaggggaatggccacatctgttgcgtcgagccagtgtcgtggttgtcgacgaaggtgacagcctttgccggccaccacccgatcacccccggtgccttcccctgctggtcgatcagccgccacagctccccctccaccgccgtgttcatgatccccttcgtcgtgaagtcgaacaccatccccgccgacgccgtcccacccaccctgtccacccagtccaccaacgcctgccggtgtgcgtcctgattgtactccggcttcccgtctccgccgtacgccatcgagtcccacagctccgccaccgccaaccccaccggcgttgtcccctcaatgtacaccttggccacctccggcgagtacccccttgcgaagtcgagccgccacgcatcgaagccaacctcgtcagacttgagccagaggagccagtcggtgagctcccgctggacgacaccattgaggtggtcaatgtcgggggcagcggcgaagtcggcgccggtgtcgaggttgcctgtgccgtcggagaactgggtatcatcgcggcagatcatgtgggggccccagtcgaggcggccgtcaggtgtgccgccctcaaagatgcagtagatgccgcggctgtccttgtagtcggcgcagcggtggttgatcaccacgtcagcgatcgcctgaatgcccttgccgtggagcgcgctgatcaacgacttcaactccatcgacgtg

SEQ ID NO: 90626 - DNA, 957 bp, Oryza sativa
atataactgcctacagagcctatctatgtgctagccaggtgtttcaggaagtagtggattagacactcccccgtttgtctactcttcttcaggattaaaaaagaaccagatctaggttttactttggacgtttgcggtaaggatacatgatatcatccatggtgtctttaatgtaggccccaactttatttaagttccttgctacaccattagccacaagtccagcattcctctgaaatctgcaggttcatcgggaaatccgtcattcattaaattttgatgccgatcttaagggatctaaacataatctaaaacagaagaggaactcacttggttaagaaatcatctcctctctgtgcaggcttatatcgccgtggttggggagctgcagtgttatcaagataagttaagtcttcaagaatagaaatgaaatgtagatactttggacagttactcataacaaactcaaagagattcatattaatgcaatttccgaagtgaccagattgtttcaccaataaagtcaggaccagtctgagatccagtaactccgattaatgagaaattggtcatacaagtagtggccaggaaacatttctacacaaccgtgataaaagtacagtgtgctaccatgtgtgcaggttggtcacaaagggtcaacaagtaagggcaaaattggtctatcatgataacatttggcggtttcaattttacacaggctcaccaaaaataatagggataatcaaggaggcaacattcgcactcgaccattgttgtgcactaacaatcctcattcaaagttttttctggagggaacaggcaggagctctgccatttcattgataggagggaaacatcagttacaacgctaaaaaaaaaggcatactgtgtagaattcaggtatatgtataataggtccaatatctaaaccaactagatgtgacaacaggcaaggct

SEQ ID NO: 90627 - DNA, 1160 bp, Oryza sativa
tttagtatttttcacattatatatatttatatagatttattaacatcaagatgatttctaaaaaaaacattaagatgaatatggaaaatgctaaaatgacttacattgtgaaacagggaaagtaataacaatgataatatcatagtattaatgagattttagaaagctaaaccgatagtatatactttacgcatctgacaagcatatgcagtcctatttatagtaggagaacaatgacttttgtttgtgatcaaaggacacgtgcggtttttccattgacggtacctgcattaaggtcaaaattaagcgtgtttcggttttgaagaagccaaatccaattttcaactatgcacacataactaccatttcgttcggagactaaacccagcaatttagcatacgtggtctaatcctaccatcgacaataataatataaattaataataacagaggaaaaacattcagcaacagtattactcacagcaagactttttaatcttgctgtatctgtaacagtacacccttcatccaaaaaaaaataatttcaacaacaaatctaaatatagactatgtgtagatttataataaaaaaattgattcttttaattttgaatggaaggagtatgcagtagtagtaaaaatatctcctagagaatttttattctatgagaacaaattatatattaagctcttttttttgcctatgaacacacgcacgcaaaccctacccctatgagcatcttcaaagactgggccggactgggccggcaaatcctggagagattgacgaagtaaaccctacccctatgagcatcttcaaagactaggctggactgggccggcaaatcctggagagattgacgaagttaccacaggcgcctagctgttgacgggtacgtcgcctaccactgaaagcacaacgccgataaatcctggaaaattcgctcccatggggagtcgaacccaggaccttaggtgctactgaggctcttgtaaccactaggctacaggccgatattaagcttttgaaacaaaaaaattggttactattaatattttgaagtttctaaatgatggtcaagaagttaatcgacttaatttaccctattcattttcatattacaagttgttttgatttttctaatcaagtttgtaaaaaa

SEQ ID NO: 90628 - DNA, 611 bp, Oryza sativa
aaatccaattaacagaatcagcggctatgctggcacaagtggattcatgcatgaggtttgccgttcgcaaggtcaactggtgtagacaaacattacccaaaggaagtaataatgaactaattaatggtggtagtaatactaaaaaaaatcagcagtgaacacagtaagcaacaagaaggaatgaatactcacatctgcttttcgcccatctttctcattgttcaacagctccctgatagggtagaatgctgcttgcttgcacagttctagaatgtctgatccagtaaatccctcgcatagaccggcgatgtaatcgtaattaatgttaggctcgacattttctcccttcaatacaaccctaagtatcttgcttctttcactctgaacaggaatcccaatttcaaatatctgagtaaagcgcctgaggatagcctcatctagctcagagggtctgttagtagcagcaaggaccataacacgggcattttctgcaaagccatataaataaatcataagatgttgcacaggagtaaccaggaaacttgtttgctagttacaaaataagttgctccctatgtttgaagagactatgtctggcaccctaaataata

SEQ ID NO: 90629 - DNA, 584 bp, Oryza sativa
acaaccaccgggtttgccagccactccggatggataacctagcggatgaagccagcctccaggagccgcgccacctcctctcggatgaaggcttgccgctccggggcttgacgtcgcactttttgccggatgggttgcgcgtccggccgcacggcgaggcgatgctcgatcacctccctggttaccccgggcatgtccgacggcttctatgtgaagacgtcggagtttgcccgcaggaaggagacgagcgcgctttcctatttggcgtccagggtcccgccaattttggcggtcttggacggatcatcgccaagggggatctccttgacgggcacctcatcagccaaggtgaggcgcttcttggaagcgcgggacgcggaggccaccggggcctgcggctccatggccaccgccaggttgttggcgtgctgctccgcgcaggcgagggcgaccttgacatcgccaaagacggtgatggggccactaaggcccggcatcttcatctggagataggcatagtgggtggcggccatgaacttcagcaacgcaggcctgcccaggaccgcgttgtagagcagattgag

SEQ ID NO: 90630 - DNA, 658 bp, Oryza sativa
aagatcctgaatctcttgaattcaaagttatgaaggagagaatgtataaaatcttctcaaatgcaatcgtagtcagctattcacacttgctgccagtggtgctgtacaacgctttcaatccccctccaccggtatgtatttaaaatctcacctttctcaaaagcatgcttttaacatctcaaaattgattgaaaacttgtatcatcatgcctaggaattcaccttgatgaaatcagaccctccaactgctcaacgccgatcaccccatcggcaaactggtcaagctggcggaggacctaaaatccggtctgattctcaacccagcaccactcaatcggccaaccaatcagacttccgcaagaggaaattggttatgagcgacgatgaaaatgatgactctgaaaaagctggcagcaagggggtgacttgaaaaccagcaaggcaagctaacccgaagaagaaaacatccagtcgtcccatgccgaaaatcaggaagtcctccaggtacaaatcatttatccatcttccttgtattgctgctcactcactatcgaaatagcactgatagcataactcaaatttgtaggaagccatctgacatagatccttctggaaaagaccctgagccgactaacatggagacgggcccttcaaaaga

SEQ ID NO: 90631 - DNA, 1664 bp, Oryza sativa
tatggccctacagccttgaggcaagtgtgtgatttcccaagtgtcattagagaggatagagtccatctcactttgcactgcttccttccagtatgcagcttcagcagatgcaaatgcttctgacagagtactgggcacatcattgacaaggtatatgataaaatcttcaccaaacattttctcagttcgtgatctcttgctcctccttaaattaagggaatcatctgacaaaatgctaattctaggttcaacagaaataggttcagaacttggagattttaccttcagtggaaatgtatcttcgaaaaaggtcgcgtcacatgattccatcacagtattttcacgaacttctgtagtttcagatttaactaccaggaaacgataagctggactgttctgtgcatatcctatgaacacgcaatcgacggtcttaggtccgagctttctcttcttgacaacaggtatatttaccttggcaaggcacccccacactttcagaaaattcagatttggtttctgcctttccatagttcatatggagtaacttctgttccttttgcaggaacacgattcagcacaaagcatgctgtgtacagagcttcaccccacatattgtttggaagacctgaattgctgagcattgcattcactaaatcagtgagagtacgattcttcctttcaactaccccatttgattggggtgaatacggaggggtggtttcatggatgattccatgttcttgatgaaacttagagaattcaattgataagtattctcctcctctgtcagacctcaaaattttaattttcaaatcaagctgattctcagcctctgctttaaaaattttgaaatgctcaaaagcttcatcttttgttcttaagagataaacatagcagtacttagagcaatcatcaataaaagtaatgaaataccgtctacctcctttagtcaaaattccattcatctcacatatatcagagtgcactaattcaagcatagagctgtctctatcaacagatttaaaaggtttacgaggttgtttagcttgcacacagatttcacactttatacctcgtgtgtcatgcttgggaattaaatctagtgacatcatacgagatatagatttgtaattaacatgacaaagacgattatgccacaaagaattatcagtacgagcagaatgagatgaaacagcgaaagctttattattatcactaaaacttgaacaaggcagcaacaaagatagtctaattaggccattatctaaatagcctttcccaacaaaagaacctctaatagttattacaactttattactctcgaagacaagcttatggcctgacttcattaacagacttccactaatcaaatttgctttcgctgctggtacgaagagcacattgtgtagggtcagaacttttcttgaagaaagcttcaaatccactcaaccactacccagcaccctagacttgctctcaagacgagtcacagaacggcctccttgctgttcctgaaaagtggagaacaaagatcgatcaaaacacacatgaacagttgctctagtgtcaacccaccaatctgcaggttgacacttatcaaatttttgagacatgttcgaaacgcaccttgcaacttcagcttcgtcaataaccatattgacctt

SEQ ID NO: 90632 - DNA, 1332 bp, Oryza sativa
aagcaatctttggccgcgtgattggaattaggatgatgcagacattgggagttcatgattttgtcaaaagtgttgagcgcgaacgttgtcgggaggatactcttattttccaagagcataatttggcaatgcctttccttgctttttatgtcattctgttcgtattttccttgataataggaaggcaatgaacacttcttttgtatttactcgaatggaaatttacagaagaaacatctgtacttgcatctgttcttttgtggcctagttgaactctatttcgaatgtatgctgtttcattgtaattttcagctgatgacgtcttgtcaattttctgtcatacagaggatgttactccagtgccgactgatagcacacgcagaaagggtggtagaaggggtaggaggctgtaatcttcatgcggcctcaaaccgacaacactctgctctcctagatgttaccgtctgcattggactattttgtttctgtgcttttcattcggtggattatttaaaccagttttgaactctgtttctgcatcaattcatgctgtcctcaatgtaaccaacgttatctgcttcgaccggtgaacatactcctgttggattacttgagcatatgccactacaggccggacactgctttcgttgtttattcgggagagcatggcaaacttgggagatgaaaacctggaaaatggtgcgaggataatgggcataactgtaaaatagtgcgttttgtacgaaaactttatatatgaaagttgttttaaaatttcaggttaatccatttttcaagtttgtaataattaaaacttaataatcttcatcttaaggacattcaaacaccatcaatatgtgcattgtccggtttatcacaatatactcacaacgtaccttgctttcataagaaagaaatggtactcccttaaactcccttaaacgtttgactgttcggtttattcaaaaatcacataatatgtgatcacataatatgtgcattgcctggtttatcagaacatacttagaacataccttgttttcatgaaaaagaaatagtactccaaagcatgaaagaaatagtactcccttgaatgtttgattatctgttttatttaaaatttttgtgtaaatataaaagtatttatgtcatactgaaacaatatttgatgataaattacgtcataataaaataaattataattatataatttttttaatgagacgaatggtcaaatattggttaaaaaataaatggcattaaaatacaatactgagggagtatattgcgaatattgtcacacagttcatcctgatcctgtaggagtaatgg

SEQ ID NO: 90633 - DNA, 3398 bp, Oryza sativa
ttgtgcatagttctgaaggaaaatatacttgaccctgcagatgtcattgcacattgggcggtcagttcacatgtgcgtcaaagatatcttgaacatcttttccagaggtttggaaattgcacagtgaggctgaaagatggatatggatttgcggtctttgattctaatgatgatgcagctcgagccatgcgggcactgcaggggaaatttgtttgtggggagcgcattactgttaattggtcaaaacagcagcccagattttctaaggatttcagaagttcaagaaacattgagtcatctcaccagagggcacccagagtcagagatggtaatattaggttcagggattctttagctcagaagaatcaccctgcaagtcatgatcagggtcacagtcctgatgttgcaccagaacagaaatcatctgatggtgcattggaaaagaaatctgatgaaaagaaatctgatggtgatgttgaggatttgaaggatgtgagggaaactgttggtcaagatccagtggagatgaagaggaatgaagatgttacaagtgatgcaaatgtaattgaacatgatagatgggaggaaactggaaaagggaatcctggtagagatgatgatgattttgaccgttatgaaccttatcatggctatgccaggcaagaagaaagagcaggggttgtcaaagcaagttctcaggagacttatcatcatagattttcttcacagaagtcgaaagagtatcctgctggccatactgctcatgattgcccccagaaaacagatggaggattcgaagcatggagagatgcattgagtaggcaagaaaggctgagaagatttgggtctccctcaaggaggcaaccagatactcgtgattgctctaagaaaacagatgacagattcgaagcatggagagatgcattgagtaggcaagaaaaaggtatggtgaggctgaaaagatttgggtctccctcgaggaagcggacagaagaatttcgtgttgataaggtggtagaaacacatcgtatggtacaagatggcaggaaacaattttctgataggactagccacgctcacagattgagtaatgtttctagagaggacaaaaggcatacccgttgcagtgaaagtataccacagacccccaaggagtcacgcaagagaagcagatctaaaagatcccgtgggtcatccctctcttctgacaggagtacctcacattcaacatctaaatgttctcgttcaagagcacattccccatctcattctgcacattctagttcaaaatcatttcagccaactcagcctgaaggtttaagatcaatggcagtatcaaatgtcagtccattgctggtgtctggttcaccacaacacaacttaccatccacagcggaaaacaagaactcagattttctggtgaattctcctttggagggcaatttagattccaaaacaacaactggactcaagcatacacgtggttaccagcaagatatcaaagattcaagattgagtggagagtctccagttattccactcaggttgaaaatccaaaggaatggtgaattgcctgtatctggtaaagatgcttatctggatggttacacagagaccaacttgaataataacttggtttatgatgacaatgttgctgatggtgtgcaagttcagaagaccaattctgaggacgcttcatcagtgaagtcaagcaaggatattctggtgaaaagtgagaggagcaactctttgaagctaacaacaaatgaagtggtctctgctcttaagcacaatggaatggaagcacgtggtacagatttattgaaccaacctgtagagaagtactttggtgctgcacgcctatggccatgggaagtcatttattatcggaagcttaaaaagggtccaatttctacagagaactacgctaagcgacttgagcagaacaaagaatatagtattgtagatcggtatgtcagaagcagcagtggttggtgggagtgccactagaatgccagactggtggtatagatagatgcagttgaggctttgcgtgtatgctgctgcaggtacattttgaggatgacaaggtttgccttctaatcagtccattcctagagctccatgagtgtaagcagacccttaactatgagaattattaagtattaggttctttcattagtataattttgttgagtaagggtttgcacaattgcacctaagtagcttattctgccaccaatattatgctgttgcatggtcagtatgttttaagttgtaatgtttcaacgactcgccccagtgaggtacttggatggccaacaggtaagcaaagatgcttattttatacatgattttttggggaaaagaaacaagcctcttgtttagcagttatatagaggaaaggttctctctgtagtttatgatttccttagtactccctccctctggtttcataattcttgacattttggacaatgatatggtctccaaaatatatctttaactatgttttctctattataatatatacaataaataagtatatttttacttttattatagtacttataagacaaatctatatatgttgttttagtgtctttaaacttaatattttagaagttattgatagtcaaagttataaaagtttgatcttaaccttatcctaaacaccaagacttatgaaaccggagggagtatgactacaattatttttgtaatcaacaacttccataccccgctaatcgagctgaaatattacagtgatgccacttcgtgatagatttcatatgcaagatgtgctcccccggcttacaagcttttggataggaccaagaaattcttcgcatgtttgagtcgtcactgttatttttgtgtagctgaattggagtaggtgattgaagctttgctaactggattacctgttacttttatgtagctaccctatgaggattatgccattctggctggacacatgaactccataatatcagtacctttatttgagtcagtttttggtcttttaatgtgacttgtcgctgatgtctcatcgtcgtatcctgatatttatattgctctgatcttcttggggattccatctagacttttgcatgcgtctggctttatatttctccaaacggtgtgatagccagttgtccatgacgacagaacataaatttgggttcttgcatatcaaacgctttatttttccccgatctgcatcgaatgccaaatcaccatcatgttgggtagatgttgaatcggatgttttccttcttttcgtctcctttcacgaggagattggtatgtggtgctaattgcaattctcccagttatttagctcctcctgcaagctgctgcagcggttttggccttgctgctctttctggcgtcaa

SEQ ID NO: 90634 - DNA, 1251 bp, Oryza sativa
taatcagcatgatagtttaatagcacaaaattaataatatgttaccgtcaaggaagggccatttatagaaagttctatactagttaggctgacaaaagcttccttgggataatttttcttgtcacccgcaacagcatcacattgttctgtttctgttttgtcgagtgtaagatacaacagattaggtgcatgcagatgcaagtcttcgaaattcccttgaacctctaaatgctgcagtgccggagcttgaatacggagacaactgataccctcaaaatatttcaaatgcagtgttttcagccatgggcatgaggagatcagatttgctatgtcagcgtctgttgagtatatatatttcagattcaagacagatagccgcttgaaaccttcaaacgtctgaggcaacgcaaccatacatcttttcataacaagtgcttctattccagttaggctcacaaaagcttgcatcatatagtttttactcctgtctgcaacttttgttttgttgagtgtaacatacacattggacaggttaggtgcatgcagatgaaagtcttcaaaggaccctttaacctctaaaacctgtactgcctgagcttgaattcggagacgattgatacccttaaaatatttcaaacgcaatgtattcagccgagggcatgaggagatcagattatttatgtcactgtctgttgaggagaaatatttcagattcagaacagttagctgcttaaaaccttcaaactgccgaggcaagctgatgatgcatctttctatccgtagatattccaaatcactgatagagaagaggcacgatggaatcttataataattcccacaggaaaactcgattgtgatggaacttggttttttccttgacagcatgtgcatccacctatcatatgcattaaggtaactcctcaaacatcaaattgaaaacgaaactagaggtccatttgtggagcaacagtgacagatctaccagtgtagtaaatttggaccgtaatgtgcctgagatgcgatacgtatcgaacagaataagttgccacattcctccaagcacttgataggatgctggctctaatagcatctacgacattcaacttcgagaggatggcgacttttagctctggaggtaggctgctgagtctatctaaactctcagctgattgtgattccacctttgcctttttagcacaatgcatcgctccagaaatcagattgaagtgacctagcaatttccgaagagct

SEQ ID NO: 90635 - DNA, 713 bp, Oryza sativa
cagggtacatacccccgtccgggggaggaggcggacctacatgctgtgcagcggaaggacgacgagtccctccgctcatacatacaacgcttctacaggtccacaacactattccgtgcatcccggcccacgcggtcgtttatgcatttcggaacggcgtgtggcacaaccgcatgctagagaagatcgcctccaaggagcctaagaccaccgccgagctcttcgagctagcggacaaggtggctcggaaggaggaggcgtgggcttggaattcccccagcactggtgcggcggctgcggctgcccccgagactgcccctcgctccaagcggcgggacatgaggggcaagcggaaaccggcccgctctgatgacgagggccacgtccttgcggctgatgggtcttcgcgggccccgcgcaacgaaaaggccaccggtggcaagccgagctccaccgccccctccggtgagggtcgatcggcggacaagtggtgctcagtgcacaatacttatcggcacagtctcgccgactgccgctcggtcatgaacttggccgagcggtttcggaaagccgatgaggagaagcggcagagtcgacgggagggcaaagcccccgcgacccccaccaatgatcggcgagaggagtccaagaagaaggcccccgccgacgatggtgatgacagcgaggatctggaattccagatacctaaggga

SEQ ID NO: 90636 - DNA, 1038 bp, Oryza sativa
ggatgacttcgtcgtagaatggacaccggtggatgaccctcttccgtccgatttccctccctccccggagacggtggagacccgagcgccgacattcgcgccgggcactgggttatgcacttcgacggctccctcaaccttcgtggtgtgggggctggagtcacgctaacttcgccaaccagggatgtcctcaagtacgtcgttcggctcgatttccgagccacgagcaatatggcagagtacgaaggactcctcgcggggttgagggcggcggccggaatgggcatccgccgcctcctagtcctaggtgattcctagttggtcgtgaatcaggactctaaggagtaccagtgcaccgacccgcaaatggatgcatacgtccgtgaagtacgacgtatggaacgccacttcgacggactcgagctccagcacgtgccccgacgcgacgatgcaatcgctgatgagttgtcgcatatcatgtcggcgcgagccccactccctccggggaccttcaggaaaggctcgtgcagccgtcggcacatttggaccccccgagggaccccggcgccacgacctccgccccgagccccgacagcctgcgggcctcggggcccgaggggatcgaccccaacccccctcgtcacgtcgcctggatgactgacatccgggcatatctcgacaataatactcttcctgaggatcgtgcagaagctgagaagcttgcgcgtatctctaagcggtacgtgctcgtagaagggaccctcaaccgacgggccgccaacgggatactcttgaagtgtatttctcgggaacagggcgtcgagctcattgctgacgctcatgaggatgagtgtggggacattccgcctcacgcacattagtcggtaaagccttccgacaaggtttttactggccgaccgcgttgcaagacgcccaggaatgggtccgacgattcaaggcgtgccagttccacgctaagcaaacccaccagttggcccaagccttacaggtcatcccgctctcttgggctttcgcagt

SEQ ID NO: 90637 - DNA, 557 bp, Oryza sativa
catgcgttgcatatatacgatgatgatgaactactgcatgctgggatcgatcgaatcgatgatactacgtgtgataatatatagattgatgcttataaatcatggttatactgcataatctgcagaggatcgagctgattaatcatgatactactgctgctaattgagaagaactaatggggcctagaactaattaactgtgatcatcatcaaggtgagatttcttcttctcgttgttcttcttgatcctgaattcctgatgcctctgcgcgatcaaagaagcgtgtagatgcttctcctcgatctcttgctgccatcatggtcatggccatgttcatcccctccggtggcggcggccgtcggcgttgatgccgccgccgccgccggcgtggaggaagtcgaggatgacggggctccggcacttgggcagcgcgggtcggcctcggcgagcatgacgtagaggaagcagcgcgggcacgcggcgagcaccatcgacgtcgcctccgggctgtccgaccactgcagctgcccgccgccgccgccgtgctgctgccgca

SEQ ID NO: 90638 - DNA, 3097 bp, Oryza sativa
gaattatttgcctgtggccctagcggattctgcccggtcctgacttcacgggttacttcgtggcacaatcggatcatgggcggaacttcgcgaccacttcattgccaactttcagggtacctttgaacgccctggtacacaatttgatctctacaacgtcattcagaagtctggagaatccctttgagattacatccgacgcttttccgagcaacgcaacaagatctccgacatcaccgacgacgtcatcatcgccgccttcaccaagggcattcgccacgatgacctagtcgacaagtttgggcgcaagcctcccaggacggtcaagcagatgttcgaaaaagccaatgagtatgccaaagccgaagatgccattaccgcgtccaagcattcgggcaccacttggaagccgaagaaagatatgccaactacaggggggagtggaagtaccaatcacaaggatcgcaagcgtaagcctaaggaacttgtggcaactactacaccatcctcccgacaacgttcgcgctcaacacttttgacaaaatcatgaactcccaatgtctgcatcatcctaattccaatcacgcggccaaagattgcttcgtctacaaacagtttgcagaacaatacgccaagaacacatgcaaaacttctgacggagatcaaagcacgtcaaagaaaaaggatgatgaagatgatgccccgactggttttcaagaccaccgcaaggaactcaaccacatcttaggcggacccctggcattatgaatccaagagaaagcaaaagttgaccgaacgggagatcaacgttgttcagcccgacacgccccaatatcttcggtggtcagagacaacgattaagtttgaccgctcggatcatcctgaccgagtggtccacccggggcggtacccctggtactagacccagtggttcgcaacgtcaagcttcgcagatccctcatcgatggtggcagtgcactcaacatcctttttgccaagactctggatgacatgcagatccctcggacagaattaaagccgagtaacgcgccctttcacggagtcatcccggggctatctgctacaccacttggccagatcactcttccggttactttcggcactcgggagaacttccgtacaaagaacatttgttttgaggtcgctgattttgagacagcatatcatgccatactcagatgcccgacgttagccaagttcatggcagtcccgcacaatacctacataatgatgaagatgcctagtcctcgaggagtcatatccctgcggagtgacatcaagcaagccgtcacatgcgacaaggaaagctgcgagatggcccagacccgcgagatcactctcgcccgagaagaaatccgactggctgcgtccacatcaagcgaaggagaagtgcctgcaaccaagatgtcaaagagcggagaaagcgacgccaagaccaagaagatccccctagatccctctgatcctactaagactgctgtaatagacgctgagttagattgtaaataggaaagcgcgctcatcacctttcttcaaaataataaaaatatttttgcgtggaaaccatctgatatgcctggtattcctagagaggtgattgagcactctttacatgttaaagaagacgctaaaccaatcaagcaacggctccgtcgtttcgcacaggataggaaggatgcgatcaaggaggaattgaccaagctgttaacagcaagcttcatcaaggaagtccttcatgccgactggctggccaacccagtcctggttcagaagaagacgggacaatggcgcatgtgcgtcgattataccgacctcaacaagtcttgtcctaaagatccctttgggttgcctcgcattgaacaggtagttgactcaacggccggctgcaagctactcagttttttggattgctactcaggatatcatcagatccgactaaaggaatccgactgcttgaagacttcattcgtcacgcccttcggggcctactgctacatcaccataccttttggattgaagaacgcaggagcaacttatcaacgcatgatccagagatgtttttcaactcagatcggccgcaaagttgaagcttacgtggatgacgtagtcatcaagaccaagcagaaggatgatttgattatggatctagaagagacctttgcgagcatccgtgctttcaggatgaaattaaaccctgaaaagtgcatcttcggagtaccataagggaagttgcttagatttatggtgtcctatagaggcatacaagctaacccggagaaaatcaacgccatcctcaacatgaaaccgccgagctcccagaaagatgttcaaaagttaactggttgcatggcggtgctcagccggttcgtctcacgactcggcgagcgggggatgccttttttcaagctgttaaagaaaactgacaatttccagtgcggacccgaagcacaaaaagcctttgaagacttcaaaacacttctcactactccaccagttttagcttcaccacatccgcaagagccgctgttgttatacgtgtcggcaacttcccaggttgtaagcacagtcctggtggctgagcgtgaagaagaaggccatgttcaaaaagtccaacgaccaatctacttcgttagcgaggttttggctgactccaagacaagataccctcaggttcaaaagctactatatggcgttttaattaccgtcaggaaattatctcactacttccaaggtcactcggtcacggtggtcacatcgttcccactaggggatatacttcataatcgcgaagcaaatgggcggatcgcaaagtgggccttagagttgatgtctttggatatatccttcaagccacaaacttcgatcaagtcccaagctttagccgactttgtcgccgagtggaccgagtgccaagaagacacgcctgcagagaagatggagtattggactatgcattttgacgggtcaaagaggatttcaggcactggagcgggagttgttctaatctccctgactggagagaggctgagttatgtattgtggatacatttttctacgtctcacaacgtggcagaat

SEQ ID NO: 90639 - DNA, 1696 bp, Oryza sativa
gattcggcccatccgaggggagagagattttagggtttttctttttataaaaaccttttcaactttgtttatttcttaataattattatttgtgctctgaaaattccactaaaatttatttacacattttaggcttttagaaattatacaaaaatcctccaagccttatttgacttttaactttgcacattttattttttggaggctttcacaaggattttaattattctaggcataattttaaaggatatattttagggtcgttttaggacgtgacattgatgataacatgaccgcttaccggcaggaggtgcgcaagttggaagataaattcgatggacttgagctcacccatgttcttcgacacaataatgaggcagccgacatattggctaatttttgttcaaaacgggaagtagccccttctgacatgtttgttgaacatctctacgagccaaccgtaccaaggaaagaaacaatcgaggccgcggacactcaagacgtaagcgtgattgaagccaactggagagagcccctcataagatttttgacaaatcaagaacttcctcaagataaagatgaagccgagcggatctccaggcaatgcagactttatgtcattcatgagactgagctgtacaagagaagtccatcgggaatcctgcaacgctgtgtttctttggaggaaggaagacaattgctaaaggatatacattcaggtatctgtggcaatcacgctgccgcacgaaccattgttggaaaggattaccggcaaggttttttctggcctacagccgtgtccgacgctgacaaaattgtgcgaacatgtgagggttgtcaatttttcgcccgacaaactcatctaccagctcaggagttgcaaaccatcccgttgtcttggccgtttgcggtttggggcctcgacatggtcggcccgtttaaaaaggcagtcggtggttatacttatctctttgtggctattgacaaattttccaagtggattgaagccaaactggtcatcacaatcacggcaaacaaggctagagatttcttcatcaacattatgcaccagtttggggtatccaacaggatcattactgataacggcactcaattcacgggcggagtatttaaagatttctgtgaggacttcggcaacaaaatttgttatgcctccgtagcgcaccccatgagtaatggacaagtcgaacgtgccaatggcatggtacttcaaggaataaaagcgcgagtttttgaccgactgcatccctatgccggcaagtgggtagaatagctgccatccgtactttggtctttgcgcaccactcccagtcgggctacgggccagtcgccgtttttcctagtctatggagcggaagcgatgttgccaagtgaggtagaatttgaatctctacgatttcgtaacttcagcgaggagcgctacggagaagaccgagtagatgatctcaaccgactggaagaagcccgtgaagcagccttaattcagtcggctcggtacttacaagggatgcgccgttatcacaatcgcaatgttcgatctcgatcttttttagtcggcgacttggttctgagaaaaattcaaactacacgggatcggcacaaattgtctcccttgtgggaagggccgttcataatttctgaagtcactcggccaggttcttaccgactcaagcgt

SEQ ID NO: 90640 - DNA, 1292 bp, Oryza sativa
gttatcacaatcgcaatgttcgatctcgatcttttttagtcggcgacttggttctgagaaaaattcaaactacacgggatcggcacaaattgtctcccttgtgggaagggccgttcataatttctgaagtcactcggccaggttcttaccgactcaagcgtgaagacggtactcatatcgacaactcttggaatattgaacatcttcatcgtttttatgcttaggcattacttctgtattttcctctttgactgttaacatcaagttgtcccttgagttatcagtcgggggctactataataataatggagtgtgatttttatcaattcaatttgcttacttgatttatcattgccttgtttgattttttggctcagtcaatgaagactgaaagtttttaaaaacttttgcgggttctaggctcaataaggtttgacaaaaacttttaagaaatcaggagctgagtttaaatcatcaagcatagcataaattcatcagtattgcacaaattgtgcctccatcatcatcattaatatcatcaaaatacaacatcaattagactcagttctttcatcatcagaattaccagacccagttggcttaaggtcgttgtcctagaatctctcaaccacatcagcggctatcttgtcagtggccttttgcgcatcactaataaggtcaagggcggcctcgtcacttgtcccgtcagcaaagccgtcaacagcatcaatatcaatcttcgggtacaagtacatggtcatcgccagcgctaggcctgctcccatactcccagcttctttgatgttcttaaaatatgtatctagagcagctctcagcttgtcgaagatctcgatagcatcaagtgaactcggatcgttgttattgaaaaacattgcctggacgagtggcgtagcggcattggtgacttcatctctggctccttcaagcttcttaattttattaactaagacgtcgaatttggcctgggatttgatcttgcggtctacacgagtaagtttacatcaatgactaggtgtgaagatgagagtggtttttgaagtgttagttaccagtaccttcgacatctttcagagccgagtccctttgttttgccaattcggccttgtctttctccagagcttggatgcgcttttccagctcggatatcttggcagcttgcactgtattgcttcttgttggttgatatcacaaggatagcagtataaataagtcagacaaagacggtatttaccttttgacgaactgctcagctcaaagttggaatcttggag

SEQ ID NO: 90641 - DNA, 1017 bp, Oryza sativa
gtcggacagaacaacacatcctaactgtcgctatcatcccacagaccaccctcgttctgcaattgcttcacggacacgtgtagctacttcaatagcatcgtttaggggagggtagctccagctatttgaaatctacaaggaaaagaagaatgatatagccacccagaattgtggatatacaagtacatccttgtgaacctcaagaaaatctaaaaaaaaagggtacttgaaaaaccactagttatcaggtgtagttacttgagcataagttgtcttgttgatttacatcttttcattagcatatctactaatattttctgaattgtgagttaatctacactgtccatgtgccataaacttccacttaccatctacaccaactattccacaaaaacaaaaatatgtcagcagtggtcaggaactcaggatagctcagttggtaaagcagaaagttcatgtgccacattgacatagttttactgtatttttatgcgagccttgtcattaaagattgtcagagtgacaacaatagtatttcccacacaacgataattgatggcaacaacaacaataattgacataattctactatatgcacaaatgaattcacaatgcattagattttattcaagtaaatgcagcaaatgcagaaaagaaaagaatttaataactaggatcaaaatcaatgaagcatgaggattaagaaaaatcaaggtgccaaaataattaaagtaaaaccttcaagggataaggttcagagtttataaagatattaaaatagtgaatgattagtactacagcttagctttcagaaaacggacaaatggtacatgcttaagttatgcactattctattaggcaagtagccaagtaggcagtataaatcaaaacaaattatcattgacaggattgatagacttacatcttccaatccagtgaaaggacggacaactcctcgctcccgtagagtcttgtgaaaagcaaaaaacttccatttacaatactcagtcccaatga

SEQ ID NO: 90642 - DNA, 1512 bp, Oryza sativa
acccataaaaaaggtaggagcttgctggaaattacgtgaattttaatatcagcttaccctgtgctacaagcctcacttaacatacttatagaatcagctgttacaacaaaagcatcagcccatgcaagatgccccatgtgcgggttaggttctgcaaaaataaaatcaacttgttacaacttacaaatgtaacaacatgcataataaatatattacatcatgaataacttagtgttatatttcatctaccttccccatcccaaatatagatcttaggatgaccagcgaactctttcgatataatatcagagacctgtcagcagataattaaacttaaatgccaagttctttaacgatattataacagaaaaaccagaataccaatcgtcctacctttcgcggtgttctcctggaaaatgaaactctcacactcccacagctgtctagaacattatacgtagaagctatgagctgcctggcaaggtcgacaccatacttacaattccctaatcattgacaaataacaaaagtcaatattggatctgggcatgaaaatcaataatgggacacatacaaaactgtaacaaaataagcttaagataaaaaggattaaaagccaacagaaattctgttagctctctgtaagttagacatgcaaaagcatatccaagagtcccaaggcagttgactagtcgataatacttctgaaaggtgtacagagaaggatataaaagatcatagcatcgaaatgctttgctcattataagattcgctatatgtttatagtcctcacatactatatacgaaattctgaccctgagttgatttgtatcataggctctcatgggttttaggaggaaagctgaaggctaatacagatatctaaacaacaacatcaaatgtggggttctcaatccacagtccacaggtagcatggagtaatggcacatcactagttctgcacccccaaagatctagggggaggggcaaagaatgcaacttcaggacataaaaaaggtcggccttttactcttgatgattctagcttctatggtatctttatgatgcatcacattagttaaaacaatttcataatgttccagggacaatggcgttgcaaggaacttttccttgctacgataaataagagatgatatccccttagagatcatcatattgagtaaagaaatcaattgagatatcctaaaaatgatgaatctcctgttactgaaagaaataacaggtgtatcttctatgcaactgactagccacatctaacagtaacacatcgacatatcatttcttattttttgtgtgtgcactcaggtgcgcataggtttctccatgagaaatcatcagagtgcaaccatttgaattgtggctagatttattcttgcaaactcaaagcaggactacgtatccaaatacagaaacaatggaatgtgcaacgtgagaaagatagggagatctacttgtgggtcctccaatgttgacgattagcaatggcttagg

SEQ ID NO: 90643 - DNA, 569 bp, Oryza sativa
aggatcccccacctagccctaatttcagctcaagctgcataaaaaacatacttttaagagccatgatatattaattaggaaggaagtatgaatacagagacaaagctgcacttactactggggctatcaagcctccaaaaaagattatcccagttatgaatgagaatgatgtcaaatagagttgttcattggcttcgggtactacatcaggaaaaagaaaggaattaatagagattactgggaaaacagtatggtaaatttcttaaggaaacttattgagggccggtaatccccgtattaggcaaaaagggaatactagacgggatttcaggcatttcacttttttcactgcttgcacctctgctttcaaaagttctgattcgctgctgcacccgcaatcgtctaacctgagaaaatacccatattgtggtgaactgcaatctgctgtttcaacaagctaaaaatggactattaaactgaagagatgaagttcatatatatactagacacctcttccatcaaaaggaaaattttgttacggcgggtaccgagctcgaattcgccgtata

SEQ ID NO: 90644 - DNA, 715 bp, Oryza sativa
ttcataccctccccgcctcgatcgcagccctgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcgttcttgaatcgtttcgatctcctcttccctcttgttttaatcttcaaatttgggtcagcaacaaattcttcaccattgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgtgttataccacgggctgcaggaat

SEQ ID NO: 90645 - DNA, 722 bp, Oryza sativa
attcctgcagccctattgaacaaagaatagagagaaaacttagtagttggaaaggaaaacatatgtctgttggagatagattggttttgattaattccgtcctttctagtttagctatgttcatgatatctttctttgagattccgaaaggggttcttcaaaagattgattattatagatctcgtttcttctggcaaggggatgatcataaaaagaaatacagattaactagatgagatataatttgtcaacccaaagatcagggtggtttgggtgttcataatttagagattcaaaatatatgcctgttaagtaagtggttatataagttaattaatgagaatggtgtgtggcaagatttattgaagagaaagtatcttcataataagtctataacccaagtggataggaaacaaggtgattctcatttttggtcagggctcatgaaaataaaaaacacatttttaagtatgggctcttggattgtgaatgatggtcaacatataagattttgggaggataaatgggtagaaaacatggccttcagagataagtatccttatttatatgctattgtcagaaggaagagtgctactattgccagtgttatggcctcggttccgctaaatgtttcttttaagagagctttagttggacagaacctaactctttggtatgatttatgtgcttctattgctcacatccagttggatgattcttct

SEQ ID NO: 90646 - DNA, 633 bp, Oryza sativa
aaatttatacacctaaagtttatacatctccagtttacacatctaaagtttagagaccaaaagtttataagtcaaaagtttatatatccgattcaaatttgaatttgaattcaaatattttttatatatatagtatttttatacatctaaagtttatacacctaaagtttatagacctaaagtttatagatctaaagtttataagtcaaaagtttatatacccgtttcaaatttgaatttgaattatatctgattcaaatttgaatttgaatttaaatattttctatatatagtatttctatacatctaaagtttatacacctaaagtttatagatccaaagtttataagccaaaagtttacatacccgattcaaatttgaatttgaattcaaattttttttatatatagtatttctatacataaatttttctaacttttgttttttaaaaaaatttgtgtggtgtactgtagtagaaagagaagaagaagaggaggaaggggagaagagggaggagtatagggggagagacggggccaaccgatcgctgggcgatcgccctggcgatcgccattagcctccccctctcgcttgagcttttagcattgaaagacatggcccaggaatgcgcca

SEQ ID NO: 90647 - DNA, 513 bp, Oryza sativa
ttgccagacgaggatccccatcacggtggctccagggaatagggttcattccagcaaggttacttttgttgacatcctgtagcttgaagacctcaagaccattcagaattgcatcaacaaattctgggttggtttcaacatcagggtgaagtgcaactctcaggtctgtctgaccataaccaattgggccaactatgtagttggtgtagattggcacaccaattcctccactcaaaacaatgacatccatcttctgtgctgtctggttgttgatgtatacaaagaacgtcctctggttcgccttggttattgggtgctggatctcacagaaatggagccgtaaaagatagtggaatcctgcatcaatcggtagaatccatgtaagattgtacctcaagttgatatatccctttagccccatggaccttgctgtctcatatagaccaactggggctatgtaacttggcatggtacgagggtaactgatggttacagtgtcatccttgaaaaagt

SEQ ID NO: 90648 - DNA, 4112 bp, Oryza sativa
tatatggcacagtgtgaccgggggcccaccagccattgggctgggcgcccccgatcagggcgcgggtcaaggcccccttgagccgttgggctcaaggggagggagatccatctaacagtcttggcctcatatcatgttgaccgcatcggatggaattgccatggaaggagggaaagtgaggctaagaaaatggtgctcagatgaacctagaaccatgcataaaactcaaaataaaaacaacaacctccctggcaataaaatcaccagggaaaccaacatgtacaaaccctatgatggtaaaactaagtgttgtttatatatatatatgctagattttacaattgttggatggtgcttggtgtgggttagtcagttggccaatgctacaaaagcgtgtgtttggggtcagggtcaacaaagctggtggtgtgctggcagtgccccttggctagataatattagtatactataatatataagagttcataatatatttttatttctagggttgaaccattgaagtaataatatgaaatttgatatatcatttcctttggtctctttttaactaagacattttatactttacgtgtaaaaccttataactcagcagtcaaaatcgattgacaactaatagaaagtgatgtacctgcagtgaaatgtattttaaaatgtggtctaacaaaacattataaaagaaacataaaaaaggtcaatctctgatagaatcaaaattggttggttctactcgcatgtagattgaaaatttcacttaaaaaaaatacggaaaggtcccactctttccaatcaagcaagggttatcagacaaaacatcactacaaaatcatgatgaccatattcctacaactcgttgccaaacactaccttccagtttgttttgtactatctgttcacccattactcaactttaaaaagctaggattggccctctcttcagtcctcacatcaactcaccaaaccactacactgttcacgaggcctcttctcctttggattttttcacttcttcatgattctccgagcaaaaatgctacaccgacaaattaacttaacctcagctagcaacaatgattccacaactgaaaccaacactatataaagtagccggagccctttcatttataggaagactcatctggatgagcagtaagttcgtcaactatatatatatatagaaaacatttcatacaattgaagtaattttctccttctacatacagagtgagaattagaataaaaatacactaaatataactttagcttgcttatattggtgatggaagctaattataatccgacttaacacctctacacgtcaaaagatgtatccaataaccaacttttcatgctattaatgaacaaaattagcttgtaacgtatatacttgtgttgtttgttcaagtagtaccgaaatgctatcttctgccaaacctttctaatagaatgcacaaacaattaatagtaccactttgtctttagaaggaattccatgttgatcatttaacaaaaataggaacatctctcctaaaaacacttacaatagtatagatgaattatagtcaatttagattgccgcgcttacaattagttctcaggaaacactatgctagataacgggaggccatcatcactttagtcttattttcgtcaccatcatcatcatcatcatcagaccttgtagagaccttgtagagacagtacatgttgtactctgccttgtctctaatctacgttaatcagcagaaatcaaacttgacactgcctaaagacaatggcacaatagttgttgcgaaaacccctaagattttccagaacttgtaaatatgcatgtgaaatttgtgtgtggatgtagcagctagctagctccacctatcttccacttccacatctcccccataggattatttgctggatccaccagaatccggcacagaaatacatgcaatgaggagtgaaacgttacaacacctcccttataaataccctaaccccacacaagaaacccctcctccatattacaatcaagagaggaaaaaaaaacagagagagaaagatcaagagcatataatctatatatacacacaggcacgtcgcgagtaaatttcacaaaactacatagactacgtggatccgatactccgatcccgacccggccatgagaaggcaaggaggcaactgcgaggtcaactcctccatcgccctcctccaggagaggttcaggaacctgcagaaggtgagggagatgagggaggggagggagcagctgctgcagacgccgccgtcgccgacggcgacggcgacggcgatagccggtgcaactaccactggtgctgctgcgtcatcgtccggcggcgagcagccgaggtggttctcgcacccggagctggtccggccgtcgtcgaggccggcggcagcacagcgagccaccgccgacgacgatgctgccgccgttcgtcagccgccggcggtgagcgttggcagggcggcagccatggttttgcagagctcggggtgtaggagcgatgtggaggtggacacctcgcttcacttgtgaagaagtgaaaattaagtagatagctagtagtagctagatgcttatttagctcggccgaattaatcattttttcccccctttgatccttctagttcttgtttttctcttgatcgatcacatcttgtatgcgctcgtggatgctgtcgaatttgaattaatttggttctagttcatgttgattagatgtttagatgagggagtgtctaaggtgttgtaaaattaaatttctcaaaaagatctactatacatactaagtactaattaactacctcagatcaatcactattttgggataaaagattctttttgggtttttttggggagagggccagaaaattcggggaaactaaaattgaatttgggatatatttttgctgaatttgaacaattctttgcttcaaaatttgttttttttttccagatgtacatactaccggaactcatatactctctctgtacttaaatatttgacgtcattgacttttttaaacatgttgaccgttcgtcttattaaaaaaatttaattcattattaaatcttttcctatcatttgatatattgctaaatatgtttttatgtatacacatagttttacatatttcacaaaagtttttgaataagacaaacagtcaaacatattttaaaaaagtcaacagcgtcaaatatttagggacggagggagtatattaatacacccgaagttgtggattgaaatcgtggaccctagctacatcataaatgttattacctctgtttttaagtttttgtcactgaacatgcattattcaattgttaattttgacccctctatttgcatttgcagaaggttcatgtatatttaaaatatgccatatacaatgacattgtatattatcctacagtagagaaccccggatttttatcctatgtgtgcccacgcaaacctcaacatgcaaattgaatccactactatagaaaagggaataggtgccggttgagaaccagtgtgtcagatttcctagctgacacccagtaggcggcacctttgagaggactcaaaggtgcctgttcctaaaccggcaccgttgaggtttcagaaatgcaaaagaaaagctaactcaatgcatcggctcgaatcgatccgatgcattgagcagctcccatcaccggtatccaagaacacatgaacagaccgaacaaacaagaacatcaagaacaccatgaacacatgaacatcaagaactaaagtcttgtcctctatgccggccatcacctcaccctcctcaccggccttctccaccatcaccgccgtcgccagatgaaaaggaggagaggaggggtgagcctctttctctaccaccactgtcgtgggacgccactgacaccacagtcgcccgaggatccgccacaggaagctagatctgtcgtggtcgccgctggatccgtcatgggaagccaccgacgccgccagatctaccgatgcccatccttgctcaccacccatccgtggtctccgtcgcgccactccattggatccacccagccgccggcgccgctc

SEQ ID NO: 90649 - DNA, 1175 bp, Oryza sativa
cccgccggcatcccgtccgggcctggagctttcaggtcaccaatggcatctagggcttctttaacttcttctcttgtaaactctgcccggagcgactcattcatggcccccgatactttcctatccaccacatccaggaggttctgcgagttttgacccccatttgaggtaaatagttgtttgaagaattcgattatcatcgctcttttgtcttcctccctttccacccaggaaccatcctctcttcttagcttgtttatcctatttcatcttctcccctcagaacagctggcgtgaaagaatgacgtgtttcgatcccccttattgagccaattggtatgagctctttgcttccaatagatatcaacctgttgctcaagcttttccaacctataacgaagcacttcctctcggacaacttggtccctgcttattggttgacgacggcaggtttccagctcctttttcactttcttcaatcgtttttccagatccccaagaacatttgagctccagctcgataggccagccgccacccccgccaaggatgcatggaccagtagtccctgaagaccagccgacacatcccatgcttctttcaccacttccttgaatttctcctcttctagccaggctgcctcgaaccgaaaatcattatggccatttcttcctcttacgcccttgttcttcccttccagctcgataataaccggcctgtgatcagagtgacgcgggtcgccgtttatcactcttgcagctggaaacattgctctccattcgggattggcgaccgccctatcaagccattccctgatatacccttcctgcgagtgactgtggtttctccaggtaaaagcatcaccctcaaatcccaagtcatctaggccacagtctgtcagagcgtgccggaactcatccatcgcagattgagccttcatccttccacattgtttctcatgggagaacaaaatctcattaaaatcccccgccatcaaccaaggagttgttgggttgtctatcagccctctcattgtggtccaggttctatgctttgtttcagaatgtgcatctccatacaaacctgtgaaacgccacattgtcccccagcatctcttacttctgtgtcgatgtgatatttggagaagctccgaactaccacatcaacccccctcctc

SEQ ID NO: 90650 - DNA, 1002 bp, Oryza sativa
caagtcccaggtacttgccgactttgtagccgattggactatgcctgataacaggtcagacaaccaagtcgacaacgaaacgtggacaatggcgttcgacggcgcactcaacaaccaaggagcaggggcaggattcatcttgacatcaccttcgggagatcaattcaagcatgcaattcacctcaacttcagggcgaccaataacacagccgagtacgaaggactgctcgccgggataaaagccgcagctgcactcggagttaggcgactaattgtgaaaggggattccgaactagtcgcgaaccaggtgcataaagattacaagtgctctagccccgagttatccaagtatctcgcagaagtcaggaagttggaaaaaatgttcaatgggatcgaggtccgacatgtataccgcaaaggcaacatcgaaccggatgatctagtacggcgtgcatccagacgagagccacttgaaccgggcacctttctggacgtcctgaccaggccatcagtgaaagaggcaagtggcgaagatagcccggtcgcccctaacatcagctagggggctacagaggcagagcgcgccgttgccgacatcgagacctcagagttgcccgaaccaatataatctttgttttctgcctgcttgatgtcgtattacgtagatcctcgtaccagcgtaccccaataccctctatatccggtctacagttgcttaaagttgtagtttttgtgttttcagtccgtgtggggatgggaaattaaagatctataggtgtcttgatttagcactttcggtactaagtaccgacatctatttatctttctgtagtagtgtcatactgctgactcgatattattgtttttggtgggtctagacaaactgaaacattttcatgtctttctcaagcatgaggtcactagacacagcagttttacattaatttcacataaaccagttcttcattttccacgaaacccagcaaatcacccattttcctg

SEQ ID NO: 90651 - DNA, 2939 bp, Oryza sativa
atatagagcatttaatggaattggactgtattataacatattgttaatgtggctgattcatgaatgatctgaaccttcaactcttgtgacctactaaccagattgtctacttgactctaaatacttcagaggattgcatgatattggcatatctatatgttaggttggatttattttctgctactttgatgtaatggggattggcatctatcttggcattgtccaattagtatgtagccaccgagctatcttaactagaacaacaataggtctcgtcagtcttactgccacatagtactgtaggacttgctagccatactattatacgtccaacttgattccaataactcaaagtcatgcttaagtcgagctttttcttgaagaaattacagagctgtccttttgccctgccaattgtcaaatgccaataactcaggtgtgttgattcctttgcagaacatgttaaattgagcttaaatgaggctaaagtagaaaaaaaaactatatttacatctcttaagaaataacttcctacggaatcttcttgtatcaaataatgctattaatttcacagttttgtattgcctaatcagagttaattatcctttttttttctgcaactgtttttgacatttcatttattaaagagaagcaccttctccatgtttctaatgccatttttggtttgtattgtgattatctattttcttgacttacaatgtcatgattcatagcatgttgatctttaaccattacaaattcctattgattgtaccttttcgttttcaatatatttagctatgcctatgtgacttgtgtattgtcattaatgggctgaatgtacagcagaataacgccttgagcttcaatcacgggatgatatttagtttgtctgcttcccttggaatagttgtaattttggtagttataactattttcaaaagagggaagcaagcaaatgaactgtgtcagcatgagaaactcctccagacaccgagtgttaagataagtcgaaaatggtcaaagagagccctgcttcttggtgtcttagttgggctttgtagttctgtctggatattttcaagcatgcatgctgatgttgttgctagaagaattgagaatcttgaaaatatgtgtgatgagagagctaggatgctacaagatcagttcaatgtaagcatgaaccatgtgcatgcattggctattttagtctcaacttttcaccatgggaagaatccttctgctattgatcaggtttgctttctttggatacatctttcttaattgcaagggtgattcaacaaacttttaatattattaaaatttttttgataatttaataatttaatcaggtttctaaaaatgcattgtaaaagaaattagctgtgaaagttgtattttgaaggccgtgtgatcaaaatggtatgtttttgtgactgactggaaggagtataaaatctgattagccattagcaatttgtttgtccaaagaaaaatgtttagaataggtgtctccattcaaaactgcttataccatgataagtcactgggaaaaaaacatcattatagctgaaacaggaggccaggaggggatgcacagtttttcaaagatttatgttatttaaaagaaaacatcttgttattttctatcctattaatactgtgcattttttcaagattatgagatcttgttatcattgacatttgacagaaaacatttgaggatttcacggctaggacaacatttgaaaggccattgatgagtggtgttgcctatgctttgaaggtgctgcacagcgaaagggagttgtttgagcaaaagcttggatggaagattaagaaaatggagaccgaagatcaatcccttgttcatgactacaatcctgaaaagcttcagccttcaccagttcaagatgagtatgcacctgttattttctcccaggaaactgtaaagcacattatatcagttgacatgatgtctgggaaggtgagctactatatctgcaagcccttgtgtatatatatttatttatttctgaataggataaacttatttaacttctgattagaccttcattttttttttcaaattgtgaaatgagtaattcagaatctaataacgtcttactttaaaaggatgggtgcatgaggtattattctttacatggcagttccatatcccaaattagaaatccgactcacagaggagtccctattctagtataactacaaactatatgtagtctcagacagacagcagtcccataacttcccctttatcattttgatttgctccatggcactagcctgccttggcccttcaacctagtcttgctacacagactctaaccactttgtcctgtatgagccatatacaacactgagcacaagcgaagcccatcccattggacatggaatctgctgttgctgtgttgcaatgttgctgctgaggcatattgccaatctttgtgtggactctgaggaggccttcatgctgaaccggatggtgacatggatgagcgaactcactatcgaatgtaagtgagacacaaacatagtggctgtccacagtggcagcgataggaaggaagaagctggcatggagagtgagggaggcagtagcgagtgccaaactctgcgagagatgagggtcatgaacaagaggcagcgaagtacaagcaaaggccgcgtaaaaggtttgattagttatgttggatccatctcagtccaaacaaaatctgtagaagtggtttgatctgagttggttcagcatgattagccgtcttgcagcagactgtgaacagctctggaccctggcagaccatgtatacaaacctaaagaacatgtttgagttttattactaactttattttagacaagggaagtgtaaactcctggcctttgcatcagctagggatgcacacaaccattacattat

SEQ ID NO: 90652 - DNA, 2014 bp, Oryza sativa
tgcagccctgacactatgatcttgatttcaggaagatcgtgataatatattgcgctcacgggcaacaggcaaaggggccctaacagcccctttcccacttcttaaatctaatcaccttggtgtggtgctaacgttcactgtgtataagtatgatcttcctccagatgcaactccagaggagcgtattgaagctacgctggggtaatatctgtttcctaataaatgtcaagttgaactacacacttatatttatttctttttaagtttgagagagttttctatcaaaagaactttgagagaattgaccatagatttgttgttaacacttgacagttatcttggtgcctcatttgatgttccgtctctggtggagagactcctggagcaacttgctagcaaacaaaagatagttgttaggctgtatgacatcacaaatcatacttatcctactaaaatgtatgattcggatgttattgcatctgatgatctgcatattagtaatattgatttcggggacccgacacgcaaacacgtaatgcattgcaggtacttctttcattgtgcttgggattatacttttgtacttgaaaataagctcactcaatccattttcatattttttatgtcagattcaagcatgcaccttcactgccatggtctgcaattatgatatcttcagcagtagctataattgttttgcttgttggctatattatctatgctactctgaattctcttgaagaggcagaagataattatacgacaatgagagatttaaaaggacgagctgaagctgcagatgttgctaagtcccaggtccttctatctctagcagtgttcttatcttttgctatgtttctttagtctcctccatgattgctttccttcttctccttatccgctaagtagatctttgtttaccttgcagtttctagcaactgtttcacatgagattagaactccaatgaatggtgtactaggtttgtcctttatactttgtttttaattattcttttctatcacattgataccttctgtattatcgtcagaagacaatgctaaatgagttatgagagtggatttctacctgaaccaggtatgctacagatgctcatggatacggaacttgatacaactcagcgggattttgtagttacagctcaagaaagtggaaagtcattgataaacttaataaatgaagtacttgatctcgctaagatagaatcaggcaaaattgagctggaggcggtgcgatttgatgtccgtgatattcttgacaatgtggtatctttgttttctgaaaaatcatgggctaagggcatagaggtgagtcgtaatctatacccattggactctaagcttttcattcaacgggatgttaggacctgaaatatgttgtttttgcgagggtagttggctgtacttgtatctgatcaagttccagatgttctgatcggggacccgtggcggtttcggcaaatcattacaaatcttgtagggaattctatgaaggtcagttttaaatctagattggctaccataattcctctgatcttcaatttattgttatactctggagaacattgttgttgtgggttccttattctgtcatttgcatacatctatatgctgtgatgctttcatataacagcagtagccagtaggagaaagtatgatccagtactcgctgttttgatatttatacaagtgaaagctcaaactggatttccttatgtagattacaaacatggcagttgctttggttagaacaaaaaagtagagttctgtctattatgcaataatctttcactgatataatcttttccaaatatggcttcctgtaaatacagtttactgaacaaggtcatatcttcattcgagtgcatttaattgaggaagtgaagagaaaaatggaagctctggatgacacttctcctgaaaacatagaagttacagcgaattccaaaaatacgatgccatataatactctaagtgggcttgaagtagcaaataa

SEQ ID NO: 90653 - DNA, 1384 bp, Oryza sativa
atttctttttcgggtattaacgacatcataaatgttggataaatatttgttaacttgagttttattgtgaagccatcataaatatgctgttatgctttcaatattcataaaactattattatgtattattttctgacactgttgcattttatgtgttcaagtgtaaaaagcagtctaaatatggtgcttgttgacaaagaagcttggggcgaggactcaggcttggcatttttccggtgtcttatagatcttcggctgaagggcacactcaagtcttggcaaaccatgccaaagttctttcttttggcaggttcaataactcctgctgactctgattgtttgaggttggcggggtattctaatagcataagaaaaccccttcgtcttagtactgttgctgcttgtcttagtaaagcactaggggttggacttacaggccgacgaagtagagataattctttggttcttcgaagtgtactaacaggaaaaaacattttagttgtggacgacaatgctgttaatcgcatagttgcagctggtgctttgaagaaatatggagctatagttacctgtgtggacagtggaaaggaggcaatttctaggctccagccacctcataaatttgatgcttgttttatggatgttcagatgcctgagatggatgggtaatcttccttcccatttgttaaaattcatctaatgatgccttctaaagacattattttgtgttacgtgcttcactgtgttataagatgaattagtaacatatccttattgcttaaatatctcttgtagtttcttcaaatggtttcatattgaaataggtcgcctttttttctttcacaattgcagtcttgagctagaattctttttttttattattgtgtccattgtaatgaacgacttcataagtctatatatggattgttatgaactttgaaataaccagaaaacttactacatgtagaacatcgtacattctttataacaagtgtcttctgcaattggatcaactgaactgcttcctttttttttttttgcaggtttgaagctactagattagttcgttctgtagaaagtaaaatcaatgatacgatccaggcaggtgaagtgtcttccgagatctatggaaataaggcccattggcatgtacctatattagccatgacagcggatgtaattcaagcaacttttgagggatgtatggaatgtggaatggatggatatgtggcaaagccatttgaagaacagcaactttactctgcagttgctcatttcctagaggctgatgcaacagatccattgacctaggagatttagtttgctagtggccacagtgattcagggttctctgatgcagcatctgctaaaaacccatttggag

SEQ ID NO: 90654 - DNA, 1875 bp, Oryza sativa
aggtaggtaggaaaaatgaatggtggatggttgtgattggttgggaagagaatgttagtggagaagttgttatattttgggacaaattctaatggctaaaagttattatattttgggacggagggagtaataacctgacttttagttctttttcttgctggttaatacacataattattttcaatattcatttgatcattaagatgcttcatctgaaattcctgcttctcaaatatatatgatagctctcagggaggtctaacatcaaatttagaacatcccacaagtttttggcatctgaaaatggatgatagaaatattttggctattggatattatacttgttttgctttcttttgaataattggatgctatgacccttcttgtagaatacttggccctggattccggaaccattaagttcagcctacgctagcaatcaaaattttgtttcatctgttaattgttatcttgtttcgtctgttaattgttattccctccgatcaaaattatctgtcgtttccaacagcaaaacagaactactagcaggacatttctactgtctgaaacgacgagtatttccgatcggagggagtgtcttgtttcatctcttaattgttatcttgtgtgtgttctacagacaattggatgaaatctatttcaacatcacgccttcagccatgtgcttaaggggaaactttgaccatttttacccagtggaaatcaatgagggacatacattgaactgacatagcctccttcatgctgttccagtgtagtggctgacaagatgacatcaatggcgttcttgttgtacagctaatatagattatgagaaggctaatgctcctgtttattctgtattcttgagtgtacatatgaaatggcaagaaaatagtgagagttggaggatttgtctggtggcttgaagaatgtaaataggaatgttcatatccatcttttctgaggtctggttatgtggggtgtaagttgtacatatgttctcttgtagaaatgtaattgattattagattacggcaatgttccaaaaaaagtatatatattatgcttccaaatccttgcttgttgagtgccctgtaattttcatttcaaatagaacaaaatgcaaattgtccggaagatccaaattgtacacttcttttattgaacatttgggagcatatgttggcaatggctgtggaatatgtttatatatctttgaaccttttcagagagaattttgaaaatctgtggtctagtgaagcaaaactcaagcttgtagttttgttatgaaattggtacatcaaaatcacatctagggttctctttgtaaatttaagggattttggacagataaagtgtcccatccatccaaagtcccactttaggagggagggagtatattgttctaccatgcaaacaagatgtcgatggcatggccaaaagctttattatttttagaaaaaaaagtccagaactctaaattacaccaaaacattggagaccctccctaaacagcacactctagaacgaagaataaataaataaattgcttaaagcctactccatcctaaaatacaacaacctacgactactatctatattcgtagtactatgatatattctctctagtcgttattatattttagaatggaggtaatataagaaaatttatttgtgcacttatcctcatcaagttttagaaaagaaagcgaagtgagagtagctcgagtggttacgttctttgtattagaaccaacccacccggattcaaatacattcaacacgggcagggccggccctgacagggggcgagcagtgcagccgcactgggccccccagatcgtaggggccccaccccaccccccgcgtagc

SEQ ID NO: 90655 - DNA, 2426 bp, Oryza sativa
taagcccattttagggtctcttctctcagttacacaatagtttgtttcgccatccaaattcacgggatctccgatcacaatggacaggtttccatcattgtgcaactctaagtgggtctcaagcccatctccctcgatgcatagtctatcacattacgtggtagccccttggtaaactgatctgccaaatttttagccatctagatatagtccaatgctatcactccggagtttttctgctttctgacagacttcagtcttcttttaacatgcctggatgacttcatattgtccttcgaactgttcactttaataatcactgtttgattatcacagttcatcaggattgcgggtactggtttttcaaccaccggcaagtccatcaggagctcacgaagccattcggcctcaactgtggcagtatctaaagctgtgagttctgcttccattgttgaccttgttaagatggtctatttgcaagacttccaggaaacagcaccacctccaagtgtgaacacatacccacttgtggcctttatctcatcagcatcagatatccagtttgaatcactatagccctccagcacttttgggtacccggcgtagtgaattccatagctcattgtcccttttagatagcgcattactctttcaagagcatgccaatgatcatctcccggatttgaaacaaactagctcaacttgctcacagcaaatgagatgtcaggcctcgttgcactagctaagtacatcaatgaaccaatgatctgggagtatctcaattgatcccttgctattcttcggtttttccttaatagcacactaggatcataaggagtaggagctgccttgcagtcactataaccaaagcgactcaagaccttgtccacatagtgagattgcacaagtgtaatcccaccctcatctcctctcagtagtttaatgttaagaataacatcagccactctcaaatccgtcatttcaaagcttttggacaaaaagtccttgacctcctcaatcacattgaggctggtcccaaagatcaatatgtcatcgacatataaacacaagatcactccctctcccccaccacaacgatagtacacacatttgtcagcttcgttcacaacaaagccagcagatgtaagtgtattgtcaaacttctcatgccattgcttaggcgcttgtttgagaccatacaaagacttcaacagcttgcacaccattccctcctgactttctagtacatacccatctggttgatccatatagatctcctcctccaactctccattgaggaaagctgtcttaacatccatctgatggatgagtagaccatgagaggctgccagagcgagtagtactcgaatcgtggtcaagcgagcaaccggtgaataagtgtcgaaaaaatcctcgccttctttttgggtataacccttggccacaagccttgccttgtacttttcaattgtaccatcaggcctaagttttttcttgaaaacccatttgcatcctacaggcttgcacccatatggacgctcgacgacttcccaagtaccattagacataattgagtccatctcactgcgtaccgcttccttccaatagtcagtgtcaggagatgaatatgcctcttcaatggttcttggagtatcatccacaagatatacaatgtagtcatctccaaaagactttgcagtcctttgtctcttactctttcgagttgctacaatgttatcctcctcaggattttcctcaagcgtttgatcaatgtgttatatcgacacaaagtgctcaggggataaaataggttcttgactagaagtgctaggtgcatttttcataggaaattcattctcaaaaaatgtggcatctctggactcagtaattgtaccaacacgcatgtcgggtactccagaatttactattaagaacctatatcccacactgtggatagcataactaaggaacacacaatctatggtccttggtccaagtttacactttttgactataggtacatttaccttggccaaacagccccatgtgcgcaggtgagagagatttaatttcttcctttcctattcctcgaatggtgttacttccttatgcttagtaggaattctattcaggacatgacacgcaatcaatattgcctcaccccaccattccttggaaagtcctacagtgtctaacatggcattcaccatctcagttagagtgcggttctttctttcggctaccccgtttgactggggtgaatagggaggcgtcctctcatgaataattccatactcttcgcagaaagaagtaaactcgttggaaaaatactctccacccctatcagatcttaaccgtttgattttcctttccagttggttttctacctcagccttatagatcttaaagtaatgtaatgcttcatc

SEQ ID NO: 90656 - DNA, 640 bp, Oryza sativa
tgtagatcatgcgtcagaggcctaacttgtcgccatcgtacacatatcaacctaagcaatcatatgtcccttatccattggtgtggagaatattcatgcatgtgtaaccccctgcatactgtacatgaaagagcacgcgtagttggttaaatgtccaactcgcggtgctagctggttcaaatcatgcagcaatacttgcctacaacaggatgacacaattgtagagaataagagaaagatcccgcagcgcgtaatgtggtaccgtcgtgtgaaagcccgcatccaccggtcgtactcgcaccctagagatagcgagactaatgcaatggcttcaagaagggcgcaagaagagttggtcgcttcgacacacatcggatgctcatcagtggttggattttgatgccaaggacacataatttgctatagacccacgtcatattagtatttgcagtaagtactgatgccattcatccttttgtagacatcatcagttcccactatgtcttggccagttcttctatccatgtacaatctcccgacttggcttggccagaaaagaaaaaacatacttgtatgtatcctgaggcaaggacccccacagcttggtatagacattgatgtatttttcaaaccgctgttg

SEQ ID NO: 90657 - DNA, 670 bp, Oryza sativa
attgacgtacgcttaggtggcggtatagggacgtatacagcacatccaaatttgcgcagatgggaaatatttggtgcatatccacgtgtaagctgcataggggatacaacattgtatgcagtaggtctaatttgaagtaacgcagctgcatgcaaaacagcgtgtccccaacatgtagttggtaggttgctatgtagtagcaatggcctagcgataagcttaatcctcttaattaatgattcggcgagaccattctgagtgtggacgtgtggtacagaatgttccactttaattcccaaagccatgcaatattcattaaataccttagaggtaaactccatggcattgtccattctaatggattgtatccggttatctgggaaactggctctcaactggattatttgggaaataagccgcgcaaaagcgtggtttctagtagaaagtaagcaaacagtgctccatcgagttgatgcatcaattaataccataaaataccggaatgatccggacattggattaattggtccacatatgtctccctgtattcgtccggattaattggtccacatatgtctccctgtattcgttgcaagaatactggtgattcggcattcacctttaaattagagggtctaacgattaatttccctgttgcacaatcagtgca

SEQ ID NO: 90658 - DNA, 1168 bp, Oryza sativa
tgacattcatgcattctatagtactccacaaacacaagctgtaagtggaaaactctaaaggtttacattaaatctatgtgtgctattaattgtgtttcagttacacatacatattaaaatacaataccttgttacaagcatgttaactgtttattttaatttgttttaagtatcccaacaaataagagttgcagatacatctgagtttatgctgattttcattacctatgcatagtattgtttttctctcagacaacttgaactgtcggacgtacaatgttgaaatgcaccaaatgatttgattgtttataagcctataataatggcatgaacaaaatttgtgatattataatgattcaggatgtaatgactacaacgaatacaatagaccagcaggccgaataatgcatcatgcagcagtccaagtacaagaaatggtggaactactcggaaaataaataatggtgtggtttgatgtctattgtgtacattcacgtcaaaagaaaatgtctattgtgtatattgctggcaatcgtcatcagaacgaagggcatgtgatgttaccgtgctatagcacatttgtttgtttttgtaaaacaatatgttttaattgctctttgttatatatgtactgtttgattgtgaactatggatcataacttatatgtctgatccttggaataaagaaatttgtttcagaaaaagaggatagttatgtaccgtaaataatattttattttctggtgaaatgcactatgggatgagtcactcaattgactagcaacttgtccatgctaacgctacgatagtatttaactaaataataaaaagaatgtgtatgttttggcaatcaagcataaaataacatcataccatttccatatttcgaaattatgtaattcttaatgtacaacttcacaataagtgcatagacaaaaaaaaaaaagtccaaaccattcatgaccatccaatatttgatctacatcccttttacaagataattcatattatttttccttatatgcctgccaccaaaaagaattttccgtctattctatcctattcacatgacccagtcaccattaggagcaacactgttttttttttcttttttgcaaaaaagagcaaatccatatttctctctcccatatatatggagttaccgatc

SEQ ID NO: 90659 - DNA, 2831 bp, Oryza sativa
attcctgcagcccagcggcgagcttgtggatcgagggctccggcgatttcacctcatcctcttggaattggctgggaacccttacgattggagggggcgtcaaatgacgcttcaccttcataggtggagggctacgggactccgctgccccctccttctccgatgccatcaaaagccggagtaaacccttaccatacccaccgccggtagttcgcactccctgaatacggaatcgctcctccttcggagtggatggagtagcggtgggtgtggtgtacttgtggagcacctcatcccttgccttggtgaacagggtgcccacatagcactcggcgggagacggcgcggccttcccatcatcttgaaaaaggcgtcgtgccttcaagagaccgagctctcccgttgtcggccgtcacgcaggcgaatccccctggatttttattcttgtaacatggcgaggggagagggatcgcactgccgaacggggggccaattggggccgagaagggttctgccgaacccctggttcggtcgaaccagggagctcgccgacgggctccagattcacaggggaacccggcactgttgcgaggggctgcgcccatagtgtgttcaccccttccatcgtgtaatgctccaccgggatcaattgatttgccagtgtcggctctccatcaaaattgtaggtggaattggaggaggagccaatgaatgggattagggatttgccagccattagtgggtatgagtggaaattcgaggaattgggttgaattggagaggggagtgtgcaaatgtggaggaaaggaggaagaagaagtgttctggtgtgatccgaacgttctacctccacacgcgcatctaaacagactagggacgagcgggggagactagcattcaaattcggggccgatcgggcactgccctggttccctggtgagtccggcaggcccccaattttcttcctaggcccactaaaacctattctaagcacaataatgacaactatacagggttttaagcatgcaatagatgagatcattgttggtatttcttacgaccacagataaatccgcaagcgcacggaataccgctgtagcacttcaccttcgggtgacccctaaaggatatcgaactcagggaacatgtgtaatctacctaaggctaaggcatccaaggacaacaactgatgataggtaggctaggctagagaggactttctatatgttttaattatgcacgctaagcaaaggtaaattcctatctgttgcttcgggcaccgatccctgctagtctgctagcgtggttccggctatagctctatgatatatccgaacgtggaggattactgggacggaattcagggctgtcaccacctgccgcttacctctgacaaatccgtgggatacacaacaaacaaaggtaatctctaacctagacaccatgtctaagttattaattactactctaatacttgcgcgggaacttccttctctatccggagtcctagtaatagagcactttgtatgaatactaaacaatgaacccgcaaatatggaaatataacttactcagactaaataattaaataacaaaagaaaggaacacgagtgcttacttaatagaagaagttctccgtacctggagcagagtataccgacagctccggtactcctctcgaattcctcctatgaagctatactcgtcgaggtagaagtcggatgagcgccaaacttccaggcactcctccagagcttcccctcactctctaccttattctagtgtacaaaagatacaatagagcctcttgtaattcagctcaaagttgtgtgtcttggaatgagagtgagctcctccttttataggcaggtatgacggttacagcctatgcgaaatgtccaaaatgccccggaaccgccattgggacgtgatcaggagcgtacacatggaagatagcgatgaacggccacagaacaggttcggccgaactggttggttcagccgaacccaaaaagtgtcctcccgacctctccttcggccgggaggttgcttagtgggcccccaataacctgggctatgttttggcctaattctaaatggtttttattgacttattgcacgtctaatccgtgtaaacgcgtcctgaatacgtggaggtgcattttgtcacatgacgatgtgttttcttctcaaaataactgcatacacatatttcaccaacactagtggaaatgattagtaataatccctaccactaagttggaaaccatgttttaattcattatatgcaggtattgacggtcaaatattatgatttaaggaccgtcaacaacaccaccacacttaacctttgctcgtcccgagtgaaggctatggactctacaacagaattatgacttccttacttccttactaatagtcacgcaaacaaattattcaaagtcatacttgtatttgtggatgtttgtagtgtctaccatgcaatcctgagcaattgagaaatggaacaatcttcactaagtcaccctaacttttcatgaagaacaacatggggtttttcatataacacaaaattataactttgctttactcctccattgattctctcgatcactcaaagtgtatgattcctcacaaaggcatatgattgtgccttttcttttcctaccatctaataaggcttatgtggagctcagggtatggaaaagagtagaacattacttgcatcacatatatttcaaagtcaaataatggatccacagaaatacaagtcatactttctggtcaagaatgtgtatgtgtatgtgtatggttaatttgtgggtggaaaa

SEQ ID NO: 90660 - DNA, 2042 bp, Oryza sativa
aatgagtagccaagaacagaacgatgcttttctaacacggtgagaagacgttgagtctcgtcttcagagagcttgtcactgattatgacaggagcctctctgtcattgtgtaggaaggcatatcgtaggcctggaggtagaggtttaagctcaagcggaggtcgagatggtggttccatgattggcaggtcgagagtctcgccgggatccgcttcctctttgatgaaatcggggggacctcatcttccagaagggcctcgggagactcatgaggaggaactgcggtaacctcttccactgactcaatttctgggagagggtcggtcaaggtgatccttgcccgcgagaatggaattgagaattcattctctcctagtattattttgaggctaccaaatcggggtgtgttgatgataagttgctcaatgggcagcccgattaggatatcaaagtcttggatttcaaagacgtggaaatctaagatcgcctccctgttttcaaagcagacaggcacatcttgcacaatcccaaatccttcgatgatatttccgtttggatgcttgaagaatttgtttgtcggggtcactgccttgtcgattaaataagcgaatgcaaaagactcagagacgaggttggccccgacagttggactcagagacgaggtcgttcccttccaggtgacaaggaatgattcagggagcggtatttatccgaattacttcggatgaaagctctgcctcccttagccattcatcgctcattatggatgtcaactcccggacagtttctcgtaggaacccgagttccataggatcgggaggtgacaagggaacgggtggtttcctcttactaaaatagtttatggtattgccgtattcttcgtcaaaaccgtccctaaacagaattgcggcactatccagagtctgaatttcttcattctcgacggacggctgctcaggaaccttctcatcaaccgagctagcaaaagtggatggttcagcaagtggctcgatcgttagaggttcctctatcttggacacggatgcctccgactggggttcattggactgcgtcatgaaggaagtgttttctagaatgcgatccaaaatcgtttttccttgtgacggcattttgtgtatgaatgatcctccagcggttatgtccaaatagaatgcagactccttatccaaactcgtatggaaatgtgggagaagcacatactcgggtaaggacagggttggtccggactggactaaattagtgaatctggaccaagctgcaccgattgattcgtttttgatcaatgcagactccttatttctactcgaagggcagtaatacgggtaactgggaagaaggcaagatagaatctgtctcgcagcttttcccagctaccgtttacacatccaacggtagaggtgtaccattgctttgctctctcttgaagagaaaatgagaacaatttccaccgcacagtttcttgtctcatgccacgagtcttaaggcatgagcagacttgttcaaagtctcacagatgatggtagggattttctagatcaaagccaaaaaaggattttccctaaccatactaattagttcgggacgaatttcatagccagttgtataaatgggctccgatgaaggaggtggctcatagaattcgccccgaggagcagacagctcaaaaagaggttgctccatggtcgagaagagtttgacaggaatacttctctgggatagcaggggtgaaggtagaataacaaaaatgaaaaaggatacgaggatgaactaggttcggaaatgatcaacaaccgttcctcggcaacgacgccagaaatgcttgttggtatttgatacagttacggataaaatccgcaagcgcacggatataccgatgtagcacttcccctacggagtattccaagggtatcgaatccaagggaatgtgtgtggtcagatcttcctccggttcatccaaggacaccaagcaattgataggctaggatagagatgattcactagtgagaaacagtgtctaggga

SEQ ID NO: 90661 - DNA, 1003 bp, Oryza sativa
cccaatccggcagaaaagctttgtcaagttcaaatttttctagacaatcttcagtccagatgtatttcggtccagatagtgcagcggcctttttcgcatcatcccctcttagtagtgctctttccttgccccctctgaagacgcttaccatgtatttctccttgtgttcatcctttttcttggggtcgtggcttctgagcaccctaggcacttcggacttatctttgtccgtggcttcaacagtggtctcctcaacagggtcccttgtaggatttgggtcctcatggatggtcggttctgattcatcccattgcaatgttggtacgtcttctagctatacaccgatggatgaaagaacttgcacatctggtagagccacatctggttcttcgacatccggtacactttgcacctcatgttctttatgtggcaagtcaggtgtgtcaggccctttagttggcagaggtatcttagcctcttccgccttgtccttcaacgatcgatgcttaggaggtctcggtggttttccaggaccagcggcgacattgctaaatatgatattctttttgtgccatagaatgacaaggtcgaccacatccccaagtactgtgattccatcatgtgttgggatgtctaggtcgtacgactcgaaccctggattcacctcttgcggctgcactttcgcatatgcagattcaataaatccgccatggtagtttctgccaggaatagcaattcccttcgccgcctcaagtgtcctcctagcgcgtccaattgggatgtgcaaccggcaaggtttagtctcttgtaaatcctcgaacggatattctggctccggttctttgggatcctgtagtggaatagaatatttcatgcagaaatctatcatttcttgttcaaaccgcttacccccctcgtccctcaacttttccttgtaggcgtcatgtttcttttacgaggaggcgtcctgtttgaagccttctttccaactcagcttagagga

SEQ ID NO: 90662 - DNA, 3188 bp, Oryza sativa
tagtcgatttcccatatttcttcaataaacctaaagtatgtctgtttttcccctagtgaatctattgcttcaactcgaactccgctgttctgtgtaactgtcttagtatctcgggctcttgtactaaaggtgtatccattaatatcatatccctgctaggaatttacagtacttgattgaccacatgagaaccgcttcattgtaatttcctcggtggtatctccatcaggtaaatttagttcttgcaaccaatctacgaagcggcgcttgtgttcttttatcatccaatcatccgtgcgtcccttattttcagatctgagaagttcgaggtgttgatcgatgtaaggctcaacgatagcaagctgatgaagaacactgaagtgagcttctgaaacaaatttgtattcaaggtcgacgaatcttttcttccctaccgtccccctaccagtcaaccttccctcgtgtcgaggtacaggtattccgattgtctttccatcttttaggtaatcaatacaacactcgaccacctcttctgtattgtacccctcaaccattgatccctccggatgggcgcgattccatacatagcccttcaatacagccatgtaacgctcataggaccacatttgatgtagatacaacgggccgagggcaacaatttggggcacgatgtgaaccatgaggtgctccatcatattaaagaatgatggagggaaatacatttcaagttggcattggatctcatgtgggaatgtacgaagaagtgctaactcttcaggatcgatgactttctgggagatagcattgaaaaagtagcacatctttgtgatagcaatctttaaatgttcccgttgaatggcccgaatagcaactgcgagaaacacggtgagcaagacatgacagtcgtgtgaattataaccagataccgacaaatctttcattgacactagtcgtctgatgtttgatgagaaacctatgggcactttcacatcacagagagatttgaaaaatgccttcttctcatctggagttagtgtgaaataggctggaggaagataaactttgccagtcttttctccttcttgcgggtgtagctcctccctaattcccatttcgactaggtcggaccgtgattgcaaaccatccttagtttagttttgtgtggtatgtccaacaatgtaccaattacgttgtcgaatatattcttctcttgatgcataacatctttggcatgacgaatctccagatctttccagtacggcaggtacttaaagaatatagaatgcttcttgaatggggaagggggcttgcgatcttctttcttctgctttgccccctttgatgttttcttacgctttgtcccctttgattttttcttagtcccttttccaaacacgcattctattttctctgttgcctcacatactttatccccgggtgtaactttcggtgcagaatcattctcttcagtaccatcaaactctgctttcatcttgcgaaacttatgacccttgggtagaaactgccggtgcctcaagtaaacaagcttgttggaacctgggaggtacctatagtacgttccattcaagcatattcacacatccagttttacctttgatctgccttgaaactgaaaacatggcggggtaatcataaatggtaacgaaaatgatggccttcactgtgaagtgttgtcgtaagtactcatcccacactttcaacccctcatgccataaatctgccatatcttccaacagtggttcgagaaatacatcaatgtcaataccaggctgtcggggtccttgtatcaggatacatagaagtatatactttctcttctggccaagccaagttggaagattgtacatggtaagaagaactggccaagtactatgggaactgctcatgtctccaaaaggattaagtccatcagtacttagtgcaaatctaatattacgtgggtctttagcaaattctttgtactttgcatcgaaatttaaccactgatgagcatccgctgggtgtcggagcatcccgtccttcttgcgcccttcttgatgccatcgcattagttccgcatctcgagggtttgagtacaaccgcttgatgcggtctttcacaggaaggtaccacatcacaagctgcgggatttttctcttagtctctccgattgtgtcatcctcttctaggcaggtattgctgtttgatttgtaccggctagcaccgcaagttgggcatttaaccaacgaggcgtactcttttctgtacagtatgcagtggtttacacatgcatgaatcttctccacaccaagggataagggacatatgatttcttcgcttgatatgtgttcgatggcaacaagttaggcctcggaagcatgatctacaaaagttgtagaagactgtcgaagctactatcagaccatccaaatctcgccttcaacctcataagttcaagaactgaccgtaaaattgagaagtcactgtgacagccctttgactcatcatatagaatatcctttgttgtcttcttcaaagcttcgaaattatctaaacctctagccgacccaacaagcaactcaggttctacatggcataacaattcctccagatcaatattgtcttcagcacaaccatccgtgcaatccatgtcttcaacaaccggttcatattcttcttcaacgagtctaacttcatcattttcgccatgatgtgtccatataacgtaattctccataaatccacgagtgactaagtgctcatttaccttcgtcagattttcccacactttttcattcttacatttagcacatggacaataaatacccctcctattctccttctcaacgtactccttggcaatatcaataaatttagacacttgttccatatatggcgataaaaacatcggccaatgatacatccattcgagcctgtccatgtctctgcaaaatttatttaatcaaaaaaattaacaaatatatttgtaacaaatatctctgcaaaatttatattaataaaaaaatttaacaaacatgtaacacttttgaagttaacatattatatttaaccaactagaggatgggacgaccacatgatatcaaagattacacataaatccaacaagatcataatatacgaaattaaacataataattagtttcttcatgtcatgaagttttctctct

SEQ ID NO: 90663 - DNA, 2005 bp, Oryza sativa
  unsure (1)..(2005): unsure at all n locations
gtgtctcacactctgccctcattgtgaagaagaccatccaccagggaagtgtcccacccgcaaggtcacatgttttctgtgcgaaggtacaaaccatgtgtccaaggattgccaactcagtgtgttgttgaccaagaccgcagaaatccaacgaacaaccctacgattgtctcatcagctagtcagctccaacagcaacattgacgatatcatccacagcaccaatgctcttcctgctccacctgactctgcaataaatcatagcaataataccttcagcaccaaccattctctgcaccgacagcctcaacaaagaattgtcgtcgatggaagaagttgtgtctctccccgacctactccaggccgagcaacgggcaatcaacctcaggagggcgataccaagcagaagaccgtcatccgcttcaaccagcaatcagaagtaagtttctcccgtgaatgatagcaatatgcagtcctatcacatcatcaaagacccaatcaaggatgatgcagtcactagaacaatgccagctatatctctccagaatcaaaatgagcagtcacgtttgtggttttcagttcgctacttatcattgtgtaattgaaagtttgcagcaatcatgtaataaataaatatattcatgtccataaacagtgagtttgctatgtttatggatgattcatgttgaggatacaatgtaccgatgttaagcaccttccctttttatttaaggcagtgccttctattcatgtaataagggagaaatgtgtaatacatacaagttctatgaggattcttttggaagatgcggatatgtgatcatgtgtataattgtttactgataaagaagacctagggtctcatttcagaggaatcatattctaacctcgagttaataaccaacctattgatggaaaagaaaaccaattaaactgtgttggattaaaaagccaaaagggacttttgtttggactaagagtttcagatgtgtcttcttcggatcaaaggcaacaaccgttagtccaatttttgacaaaccacttcaggtttcaccgaaaggcagcaggccaaaggacctcgtcatccctagaagcgtccgcaacccacattaaagagtaccacctgttagagataggccgaaagatgattgataaaagagattggcaaagaggttctctagcaggaaagaagtaggccgaaaggtgattgataaaggataaacagaaacatgctctgcattgctcaaggaagacccctgatagtaattgccccgcaacagtcaccttgtcattgaggtaaaaaaaaatcatgagtaagcaagatgacctangtaaaagtgtttccatgataggcaaggagtgaaatcttcaactcggtatcagatgctatacggagtgaaaagtgcaggcaccggttaccaggcaatgttatgtcttgggagatgattcaatgggaaggaactcatcaaggtcgaaggtgtaaaggaatacatggaatgctaaatgatgacaagcatgatattcttatgatgacaagcatggtattctagtaatgacaaagctgatatcgacgcataatgtgaagtgggtaacttgtatgaggttgacgccaaagatatgaattatgagaatttttcgaactgaaaccccatcttcaagtgccgcaacccagtcaaagtcagctagaggtgcaaccagggacaagtcaggtgaagtgaagattccatctgccaatgggagctcatgccaagtagttcagcgcggagaagtccggttagaaatgtccgttcaagaagaggttgcagaagaagctgaactaagaagagaagacagcccaacctatcttcttgctagcctcctcgaatctcgaggacgagattcctgtaaggggggtggatttgtcacgttctgataaattcatcccgaaataaaaatcattccctaaaaggaataatagaattaattaaaattcgaaaagaaattgccaaacactaaaatacctaca

SEQ ID NO: 90664 - DNA, 2585 bp, Oryza sativa
tccttcctcccgcacctttttttttttccttccgcacttttttcgtgattggcccattagtaacaagattactgtggctttccgcctaagagtaaataagttacgaccacttccgtacttccaaattgatttagtaacaagattactgtgtctttcagcctaagagtaaatgagttactaacacttccacacttccaaattgatttcttctcttagtaaatgaattactcctaggttattttctgccctttccaatttggttcctcctttcagtaaataaattactctcttagtaaatgaattactcctaggttattttctgccctttccaatttggttcctcctttcagtaaataaattactctcagatcgttatcagctcttctcttagtaaataaattacttaggatattagtactcccaattggtttgcaaatcttctcttagtaaaataagttactcctgatactggagtaaatatattgcagattgcacaaggccgctggagtatttagtgacaaaacaaatgaaggtaaaaaattatgattcatattatcaacctaaccacaatttaataatttctttacaaacatcaattgtttgatccagtgtcggtgttacatcaacaatctgataatgcactcaatgatacattggcagaaaaacacaaaactaataaacaaaatcaaatcaacaccacccgctaatacatatgtcgataccgatcgatgccagcactaatatagcaatgtagatcagggccgacgacgctgattattaactgcaaaaggcagtaaatcctgagttcagctcacaagtagtaaatttctgatttcatctccatccccactagccagctgaagcctcatcccatcttgctggccttgccatggcaggcaaaagcaccacaagagaaagctccacccaatgaactgtacaaaatcaagagcagtatcaaaaagaattcgatggatcgacagattctacacaattgtagaacaaaatcaagaccctgatcaacatgaccatatgcagtgagcgcttcagaaaaatgaatccatatgctctgttgaaccacaaaattgcagaaaattcaatggattgacaggttgtatgcatttttacaagaaaatcaagaacctaatcaacgggaccatatgcattgagcagttgaggaaaacatgtatcgatctgctttgttgaaccacaaagataattgcttgagaaaaataaaaggagctaaaaaaatgcatagctcagctgcaacccaacgaaccttgcagctagcagacccatcatgctatccacagcttcctctgcccatgtgtgatctatgctgtcgtcgaggcgtggccatccacctggacaacatccttctgcctcgctggggttgcagcctcccccatgatcgtcagctgaggtgcagaaaactccacaaattcagagcattcctgaagtctatagatgaaaaatcaagtagaccaaaattgagaaatctgttcatcaacaaaaaaaaatcagaacatgaactacatctacagcagaaaaaagctcataggggactacaactggtttgttcaaccaaaatattcagcgaaaaactatgatcgaaaggatcatatgtagagagcagttcagagaaaatcaattgatatgctctgttgaaccacaaaatttcagtgaactgctattgaatcaagcttctagagttttcatttataaaaaatatcagagaacctgatgatgatgctattggcagttttccaaattttgcacacacaaatatatcactgaacaaatgaaattcagatgggagcacttttctgaatatattgcacaaacaattcatggttgaacaaatgaaaattaaaatgagagcatatggttcttcatgcgttgcaaaaaaaaaaaaaaaaaaacctggctatcaggactattcactcatgatgcttgatccagcaaaagcagccatcaccaaaaaataaataaattagaaaagcttgttaacctatcaattacagaaacctgtagatgcatagaagcctgaaaatttcagaatatcaatggatgttagtgttacacaaaccaaatccagatcacatagaactaacgaaccagccagaagtttggtaggattatagatggaagtctcatgaattctctgagagctaaatgcttccctgaagtgtttcaacagaaattaagatgctctccaagcttaggcagtcacaatagagaactgaaggaagaattcccgtggggacgagtcgagcggctgcggcgtacctggtcctcgaggtctatctgggtgggcttgcccttggcggccgggtcagagtagacgtccatcggcagacggcagcggccaagcagcgagctggtggaggacaaccacgatgacggcagcgcgcaggaagaagcgggaggaggaagaggaggagaggactgcaaggtggcctgccgcccgtgctctcctcccaccgccgccggtggatccgtgcgaggtcaggcgagggacgcccgccgccactggatccggacagaggacgaccgtcgtcaccgggttcgagcgggggacagccccg

SEQ ID NO: 90665 - DNA, 607 bp, Oryza sativa
tggaagtggaaacaataacaatgaagataacccaactcttgctcaagttctggctcaacagactcagttaatgaacatgatgatacagcagatgcagaaccagcttaaccaagggaacaacaatgctccaccgccgcagaacaagttagctgattttcttcgtgtgaggccacctaccttttctagcactaccaacccagtggaagcaggtgattggttgcacgctattgggaagaagttggaactgctccagtgcacggatcaggagaaagttgttttcgcttcacatcagttgcaaggacctgcatcagaatggtgggatcatttccgaatgaacagagcagaaggacaaccaatcacttgggcggacttcacggaagcattcaagaagacacacatacctacaggagttgtctctttgaagaagcgtgagttcagggcattgaagcaaaaggatcaaaccgtggcagagtatcttcatgagttcaatcgtctggcacgttatgctccagaagatgtgcgtactgacgaggaaaggcaggagaagttcttggaaggcttaaaggatgaactgtcagttacgttgatctctcatgactatgctgat

SEQ ID NO: 90666 - DNA, 627 bp, Oryza sativa
aaaagggagtagaaaattccgtagcagatcatttgtccaagctgcaaatcactaacatgtaggaacagccgatcaatgatttcttaagagatgacatgctgatgacggttcgcgattccaacctgtggtatgccaacatagtaaactacatggtatccaagtacgtaccaccaggggaaatcaatgaaaactgaagtatgaaagccgccgtcacatatgggatgagccatacctgtatcgggtctgctccgatggcttactacgaagatgtgtgccaactgaagaaggacttaagatcatagaacgatgccatgcctcaccctatggtggccattacggtgcattccgcacccaggccaagatttggcaaagtggcttcttctggaccaacgatgtacaaagacttaaaagaattcgtcagaagatgcacaagctgccaaaggcaaggaggaatcactgctcgccatgcaatgcccctcacatacaatttgtaagtcgagatattcgatgtttagggtatagacttcatgggacctttccctaagtctcgcaactgcgagtacattctggtggcagtcgactatgtctccaagtgggtagaggctatgtcgtgcagcgctgcggatg

SEQ ID NO: 90667 - DNA, 733 bp, Oryza sativa
aaccaaatgccaatcaataaaaagatgttgtatcgtttcattagaattatagaagcaacacttagtgctacctttccaccttctttttgcaagattatcttttgttagagtaacctcaatggaattctaagctcccaaaggaaatatttccttggaattactccgttaaacatgagagttctgtacatggagttgatggtaaatgtttcctttttattggctttccacacaaagacatcattttgttccgtaagttgagttgatataacttttgagaccaagttataccacgctgctaggttatcccctacaatagctcttctgaaagagacgtttaggggcaccttttccaacacttcggccaccattacattttttttcctaacttgattatacaacgaaggatacatcttatcaaaagaggaatcaccactccaacaatcctcccaaattctcaattgtgtgccattacctacttgaaaagcgccacaagaaagaaaagagttttattaacctccatcagccctgcccaaaaatgagaatcccctggttgttttcctacaagtgtaattgttttcttagccaagtatgttttttctaagtagcttttgccaaaccccatcctcattgataagcttatacaaccatttactcagcaaacgtttgttctgcacatttagattatgtattccaagacccccacaatccttaggtgtacaaatcacagggctgc

SEQ ID NO: 90668 - DNA, 605 bp, Oryza sativa
ttccagttccaaacatgtacgaagaaatactggtaagtaggggtgaaaacggtacggaaatttccgagaattccggcaaccgtttccggtttgcaccgaccgtttcaatcggtatcggtaattgcggtatcggaaatggaaacggtaatctctttcggaaatggtagcggaaatgatatggggttttttccgaccgttttgtcggtaactgttttttatcggtaatttccgtcaaatttccgacaaaattccgaagaaggaagtcggctaggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctccttctccccaccgatgccgcccctttctcctctctccttcccccaccgccgccctgcgcc

SEQ ID NO: 90669 - DNA, 2173 bp, Oryza sativa
tatggatttctagacaagcggacttccaacaaggcggagaaagatgcacgccttgaagccaagatccgggcgtcgatcagagtggagctgacctctgaattcgacgagaagctcgagtcgatgagggccaagattaggcaagagatccgagaagagcaacataacccgcaggccgccgctgctgctgcgcaagaagagttaggaagtcccaaccaaaagcgcagcagttgcgcatcaactgagttggcggaaaatccaacatcggtcgacagcgccatcaaccacataacggtaaaagtttcatccacaatgcatgaaaggcttaacgaatccatatgttatataatattctaaaaaaattgatgaatctatcgcaagaaccaacgagctgcaccctcacagttagggtgatgccgaccttcatggttccagcagccgagggacttgcgtacaagccgaccccagagacaagagtgcatggaccgcaacttagggccgactgtgcaaaagttcaagttgactcagtgaagcccgaatacgagctgttcctactgaagtatccgccgaacgacgaggtcctatcactaggaaatgcccgtggtaccttcatccaatggcccaaggacctcattgagataaggattacagcgagaccaaccactgcaccaagcggtcgtccgccaaggagacccacctttgctccttcagcccctatagctcaagatcgtcatgcacaatcttatgatgtgcagttgcagtatgacacggattttagggaggaccgtacagaggccgactgcaaggcgattcatgaacccctaccgatgaagaagagcaggaaggcacactcttccccttagagaattactctcgataaacccgatgcaaaggagagaggaagaggtggaaaggtgaaggcctcacttctggctccaaggaagctagatctgggcaaggggcatgaagagacttaggggaaagaggtcaagaagaaatatgtcgctccataggagttccaactaggcatgccattggttagagacgacgtgctagccacaatgggcaccacttgcaaggaccttcacgtatactacatggagaaatctaacgccaggaggtaaaatagagctaccgatatccttggagagcatgatggaaagccattccttggtccaacaaattatatcgtggtggactttaaggatctattcgacctctataggctccgagcggtggatacaagccttcttaagtgctactccttgtaagtattgtcacccaactcaatttggtaataacaatccgtttaactcgcttacaagatcgtttatcttgcgtgtaggttaagttggcagtggtgtcagaagaatgcaccagaagttgccttccttgatccacaagtggtcactttcacaaatctcgagaatgatcgtcaaggaatggtcaactacatctacgacaccttgtggtcccaccgagaaaaggagtacattatgtacgtctataatcaatagtaagtgtgttccctaaatatacacaacagcatgacacatatagctctagtatttaactttcactatattaatgccgcagtgcccattggatccttctggtcataacacctaagtggagtacatgccactacttgaactccagaattgataagcaggcatttgattggacccctattcaactagcgatagatgaagcgtggggccaatacgtgcaaagaggaggccttaggaagacaggacatgacaccctcatccaaaaaaaagacttctcgatgaagcaacaaataggtgaccagtgcggattctatgtgtgccacaacatgcgccttctgtacagagaaaaggtgaagaatttggctgaatttgaggtcgatgtcttaattgtgatatactaactacatcaaagtacatatatatgatcgatcaactaatctcaaattatgacaatgtagggcaaattgccaagtctctgcctaccagctttgaggaggttcgcgaagagatagccggcttcatcctctgcgaaataattaaccccaaaggaatgtttaggcttaaactaaaatgatgaacattgttgaacttttatatttaggcaatgatgaacattgattaagaccttgattatgtaactatgatatttatatttatgtatataa

SEQ ID NO: 90670 - DNA, 1887 bp, Oryza sativa
ccatgttagtatattgtcctaagttaatttcctgatatggatactattcattttttgttgaacgaccatgacagtttgtcataaagaactcggcaatcaggggtggtctctcaaaacaccagaagggcatagttagggggtattggctgcatgattgtatactatagagtgtaaattaaagatacataagtattaggatgaattctttttttattcttcctccatttagccgaggatttatttaatgagagtatcttagtttttcttcttcgtgtcgctctatccttgaattcattaacccctgcttagactctaacttatacaaataacataaattattagtatagtcttctcttatcaatttttccttgagattaaataaatatgataccttagaatatttccggatgaaatgctacaatagtatattcgtgcgcttacggataatatttgtaaccgtaatataccaggaatatttttgcaccactactgagaattatatttccagtaatgtcattaagaaataccaacaataatctactatgcttttggaaaattaggggtggagataaggatggggaaattagggcttgaggcttaagcttgggaccaaattcccattaaaatagggggctactatatactggtatcccgttgggatactgtcccaacggtatcgctcccagtccacctccctcagacacgagagcgtaggccaccatgggagcagcgcagacgaggctgacgccggtggcgcggacgcagccgccgccgccgagctctggcgtagaggacgcagctgccggcgacgagctccagcgtgaaggacgcggccgccggcaagctccggcgtggagcatggtcacatggacggcagataatcctgcgtggtgacagagacggcgccatcgacgagctccggcgtggggagtggacggcggaggatcctgcgtggtggtggcggcggcaccggcgacgagctccggtgtggaggacgcagacaccggctgaggcgtggacgatggacacggccgccggtgacgagctcccgacaaaggacgcggtcgttggcgacgagctccgatgtggaccgtggacgggagcggatgcagctgccggtgacgaggttcgggttcagtgtggagcgtcgacgggggaggacgcggccgccggcgacgatgcctcaacaccttgatgcccaacttctggtatctagtaggtatcatatgaatatgatacctcacaagtatcacccccgatacgtcgtagaaattacatgatacctgatagctatcacatgatacctcacgagtatcgcctgatacgtgataggaatcgtccgatatctgatacgtggtagaatcgcatgatacctggtaggtatcacccgataccagctagttattaggtgatacttataaggtatcatacgattcttaccacgtggaagatgatagttgcgaggtatcaagtgatacttgagtaggatcttgttaaacctgggaggtatgatgatcctccttagtatcatgtccggtttcaccaggtttcataggtgatactttgggaggatcatgtgacacctaggaggtatcataatcctcatctctatcatgtctagtatcatcaggttccacaaatgatatcctaagaggatccctcaaaagtatcattatgtgtgatatctgtgcagtaccgcatgacactacttaggtatcatgtatggtaacaagattctatgggtttcacaaatgatactttagtaagatcgtgtgatacttgcgtttctaccatatatcagatgatacttgcgaggtaccggatgatacctatcaggtatcatgcgattcttaccacgtggcgggtgatgcttgcgatgtatcaggt

SEQ ID NO: 90671 - DNA, 706 bp, Oryza sativa
ctgcagcccatacacatattagttcgagccaaccatctgaaataattcccagttcaatcacaccaccagaacaaactgaacatacaaatgaacatgtcactgagcaagataacagtgaagctcctcgaaggagtaagagacaaaggacagctaagtcttttggtgatgatttcactgtgtaccttgtggatgacactcctaagtcaatttcagaagcatatgcatctcctgatgcagactactggaaggaggctgtccgtagtgaaatggattctattatcgctaacgggacttgggaggtgacagagcgaccctatgggtgtaaacctgtgggatgcaagtgggtgttcaaaaagaagcttaggcctgacggtactattgaaatgtacaaggttcggcttgttgctaagggctatactcataaagaagacgaagatttctttgacacttactcacttgttgctagattgaccacaattcgtgtgctactttccctagcagcctcacatggtcttctcgttcatcaaatggacgttaagacagcttttcttaatggagagctggatgaggagatctatatggattagcctgatgggtttgtagttgaaggtcaagaaagcaaggtgtgcaaattgttgaagtctttttatggtctgaaacaagctcctaagcaatggcatgagaaatttgacaaaacattgacatc

SEQ ID NO: 90672 - DNA, 1381 bp, Oryza sativa
taatgaattcccatgtcataatccttaattaattccaaccatctcctttgtctcatgttcagatccggctgagtaaagatatactttaaactcttgtgatcggtatacacctctgtacgagtaccgaaaagataatgacgccaaatcttcaacgcacgaactactgcagctaattcaagatcatgagtagggtagttcttctcatgcggacgtaactgacgagatgcataggcaaccaccttcccatcttgcatcagaacacaacctaacccaagtttggatgcatcgcaatacacttggaatcccttctttggatcaggtaagatcaaaataggagctgatattaagcgattcttcaactcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaacggtctttggttgtttccagttggttacggattctacattactaggatcgacggcaactcctcctgctgagatgacgtgaccaaggaacttcacttcagacaaccaaaattcacacttgctaaacttagcatacagttgatgctctcgtagcttctccaatgcaaggcgaaggtgttcttcatgctcttctttggttcgggagtagataagaatatcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctgg

SEQ ID NO: 90673 - DNA, 1588 bp, Oryza sativa
ctgcagcccagaagcaactcgaaggcgaagacattgtcacccattagcaatggcggagacgttaaggccgatgaagtagaagtgctggtgatgatgtcagtgacaataatccgtcaatctgttgagaagatatcgaagctcgagcaatttccttgatgcgagcgtgtgcataacgaagattgatgcaatgccccttgatttataaagatggcagtagaacttggtgttatagctgttgtagatgcttcacttggaggaaagtagaggctgttgtacaattcattgaaactgagctgattggttgataactgtaaactcctggatatgtagattaaatctcgaactaccagctaaagtaaaatgtcggctctgaagcgaagacgaagataataactcccagagttgactcgttgattgattgattgcttcatcttgacataaaacttgtcgaattttgagtcttatatttgtatagcccccgactctttggtcagtcaagaaacaactgaacatagagtcgagaactgtagcttcttgtcgtcgagtagaattcttgaaaattggagaaccacttgtagtagtagattaacacgacgtcaaatttggtagtgcaagccgagatgtcgaggctcttgtagacgtcgtggttggtgaaataacgaagctcgtgaagtagaggcattatagtttgccggtgccaaagataataaagatgaagtcgctccaccatggtgacaaaattgcatagccgtgatgaagtaaacacgagtcggcggcaacagaagcaaaccggtagcgtagacgcgtagttgtgaagataaaaacaccagtcagcggcggcataaccagtcggcgacggaagaagtagaatgatgacaaaagcgaagacgtccttgaacggcggcaaaataggctagccatgaaagtgaagacaccataggcggcagtgaaggcaaaccggcgatgacgatgacgccagttaatgatgacgaagacgtgcaaccgtggaggtgaactagccagtcggcgtcaggcaaggcggccagaaataaagacgatgacgtccatcagtagtggtagtggtataaaccagctgtagaggcaagggcactagtcagcagtagacgagacgaccggcggtgaaaacgataaggccaatcaacactggcagaatcaggcagccgtggaagtgaagaaaccagtcagcagtagacatagacagtttgcgttgaagatgatgatgcctattagcgatggcggcgacgtagccagccgttaacacgatagcaccagttggcattatacgaggcggccggtcagtgaagatgtagacgttgaacaacggcggcataataggccaggcatgcaggcagagacaccagtcggtggcgacgaaggcaagccaatggtgaagtgatatatgcccaacaacggtggtatgaccaaccaaccgtgaaggcgagcacaccagtcggcggcggcgaaggcaaaccagtgttgaagacgtagacgcccaacaacagcgggacaataggccagccgtgcaggcggagacactagtcggcgacggcgaaggcaagctggtcgg

SEQ ID NO: 90674 - DNA, 1617 bp, Oryza sativa
agacctaagtctttttatctttctgtcaagttgattttcaacttctgccttataaattttaaaatagtctagagcttcgtctttcgttttcaacaagtacacatagaaaaatctagtagcatcatcaatcaaagtcatgaaatatcattttccaccctttgtcaacaccccattcatttcacaaagatcagaatgtaggagttctagtggtgccaagtttctttcctcggcagccttgtgaggcttgcgaggttgcttcgattgcacacaactatggcacttagaacctttgacaatggaaaacttagaaattaaacacatgctggaaagccgagacatcaatccaaaattaatatgcaataaacgtgagtgccaaacattagcctcatcatccacactgccacaaatatggttcacagacttattgtagaaatcagaaagggaaaagcggaataggcctctgcactcataacctttactaataaaatatccatgtttagacacgactactttattagactcaaaaactaacttaaatccgtctctagtcagacgggagccactaacaagattcctgttgatagaagggacatgttgcacgttcttcagctgtacgatctttcccgaagtaaactttagatctaccgtgccaacaccatgaacagaagcatgtgacccattccccaataggacggtggaaccccgtgcgacctgataagaagaaaacaatgagatgtcagcacaaacatgtacattggccccagtatcaacccaccaataagtagactgattaactaaaaaaacagtaggtaaattaccatacccgcttccatctccagtcttgccaatggtcacattagcatacttagaagtctgccctgcaggtgccttcatccccttgcgctgtggatacttcctagccagatgaccaagttggccacacacaaagcaagtcctctcatcttgattaggattgttattgttcttcttctgcttcttgaagttggtggtctgctgagctttgtattttcccttgctcttgttctgggccttgtgcacaatattggcactggactgcccaccatcgcccttagacgcggcatctttttcccgagctttctcctcaatatcaagagacgttatcaacccctcaacggagtattcctgtctcttatgtttgagtgcagtaccgaaacttctccaagatgaagttagtttcgcaataatgcacccgaccacaaatttgtcgggtaagacacacttaaggagttcaaattccttagccatggtttatatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcaaatacacctcgaccagacgatcgccaagaacgctaagaatgcatcccacaaagagagtagtggctttctcgaattgcttctgtggttcagcagtaagaactccttcaggtttgccagtactcacccagaagcatttcatagctgtcagccacagagtgaccctgatctggcatct

SEQ ID NO: 90675 - DNA, 3362 bp, Oryza sativa
  unsure (1)..(3362): unsure at all n locations
attcgcatgacatggaataaatttttttgtgtatttaggtgacatggtagatgaatactaatatatgaggtccacatgtcaatcaaacaaagaagatagtgggacgtcccactacctccacctcaccctctctacctctatctcctcgatctctccgccggtgagccaaagtcagtggggaggttggcgagcggggtagggaggctggcaaggggggcggagaggcctccccatgtaaatccaagtcatcaccgtcatcgtcaaccgtggtcaaattggacggtggtgaagagcttgggagaagaattaataagtggagccatcagagtagtgtgtggccgtgggtttgcttcggatggcgacggccatgtccctccccgccagtggcgacgacgacgtcgtcaatgagaaaaaggaggaggggaaggggaaggccttctgctcctgccggtggcgggcgtgtgtagttgcgcggcaagcaactgcagtagttgcacaagatctttctccggtttgacctcgacggcgacgggagcctcaccaagctagagcttggcgtgcttctccgctcgctcaagctccttcgcttgctcagcctccgcctagccgccgaggatgagatccatgccctcctcgccatcatggagctcggcgcattccttcactcactcctcctccgcccggctgccagggatgagatcaatgccttcatgtcggcatggagttcggcgcgctcctccgcttactcggcccctgtctggcaaaggtacatgctgaaatataaagtaattgcccgtctttcctcatcaatttaaacttttgggttgaattggtcgacgcatgtaactcaatgggatatcannnnnnnnnnnnnnnnnnnnnnnnnnnnnnnnnnnnnnnnnnaaataaaaattgcagcccacttctaataccatcgagttcgacgtgggttccgtcgagtttgatcgacgtgctcgcctccatactcacagaactcatcgtcgggccttgctgccccatcatcaccctcgaccaggcggaggtcaccgaggccttcagggcctttgactgcaagggcaacggcttcatctctgccattgagctcacacgctccatagctgacacggcgacaccgacagcctcatcatccttttatttgactgtgggtcccatcacccactgacatgtgggtcatagtattttttttcttatttgtttaactgatatgtgggccccacatattttgttttaaatttgtagttttcaattttgctcgttttattttttcgggatcaaactactacgtaagcgctacattaatgccacgtgggacaaagtcctcgtcaatcaaaatcagggagcaagaaatctcgtttgactggttttgtaagttgagagacgggatgaaactggtttttcggttcatggaccaaaatcagactaggacaaatttctagggaccaatgtatcatggaacgaccagggtttcaaaaaccgccgggggcccggttaccgccacccggcggtacggcggttaccgcgcggtaaccgcggtaaccgccaaaaaccgcgacaaattcacttttgaaatttttgaaatcaaaaccgcggtatgagacgcggttaccgtgcggtttgccgcggtaaccgcgcggtttggcgcggttaccgcgcaatgttggggcaaatgaagaacaaaattaaaaaaaaattaaaaaaatagaagaaacacctaaaaatttatagaattttgggataataattaaaaaattttggcatgatattttctatattacggacttgaaatcaattgaacaatacatgtaggtataaaattaaaaattttggcatgatctttgctatattacggacttaaaatcaattgaacaattcataacataatatttcgacaacaacaatcaacaatctgaagatatcgcacaaggtgtccacatgttcacatgtcaagacgtccacaatatagagttcacaagtgaaatgaatacagtcgacaatatagagttcacaatatagtccacaatataacatccacaatatgatagttcatatgaaaagcaatatgcaaatagaagttttgttggacgatgaaaggaaatagagaaggacgtaccaacatagagccagctataagttccactgattatatgccatgttgtactcctctgtggacatgagcatcaatccatgcgactgtagcaaccctgccttgtattcctcccaactttgacctgtccatgatgctgttgtttgccattgagcatacaattgagcgtaccactggggctcttgccactcgtacacccatgtaggagggggataatcagaaggttggggacgattatacgcataccttggatagccactttcaatgctagaggcactgaatgagctgtagctatcctgtggtatgtcaagatgttgtcgttgttgttggtcactcggtgaaacggtagttcgttgagagcttggagcaccgtgatcacggtcctgagtcgcgtgagtgaagtcggcctcacctgcaaatgaaattgtaagaagaaaattaatcaatagtgaaatgcatggtaaaggtctaaatagaaaatgaagcacattgcaccagtgaattggatagggctgtggtgacccccagaaggcacttcagtggttccttctcctccttcaccaccatcgtctccatcatctgtatcagttcttgagctactatcattggactcttggtagtctgggctatgttcggtctcttcatcgctatcaacattgcgagactgtggacctgtgcccttagctcttttggatgtaggtttttttggtggctgtcgagtcttcctttttccaatatgagtgtcagctatattcacatcagcccactctgcaatagtagaagctcccgtggttctgcgcaggtcagtcaagtccactaggttggctacaagtggactaggcacgggagcatcactttcagttgagtcttcatctagttctgggttggcattggaccgagcattatccatccattttttaatctgattgttactttcatagaatgataggtccgatagtctctgaaggggatcgtcgtcctccttcctaacttgggcatttgattgctgaattcgtaggcgaaggttgtagttcacataaactagtttgttgagcttgttgtgggtaagtttattacggaccttggtatgcacgaatgcgaatgtgctccagttccgttcacatccacttgaagagcaacattgaccaaccatgcgcaacgcaagcctcttcaaattcggcgtgtctgaggcaaacatagaccaccattgtgctgcacatgccagggctgcaggaat

SEQ ID NO: 90676 - DNA, 580 bp, Oryza sativa
agccatagactaaagtcccgacccaaccctacctacggccgaaacccccgtgtcactccctaaaaatcctaaatgtataaattgtatgttaagtaggaatttatagaaatgattttaaaagtctagaacagaagatctaattttaattataaattccaatataaaatggggccagataaaatatcattaaatacattgctttattctataattcatagatgtttctgggattcatttgagctaaggaagtatttttaataaatggaattgcatttaatgaataatttaaattgaaaaatgtttttaaaagtctcttttggctttgggccgaaagtcggcccaaaaccttctctctctctcttcccggcccaagtcggcccagtccagtccgcagccgcgcgcgcgcgctcgctgtcgctgacaggtgggtcccacctgtcagtcttcgtattcctcgcgccgccgccgccgcccgaaaccctagcgtgcgccgccgctgtctctttccaaattcggccgcgtctttccttctccggtgaaatcaatagaggggaaatgtttcccgagatctcctctacct

SEQ ID NO: 90677 - DNA, 1130 bp, Oryza sativa
ttgcatagacccgacggtagcactggctcaatagaggggatttgcaattataacactgcaaacattaacttttgttataatgacactggacccatattttatagacacagatggacccatttatcatccactcgaagtgttaaaacagcgaagccctcatgtttacagtcccaatattacaattttctcctccatggacagatgaacgggacacgtgtacttggatgttaggaggaaccacatccacgtctcatcacgtggtaccccgtgtgttcctatatgtgcaagtggtggtccctaagtttaatgggaccacatgtcagtaagtacttcaagccatgcgtgcatggcacgtgaccatgcatgccattatgcctcgcatggtgcgcactcacgctccattagcagtgagccgttacactactgctaagctagcttaattagtggaaagaagtaaactaactaacaataggcaggcagcaagccagctataagtggatacagtactaatcgttcgtactttagagtaattaaactaaactaaacttagtaaaattaagtaggcactaatgaccaatcaaatggttaatcgagccatagctaatcaagagagaggatggtcggcttacacggtgacagcgtggcccccgaaggtgtagaggatgttggtggcccccgtgaagtagagcacgatgcttgtgggcccagagtgcgccacaccctccacctgcattattcccaatatatgcactattacaattactatctatcactattactatcattttgttatcataaataagtgacgtttgggactttgatcttatattaaaaaaagatgagtaattttacagttcttgaagatgtatcgtgaggtactattttttatattataaatttgatacattttggtacctaaatactatgaggtaccaaattttatattaaatttttggtacatcatgatacctcctcaagaactataaaactgctatgaatattatgtaagatatatatgtacctgtccgtggatgagggaggcgacggcgatgtaccaggcggtgtaggtggtcatgaggaggccgaggaaggaccaaatgcggtagttgtgtaaaaacaagggggatcca

SEQ ID NO: 90678 - DNA, 2176 bp, Oryza sativa
acgaaaaggaatcagatgcagtcggtcgtgcaatccgcgatggctgctaagactaagacgaatgggtcgttggttccacccttcaggccacagctgggcacgagtggttctagtggccgtggtgctgtccgggaggtggaggatccggagaccaaggcacggctaaaggccatggcagcgagagctctgtggaagcttgcccgcggtcatctaggtgtctgcaagagcattactgattcgcgtgcactgctctgcttcgcggtgcttcttgagaagggtgatggtggcatgggtactagcgtacagtacttctcagcaatggcaatcatggaaatttcccgtgtcgctgagcacagccttgccctgcgacagtcggctttcaagcctagctctccagcagccaaggctgtcgtcgaccagctgcttcacattgtcagcaagggagactacgatgatctcttgctcccttgcattactgctcttggctgccttgcacgcactttcacagcgagtgagaaccgcgtcatcgctccccttgtggagctgctcgatgagcgtgagccaccagtcattaaggaggccgtgcttgcgctcaccaagttcgcatgcaatgaaaaccacctgcatgtaaaccactgcaaggccatcgtggacagcggtggtgctcgccaccttgtccagctggtgtatctcggtgatgaggtgcagatagaggcactgatactgctctgtttcattgcattgcacgtgccagaaagtgaggagctggctcaagctggtgtgcttgctgtgcttctctgggcatcaaaacaggctcacatgatacaggacatgcgtgtcgatgcactacttccagatgccaagggaaggctggaactcttccagtccagagcctccaggtgattttggcagcaagaccagcagacatgggttagtaatttctttgctgcaatgtgtaattagagtagattttttttttctgttgttcatgattgttctatcggagttttgttctccgtaggttgtacaaatctctagcaatcaatctgtcagtaaaattggttgggattattgaattgtaattcaagaggcattttaaacagattatatgtgtacctgtaaagttggccaaaaatttagctgattgtttttcttgttacttctgtctagttggattgcaagagtgggattctgaagctttggttcctgaccaggctatttataacttttaagcaatttcacattattcagcttcaaaaacaaaagaaaactacacatttaataccaaatttatcacaaaactacacatttaaaatgaagtgtcacaaaactacatgtttagtaactaaattatcataaaactataggcttagaaccaatttaggaacaaaataataatgtgtatagctccaacataacaacggttctagggatttaaactctaaaagctgtagttttgtgataacttcaatattaaatattcagttttgtgatgttaaccttaaatctgtagttttgtgataaattttgtgctaaatatgtagttttgtgacagaacaccttaaatctatagtttcgcgatagtttggtcaaaatacctgtagttctgggaaatttactcaaaatcaaaacactagcatataagtcaactgctcatctacaatttttagaagcatgggaactccaagaaaattgttttaagaaggatcttgcatatcatggtgccctacatattgcgtatgaaaattaattttgattgttttgtattggcagatgcagattgctgaatatgtgattgattttaatgttgcagagcatccctagattgtttttatatattgctactttgttatttttcaaacttatcctactcatatttggagtttggacatttcttcatcgttcaccctgtccaatatgtctagatatttatttatgcttttagcaatgtgctatattagcatttatcagactaaggaacagggcacatcaacaaacagttgatagctgggtcaatactcaatacaacatgtgatttaaaaatactcttgcattttcagtgtatatagacaaccatcattgatacatattttgttatcacaacatgctgaaggttgacgtacaatccgtgtactctaaaagttgaccaacattatttacctatatcagccgtgca

SEQ ID NO: 90679 - DNA, 3962 bp, Oryza sativa
ttatttttgttttacattttttgaaaatgacagctgtacttttgatattgctggatagaacttctcttctgctattcaagcgtcatgtttgtcctattctctccttatctatataatgttgacaagagcaccaccacatgtacaaaacatcaaagtttcccataccagatgacaccaacttacccagctgacaccgacacctgggccccactggaagtcgcaatccagaggagccggcgtgttattgtcagttcttacccaggtgatcagtgtggccaatcaagtgaagcctgctcacctccgcagttcccggggatggcgatgccacactgcttggtgacatagaacaccttatccatgttgatgttgtccctgacgcctgggctgcccaggtaggtgcagacgcagggcacgttgacgcccttcatggaggtgcagcagtcaggtgatggctgcagcttcggcccgtccttctcaacgaacttgtagcaggttgtcttcagcacctcgacatcgttctggcattctgtacctgccgctgctgctgcagtggtgaacactgccaggaggaagatcagcagtgcagccaggctagaagacttgagctgagacatcctggtatgtgttgttctttctgatatcttgaacttctctgattaaaacttggaaacttttgatttgtgcaatgcaaatatttatagagcttttggtgcctgaggttgtcatgctccattcttgcttgggctagttgagcatttcgtcctgcactggtaaccatagaaatgcaatgcttgtgacttgtgaggtgaatggttcatggctacgtgtttgatttagcctgtgcagcagatgcaaatgcaatcggtgtgataatttgttgaaacgagagcatgcggtttagatcttgttgggctatgtgatctactgggccgggcccagttctgctttcctaaagcccatccgtgactgtttgatatgaaattgcattggtataagttcactttgggtccctctatttatcacctagtccgattttcgtccccggtcgcaaaaccgggtacgatgggtcccccaacttaacaaaaccgtttaaataaggtccttcggcggtactgtcttcggttttggctgaggtggtgcctacgtggctccttttgaccaggttttcgtccaacgtgtcgttgacgtggcgcttatgtggcaattagatgaaaaaataataaaacacgtgggacccacgtatcagtttcgcacacaaataataaaaaatgggtgggcccatgtggacccacacgtcatcctcaccaccatatctctatccccctctctctctatcctctctatccatctctctctccaaccgacggagtggagtgggcggcgggcggagtgggcgacggcagagcagaggggcagaggcagagaggggcggagacgaggggtgaagcggcgcgtcgtgggcggagcggccggccgacgggggagaagtcgcagcgcggcggtggccggaggggcgcggggcgccgaccgttgggagcagaggagccgcccgtggcctgtggccgtctgcgggtgcgtgccggcgtccaccttgatgttggtgttgccgttggcgacgaggccatcgaccagggtcttgaggttggcctgcgcgtcgccggcgacgtaagcggagcgggcagaggcgccgcgctcggcttcgacctccatgagcttagagaagacgccaaccatggccgccgtgttgtacgtgcaggcctccgtctgtaggtacgcgccccggtggtcggtgaacacgttgttgccgttgggcccgccgacgacggtgccgtcgaggtcgtgcgacttctccccccgccgcgctgtggaatgaaagcatactgctcggcaactactggactacctggtgaaatagctcttcaaatctacaaacaaaattacggaaaattacagacatgtgaatcaatgacaaattgttcattatacttttgcaaattgcaatgttttcacttgtcatttgtcaaatactcaacaaatgttacatttttatgatgccaaagcctttcctttcccctttctatccatttgtgctgaatcgggctagttgctttgctgccttgcccttgctgacttgttggtgttgctgcctgctcggcttagagctgggctgctacacgcaggcgcacagccgtgcaggccaggtggcaccgcggcactaggagcgggcaagcaccgccgcgccggcctgcagtctgcagaggctcgccacctagcctggacgctgcacccacactgttcatggcttcactcaattcgacgcgattgggattttggaatggggaattttcgaccaacggccggcgttgtgggccgcgccaccgggggcggggagcagcggcggtggtgaggacgggtgcagcttcaagatcctgctcatcagggacttcggtgtcggcaagagccgccctccctgcttcgccggctggagagagaaaagagggagagagagaggatagagagagaggggatagagagaagaggtagtgagcatgacgtgtggatccacatgggcccacaattttttttgttatttgtgtgtgaaactgacatgtgggtcccacgtgttttattattttttcgaatctaattgccacataaacaccccatcaacgacactttggataaagacctagtcaaaagaagccacgtaggtaccacctcagctaaaactggactaaataccgccgagggacctcatttaaacggtttcgtaagttgggggacccatcgtatccggttttgtgacgaggggatgaaaatcggactaggcagggacccaaagtgaacttatttcaattgcatttggaggaatgtaactggactcctttgttatctaatgctcaagtgcaactactggctgtccctctgcatgtgcatgttgtggctgaattgaacatttagcctgcaataaaattggattttctttttacgcatgtgttccttgattatatatatatggggcgtcagaatagcaaatgtatatctgctgataatctttcagttgtgaccacagaatggttaaaattgttgagaaacctgtcgattctactgatcagcacacaagcaaaccaaacacagagttgtggaacacagaaagtatgagcgagtggaagctttatttcttctggatttgagtacaagctacaagaggagaagcaggagaccgaagatcgattgtcctcgccttggaccttctgggccctatttataggcggaggagggtggaggcttacgtcgtaagccttggaccttctggcttgcgtcgtaagccggcttacgccgtaagctggcttctcctgtaagctggcttcctctgtaagctgacttgtgccgtaagctggcttcctctttaagctggcttctagcgtaagctttcttctgtagtaagcttcccacttataatttaattcgtccacaataagataggtttcataacactcccccttggacgaatttgaattatgcgcatgcctcataaaaactcatcccaaaaacctagtgggaaaaaatggtaggagaaaagagtacatggcactttgaatattgtgttgcacctgttgcctcgttaaaaaccttgcgtgagaaaaacccaatggaaaaaaaactcaccaagggaaaaagagtacaacagttgatcaagtcttcaggacttgtttgtgattcttcaggatcataatcatgggctattctcttaattgtttgctccccctgattcttgcaattcactaagtcgtctcatgccgatgccacgaacacatctatgaaaacttgatgctggcagagactttgtaaataaatctgcgagattttcgcatgacttagtttgcaggacatttatttccccgctcttctggagctcatggggataaaagaatttgagagtaatatgctttgtgaaattg

SEQ ID NO: 90680 - DNA, 639 bp, Oryza sativa
ctgcgcatggcaatggcattggagcgaacacgtcgaggtcaatgctcttgagaagcacccagctgctggtgcttgcgacgccatcggcgccgccagcctcccgcgcccacagctgcaggctgaacacgtccatcacggcgaggccgagtgcgccgtccggcgaggccatcagctggatgctgctcctcccgtacagagccagagcgtcgggcggcggcggctcgaccacggcgagggtctccttgcccatgtcgagctcgaggatgtcgccgtcggccgtcgtcgagcgcccagtagagcgcgtccccggcgagcgcgctgggcttcttgcccacgtcgccgcagcgcgctgtccccgcggtgatcagcctgccccacgcggcggtctccgacgagtagaggcaggcggacgcgcggccctcgccggtgaacacgaaggcgacgcggaaggagccgtgtcggcgggtgtcctggtcgccaagaaccgcggcgttgcaggcccggacgtggcccgcgaggcggccgaggcggacggagctgcggtggccagtgacggggtcccagacgaggagctggagccagccgggcccgctgcggaggagcacgcggccgtggcggcatcccaggaggctccagtcg

SEQ ID NO: 90681 - DNA, 1112 bp, Oryza sativa
tctagatgccttactccccctaatgttgggaaatggtcctcatcacagatacaatcaggcgtaccgagccgtatgaagatccccagtcataggctcaagatacttgattatggacagtctcataaccaacgtatatccccaacttccggtggggtcctatagaagtacgctgtggtggtggggattacgcagatgggaaatacttggttcttttccacgcactagctgaaggggggatgtactatgatatgcagttggcctgagttggattagtgttgctgcatgcaacacagcatggccccaacaactggttggcagcctacaatcttgcaacagtgtccgtgcaatcaacttgatcctcttgatcaaggactcagctaggccatttcgagtgtggacatgtggtactgaatattctaccttaatgcccatggctaaataataatcatcaaaagccttcgacctgaactcaccagcattatccattcgaatggattgtacgcagctatcagggaagctagcttttagcctgatgatttgggaaattagctttggaaaagcatggttccttgtggacaataggtccacatggctccacctggtagaagcatcaatcaataccatgaaatacctaaacgggcccgacagaggctggataggtccacatatgtcaccttgtattcttgccaggaaaacaggtgactcatccctaatcttcaggagggatggcctagtgatcaacttcccttttgcacaagcagggcaaataaaatcttcaggattagggaagtctttagtttcaacattgtgaccagcaaaattgttgatgattctcctcatcatacccaacccaggatgacccagtctgtcatgccaaactctaaatgactctgggtttctaaatatggatttcatcgcaacatattccttagtgggttttatgtacgtgtagtacaaacccgatggcgatgaagggagcctttccaccacttgcttttgatatccatctatttttgatatgagcagatattcagcatcttgctcaatctcagtttctatatggaaactgtttgcacggatatctctaaagtttaagagggtacgctttgaat

SEQ ID NO: 90682 - DNA, 706 bp, Oryza sativa
cccccattttttgtggaactatggggctgagctaagaaggtctaatccaggcagttgcttctttttgaacttggtagacagttgtttcagcacatgttacatgtcctttgatgcatgtaagagagggtctttgagtggatgtaggcctttgatatgtttggatggttgccacatcaagactaaatttggtggacagatcctaacagcagtaggtattgaccctaatgattgcatatatccaattgcaatagttgtggttgagacagagtcattgaggtcttggagatggtttctacagaccctaaaggaagacctgggcattgacaatacctacccatggacaataatgactgataagcaaaaggtatacctgttctttatttttcttataggttacataacaagttttgttcttataatctgacatatttcaaattgttcttatgtttgtttttacataacacagggtcttataccagctgtccaacagattttccctgattcagaacacagattctgtgttagacatctgtactccaattttcaggtacatttcaaaggtgagaatctgaaaaaccagttatgggcatgtgctagatcaagttcagaggttgagtggaatgccaacatggaagaaatgaaatctcttaatcaggatgcatatgagtggcttcaaaagatgcctcctaaaacttgggtcaaagct

SEQ ID NO: 90683 - DNA, 1528 bp, Oryza sativa
cagggtcttttgttttttactgaaccttatcccacataactagttatatatctagtttttaagcccaacagcacaattaccatacttctaagcaatataaaatatttcttgctgctagctacatgatgatgcatataattttgaactataactaatctttctacttgtcagctaaatcaaaatatttataccctattggttacacatgttctacaactgaaattattatatgttccttttactgattcagagatgctcttgttcatattctttttttttaataatggaaatgggctacatctccggcctctgcccgtaggcacacagccaaaaaattcagacgtgaacagaaaagttaaaaaaaggcgagatgggacaaacccctaacttctgccgatgatatgatctactaaaataatatttttttcaaaatcacgtgaattctatcacgaaattctgtaggtactacgccatccaaactggaataaaagttccttggctactaattctaagcgtgtagcaccattgcgcatagtatcctgttgttcctgtgaaagcatcatacaccaagagtggagccaattggaacacatgaagataacctgcatgatgttagacatttttttatggttaaaaactatatcattacggcaacgccaaattgaccaacataaagctccaaacaaaatcattttttttgtgggtctaggtactccccttagccagtcaccaaaaatatcttttgcattgtggggagggggatgttgaaggcaaagaagacacatcaccaagcaaaacgtgcaatatgacagtcaaagaaaagatgttggatggtctcttgtgtattacaaaaacaacattgcttgtttcccctctaatttctctttatgagattatctttcgtcaagattacttttttttgtgaagaaaccacataaatactttgatttttagtggtacctttacctcccataagatcctcttgtggattcttacattggaattgatgatcgcattatacatggatttgaccgaaaaatggccatttttatgtagcgaccaaataaagcaatcattttcatttgacagggttatgttagctagtcgagagatcaaattattccactcaactaactttggtcctacaattgatcgtcggaatgaaacattcaacggtgttgtgctcataacctctgccaaagtagaatgtcttttttggaccacattgtacagagaaggatattgatatttgagaggttgcaagcccaaccatgtgtcttcccaaaatcttatttccatcccattaccaggtttaaaagatccatactgaaaaaaatgatcttttactttcattaggcaagcccaaccatgtgtcttcccaaaatcttatttccatcccattaacaggtttaaaagatccatactgaaataattgatcttttactttcattaggccagcccaaaattgggatgttcctggtttgtgtgacatgtgggagaggggttcaccctttaagtacttgttgcg

SEQ ID NO: 90684 - DNA, 1804 bp, Oryza sativa
gtgtgcatgaaagtatatttaacaatgaatcaaatgatatgaaaagaataaataattacttaaatttttcgaataagacgaatggtcaaacacgtactaaaaagtcaacggtgtcaaacattttgaaacggatggagtattatttaaatcacaccaaatgtcacatgacactctaactaataccactagtaaatgtgttactaccccaacatagtgcgttcgtaatgatctttggtcagacacgaaatcgttagccgaatactagtagcttttgagaagaatatagaatggcgagttttgtggacaagaaaaacgtgcaagttgaacccatcattacacaatatgtgaagaatgccgccttttttatttatgcccaagtccactgaattggaactgtccttatctgcattagcgatgcgatcacgtcagagctagctccttgtacccttcgtactagcaacaatgatgctgtactagtactacaaatccctttcaaatcactagtaactaatctcatgcaaaatcaaaccctacatacataatctgattttggtgtaacaaagaatgaacgaatcatccgtctccgccccaacaaaatcacctaataaatacactaaaatccccccaaaaaaatcaaaaagaattactaaaactataatcatcgatatctaggtcaaccctgtaacagagctcggtcaacactgtcttcctccaggggcccactgcgcagtggagcgcagccaggaggcggccgccggcggccaacctgctccattgcgccgccgtgtgtgtacgtggacattttgacgccgacgccgacgtgccaggctgccagccaaggcggctcaaagcagagcggcgagagcgacggcggcgaccgagaatacggcggcggcaatggaggagtaagccgaagtggtcgtcgcgccgctggattgcgggcttccgccgccgccgccgaagtagaccatggtgtcgttgagctgctgcagcccggcggcctgcgggttctgccccgacgacttcacgctgttcacaacaaaaacaacacgattagcaatatgaccaaaccaagttactctcactgacaggtggggcacaccatcaaaccttactaaggttgggaccagccgtagtaaatgagctgagtactttgggtccagttgtcagtgacgtggaaatagcgtcaaaagttgaccacattggggcccactttgtcaattgttttgttagttaatgataaacgtgcagtgcggccacatgggccccacgtgtcagttctagccgttttttatccgttactagccgttagcaccatcaccacacctcctcgaaatggctcacctaacctctttctttttgtcagcttcccctctcgcacacccaaccaaggtcaaaaatccaactaaattaacgtgatcaaatccaggaataataataataataataacaacgttttctttctttaattgcgacttactagtactccgtaactgctaattactggagtagtaagaattttctttttttaactagcggggtcattatttactattgcaattgcggattttatttattttatttttacctggtgggagcggcggggcagaaggtgatggcgtagtctgtggcgccggcggcgcaggtgaaggtggaggtggagtcgtcgtaggcgtagctgtaggcgcgagggcacgccgccttgaagaactccgagtacgccgacggccggcacgtgttcgggttcccgtacgcgccgctgcagcagtactccgccgacccgaacgcctcgcacgcgctccgg

SEQ ID NO: 90685 - DNA, 736 bp, Oryza sativa
cagatgttttagttcgctaagtttgaaaagtccaaagagcgcagactagccacggagcttggatacggtttcccgatcggagatccatggatcacggatgctctctctccccatggcctttcacctctgaaagcgtccttccttctaaatgcccgggcatccatccaatgcatgattttcgatagcgtcgaacatgagcggtagactgaacacccacacaatctcaatttgacacagcaacactttccacctctcttccttcccttggatcagataggaaatcctcacttttccaagacagaagagaagcaagcaacggattgagcaactagcgtgaaagaacaagggatgagcgctttgttgctaaagcgcatacgttttcttgcttgatttttatacgattttttgagcaactagccgatcacgaaataggctcatgctcactcgtggtccctactgcttatgggactgtgatcgaatccgatctggaaaacagtgctttttgataactaatcactggaagcacctgattctctctactctgtttcacctctctttcttttggcttcttcttgagaatattttcacgttggatgaagggatgggctttcttttgagttggctttgatcgattgcttggtgtcatgctatttactacaacggttagctaaattcgtttatgacaccgattcatttctagttgatccattcgtaaggtcgttcagaagcaaatgct

SEQ ID NO: 90686 - DNA, 2535 bp, Oryza sativa
gatctccctgaactcttatccttgcgaacgcgatcttccgaaacgacgggaactacacgctggcatgcaaaacgaggaaaaactctaataaaaaccaagaaaacagtacataaaaagtaaaccaacatgtagagctcaattttagatgaattttgcaagttgaatggctcaattcgtagttcgaatgaattagatatgaattttagaagttttgggccatttaaatgaatttctagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgcaaggcggaggggtgggttggctcgccgaccaacccgaccagacggcggcgcgcggccggacggccaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatgaggctcgagcagagggaggcggcagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcggcgcggcgcggggacgtcgacagtggcggcagcggccggctggagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcgcggggtggaggaggtgggcggaaacggccgcgtcgtggggcggctcgggcggccatggcagcaacggcagctgccggcctgaggttggggatgacaggtggggtccacgggtcccatctgtcggagagggagggagggagaggccggctggggaggcaaaacagacttgagggagagagagagaggcgagcgggctgagggagaaggccggcccgagagggagagagggggggaattgggccgaaaggggcccaaagagaggagggaggattttatttttttttctttttattttaattgatgcaatgatctttgtgctattaaaactatttctcgagctccgaaaattcacggaaaattccggagagtacattagggcacaaagaatattacaaaatattcccggccaatgatttttaaaggaaaatttcaaattctcccattatttcacttgattaaattgatttaacttttatttaatttctagaaaatgtattattaattgatttttattcccgaacgaaaatcggggcgttacaatagacccagtgggtcgggcagaatgattctttagaagaacctaattctgcctttctgcaactaacaggactgagataagatcagagtacttcgggtactttgagttcctgtattgctgttgcagcactatgttgttgggatgaaaggtagataaggttttctcgatcatctcagcgtcagtgatcttcaggccacataaacgcaactgagaaatgatcctatggagggcagagttatacgtcaccacagacttgtagtcttggaagcgtagggtgatccagtcatgttgtgcctgtgggagcacaattgacccttgctggtcaaagcgatccttcagggattgccataataccagtggatctttctcggtcatatactcagacttcagatttgggtggagatggtggcgcaagaaatgcaatgcctttgctttctcggccttcgtagactccacagtgccaacttcgggcaacacaatagtatgatcgagacccatggagtcgagtttaatctcaacgtccaatgcccaagtgaggtagttactaccatccaaggcaagctcggtgaattccttctttgctatgtccgacatgttctgcaacatcattagtattta

SEQ ID NO: 90687 - DNA, 3435 bp, Oryza sativa
aatataagagattttaagtttttgcttttaacgtttgaccactcgtcttatttaaattttttttgcaaatataaaaaacgaaaagtcatgcttaaagtattgtagataataaagaaagtcaaaaataaaataattaataattttaaaaaaatttaaataagacgagtggtcaaacgttacaaacaaaaactcaaaattccttaatattatgggacggagggagtatagtttgtgtctttatgtaccaaaccaagacaagacaagaccacactgtatacatgctactacaggaaaatcactttggtacaggttagaaaaccaatatttaacttcgatcggtcacctataactaaaaaagatgttatgaacctagaacaaacacctataaactcttataggtgccatattttaaaccgtccggtcacacgtggcatgacatgcgcaatgcccaccaacatctgggccctgcatcgtcgtttctcttgcacgaatctgaaagcacacacatgtactccctccgttttagattataagttattttgattttggtcgaaatcaaactgctttaagtttgactaaatttgtaagaaaaaaataatatttttaaccaaaataaacatttaattatagatttgattgaactgatttggtgttgtaaatattactacatttatatctataaaacttgggagtagattgattttaaccaaagtcaaaataacttatagtagtagtaattaagaaagtaattaagggatgaaatgcaaatgcagggagataatgcacgcgatgtggcggccgcagaagttcaaggcgatctacctgctggcgacggtgtacgtgctgacgctgacgctgccgtcggcgtcggcggcgtactgggcgttcggggacgcgctgctgacgcactcgaacgcgctggcgctgctgccgcggacgccgtggcgcgacgccgcggtggtgctcatgctcatccaccagttcatcaccttcggcttcgcctgcaccccgctctacttcgtctgggagaagctcgtcggcctccacggctgcccctccctctgcaagcgcgccgccgcccgcctccccgtcgtcctccccatctggttcctcgccatcatcttccccttcttcggccccatcaactccgccgtcggctccctcctcgtcagcttcaccgtctacatcatcccctccctcgcctacatggtcaccttccgctccccgcaatcccgccaggtaccttcttacttttcttcttactccatccgtttcaggttataagacgttttaactttgttcaaacttaaattgttttaagtttgactaagtttgtagaaaaaagtagtaatatttttaacctcaagacaaatttattatgaaaatatattcaattattgatttgatgaaactatatttagtattataaatattactatatttgtctataaacgtagtcaaatttgaaacagtttgactttgagcaaaaccaaaacattttataacctaacacggaaggagtactaattttctttatctttctaattctcatcatcaaaatgcattttacatatatacatgcttgaatttatttgtctttgagtgcctacattgggggtccattgcaaccatatttgctgaggctttaggtagagatgatatagtttcagtgctgttcctatgtatacatagttgccaaatgctagctatctagatacagaagcaaatgtttggtgattgatggaacagctggttgttgcaatgcagcctagacagcatgagcccaccatgcttccccatcacaccttgcttgcttcttctagtgcttactgataattagaacagatcaattaattaattaattgtttgtcttaattaatcaaagctagcgctagccattaacaagactagctagttggcgtctatttgattgatctgctgctgggacgtggcaaattccaatgaactcaacgtaacactggtaattaaacactattattattgtttctgctgctgctgagtgttgcaagtgtgtcattctcggtgaagaagagactgaatgcaagacaaatctgagcagcgacagcatgcaattcctttgagctgagctagaaaccagagcaagtggcgatatgatatgatatgataaaagaaaagctatatgtaccataaagctactgaaagtggtgtagagattaatcaggacgcttgctgctgctgctgtgctgcatgcttgcctgctgcaatgtttttgtaccatctgctgtccgggagccattggcaccgagcagacagactgcattgcaatattgcattgtatttgcattagagagagagctaggtcgacacccatgataccatgtctagaaagcaacaaaaataaagctttcagcaacagcatcatcacagtatactagtagcagtagaataccatcattcacctaatgacctacttgtgacatcatcccaatgcaagcttaacttatctttgcataatctttaatttcttcctgatctgcatccatatactgttctgtttgattctgaaacagtacatacaatacatacagttgcatgttctgtttcgtataattcggtaacagtagtataataactcaaacatatataattaagtaaaggtgcaatattattagacttttgcataatcttttctttctgatccctgcattcatatatactgctctctgttggattcttgaacagtaatctaactgaaaattataattagagcaagtttaatagtatagctaactgctgactctaaattatctatagttaacttaatagccaattaatagccaattcatacaatagttacctataaacatatactacataatcaatatttggtcccacctgtcatacacatatgcattttacagtctgtgctgtagctggcttacaaatctgtagcccgctactcttacctctactcttttatcttcttgaaatatgcttatagctgacttatagtcagctattgtacctgctatcacgagatgatagtaattaataactgattggattggattggattgcagaacgcggtggagcggccgccgaggttcgccggaggatggacgggggcgtacgtgataaactcgttcgtggtggcgtgggtgctggtggtcggcttcggcttcggcgggtgggcgagcatcaccaacttcgtccaccaggtcgacaccttcggcctcttcgccaagtgctaccagtgcccgcctcaccccgccgccgccgccctctcgccgccgggtgccatcgctccggcgccggcctcgatgctgccgccgttcaactccaccgccgccggcatctttgccgctccggtgccgtctcctgctccggctccggcaccgatgcatttcgtccttggtcaccaccaccatcaccggcaccaccgccacggcctct

SEQ ID NO: 90688 - DNA, 1223 bp, Oryza sativa
taatgccaactcttgtccagttgttggcatcgtcttcagccactgatgttgagaacacaattcttctattaatgagatgcagacaatttcagattgaaggttcggaagaagccctccggaaaatgttacctctggtaatgcctccctggaagtgtaggttgtttgtgaatatgagttagaatgtacacttcgtcacttccttatcttcataaattttgcaggtattttctcaggataagtcaatatatgaagctgtggagagtgcattcatcactatatacacaaagaaaagtcccacggaaacagccaaaagtttattaaaccttaccattgaatgcagcattggtgaccttgctgcccttgaaagcttagttagttcattggtatcaaaaggagaaatttcatccaacacggtgcactcttgtttcccttcaaagtttgctcatagcaacctttcaaatgctattttttacagtttagttacagtaatgctaagtactccccccattccaaaatatagggcacaacgattttttcccctaatgttgcataatacgaggttcgcatgcatgcgtgcatgctattgactagcacctccccctcctctaagttctatttttaaagcctctaccctcaagatctctgatctctaatcccattgggtgcatgcattttatttattgggatgatccaaattagaaggtgataataattttttcttggtttttgcgtaagagatagttgctcattatattttggaatgtaggggagtactcatttattctagcacaccaatctcctgtgcaccaaaagtgattctgcacatagattgagaatgcaaggtagtactaacttgcaattaagtgagtgcattaattgctgaatatgcataaattaagaacttaagatgcatgcaaagaatattgctcccagtttctccactttctgatgtgaacttcccttatctagatcctacagtgggaacttttttctgttcatcttgaagtatcttttgttagctgctcatcaaaataatttatattgcctataacataacttataccattttgtcgaatgttatttatctaacttcagtgacacctattatcttttgttggggaagttcacacttgttaaatcccattgtcttttgcagataacagccctgtgggattatttttgctttcacatcaatggtgtgaaaccagtgcaaagccgtggag

SEQ ID NO: 90689 - DNA, 3066 bp, Oryza sativa
ttcatcaatgtccatgctttcaagcttcttcttggtctcttcatcagtcttatcttctttgaataactcttctgctccaaatctcaatatcgctgaaagttcattctggcaaaatgtatagctcacatcagaagagcaaaacagaaaatacaagtgaggtgacaagccagattctatttaatgcatttctctcagaattttaattatcagtaaatgctcttgtgttgtagagagaattatagcttgggtatcttgaaagaaggctggtctagtcacatgagcatatatataccacactagacttacagcctgtatcactaacaatcgcttagttgataagttactggtagttttaacaatcttttgtaatacaattatacaatagatagatttcaaatatacaaatctatcttatatacaaaagattgttaaaactacctaagtaatattgttgtaccaaaccaatatgacatccaaatcaacccaaatacctaagtaaactaaataactggtgcagaaacttaccttgtcaaacatggaaccacctttttttgattctttcttctcgagcctgccctcagcatttagcttctgaatcactaggtgatcaagaacctgacatatatagaaaaagaacaagtcagaggttattcgtttatatttattaaaacaatatatgaaacaaatcaggctcatcaccatttttttctttgcacgttccaatatatccttcttcaacacttttgcatgtcacgaaacgatatatgttaacagtttcttgttgcccaatcctgtgtgccctactcattgcctagcatgacatcacacattcaaaaacccgaaatatgagaaactctttcaagacaaaaattgaaaacccatatatgagagagagagagagagaggggaacctgtaaatcattttgcggattccagtctgaatcaaaaatgatcacggtatctgctgttgcaagattaataccaagcccaccagcacgtgtagacagaagaaaacagaagtcatcacttccaggagcattaaaatgctccatggcctggtgacgaagatctgctctcgtactgccatcaagcctctgaaactggaatcctcggagggatagatactcagcaaggatgtccaacatcctaaccatctgcaacaatttgattcagaaagcacttatataagttatctaaggtgcaaatgctttcaagcgacatataatatattcgttgtccgatatattgatgttggtgtaaaatacaaatgtggctctagtaacacaattgctttcaaaatgcagggaaaccataattgtgttgtaaaaaatataaatacatttaccaactaacaaaagcaaccaattgaataagcttgttctgtcagattaaatatcataaaaaacactgtaaagtgggaaaacaaatacactgagccagctcttcctatcatccctgaagagaagtttcattctgcaaacaaaacactaaccaactatgcaaccaactaaccacgttgttaacttgactcaccatactaatttctcaaattgaagcaaatttctgcacgtatgcaacatattgctaatggattgtagaaaataagtttagacaatgtattggatactattagttcgactaatatagactgcaacacaatgggcatcaaatggcaagtaaaccaaacatacaaacctgagagaagataagcacacgatgattagtctcccgcagtcttaccaacagcttgtccaataacactaatttcccactactcataacaatgcgttcaactttattgcgatcaccaatgctatctccaccataaccatgatcagcactttcaaataaaaatgggtggttgcagcactttttcaactcaacaacgatatttaaaagcgagacctgcatatgcaataatcaagttagctagaataatttaaataaccagacatttaaatgtgcctgcagaagaatctgtgttttgttaatgctattttctttgtgtgtatattatgaagaatcacctagaaaaaacaaaatggaatcataaaaaattgaaaacacgaagaactgcagattagctcaggaaaaatagccctcgattggaaaaagaactgctacatatgcactgctcatttctcaaatacaatatacaggatattccatgaaggacaatcagcattacacaagcattgtgaacagcctaattataaatagttgtgaagttaaagataagtggtggttgtcaaaaaataataatgcatcgagtaaatcaggcaataaaggtttgcatatataaaagtagtacaccgtcatagcgactacgtaggaacagaagaatagaagaaatcattactaaaataaaatagtgctcaagatttatcaacacctgattcccacgaactcctttgttgagattctggaaattccgctccaaaatccatttgtaatacctaataattaattaggaaaaatgattttatctcaatgatgaataaaaggaacataaacttacattagtacaaagtatttactgcttctgtagaggagacatatcaacacgaagaatccgctcaattttcggaggtaaagatttctccacatcttttataactcgtcttagaatatgaggcctcaattccttgtgaagatttgcaagctataaaaataaatcaagcaaagttatggatgtccaatgctgacagaatagtctaggtcaagagaaaagtacattttgaaagagaaaaatatttacctcagtttcattgaaggaactcaaatttttgtatctctcaacaaatatatccttgctgttgaatttagatggatcaaggaaatgaagtaacgccctgcagattttaaaatacactcagcaaaaatgggacaaagaataataaaggtaaaacaaaaatatatatagaggcaaaatgcaacagctatgaacatgttgcagtctctagtcacctattcacaataagaatatgaacttccaaccataaatctacataaaatcgcataccagagctcttcaacgctgttttgcaatggggtcccggtgatgag

SEQ ID NO: 90690 - DNA, 754 bp, Oryza sativa
cctgcagccggttattaaatacccacgaatttaatttatatttgtaaagttacacaaatatttttcaacacaaataccaggtacaaatgtacaatcagcacatagacttgctatctcaagcacaaacatacttaggttccacaaggagaaaagaacaaaagagatgattgtttaggagaacagtaggggagttcccaattgaaggaaaagaaagaacagatgttcaagatcgatggaacaaagtctgagggattcttactgctggtgtctcaagaccgtttcattgtccatagcaacagatgactggaagttgacaggctttattgaacgtgtactttgctgcaaccaggatccataggggttcgctgaagccacacttttcttcacttctgtgttttcaagcacctaagatgattcatgaggtttagcacatatatttgaattgtctggaatactcaaagcaagaaaggaaaatggttatttcatttctattctaacctggccagtttgtaggtcaaccgttatcatcattccaggacccaatcttcctttcattactacctttgactcatccattggtataacaccaacctgtagattgtcataaaaaaaaaagctagtgatcagtaagaaccatacaatatagaactttggggactcccacagggcatttaagaaagtgatccaaagtaactccatcaagtgttgcagtatggtggcacaaggttaatattttattgtcatgattttaaat

SEQ ID NO: 90691 - DNA, 2846 bp, Oryza sativa
gatatttgtggctcaagttcagctgttcaagtcaacgttggttatctctgtacgggattaaagaaaaaatgaacgagaagaaatctgcctcaccttgccctctgaatattctgtcctgtcaggctgttcggtgcacttaataattcatggaaaaagtccggagatattgtcttagcttgagatgaaagatggagtacgtcagaatgaagttatgactgaatatcacagaaaaaatatgcgtcagaacaaatcattatctggattgttcatgcccggcaacaatattgtttgttgccactggcaactagctccaatagtaggtgacaaagagcttttctggaagagttctagttgacaaaaccaagtcatttgattcaaccattctcaagcatcagtactattttttattttaccaattcatgtcaggactattatgcaagagaagatagtgtttccacatataatccaaatattaaaagcattagctaaaattacctttttctgaatgtgcttatgtttgattgctgataaaatatctttttctaaatgtgcttttgtttgattgccgatcccacttgtctttgaaatcatgaagagtaggtgcacaactttcatcatctcttctgtgtttttctagtgaaattgtttccgttgccagtggagcacccaaaatggcagaactggtagtactaatctacagggacaaacattgccatgatggtctttcagcttcgtgctctctgaacgaacggaaagggagatcttcagagttgaaacacttgctgtgctgtctagtacaagtacagtttctgccaatcaagctgatgtagttgtaggatacaattgaaaacaatgtcgccactaatcactattaagtagtactcctaacttgtgtcctcttcaaaaaagaaaaagaaggctctcataacttatggagctccatgagtgcgacaactttgtccacggttcggatggagtcatggggagatgagtttacctgaagaaacaaaacatgtgcgaattggagtaagctgaagtgtaaagcagttgccggtgcaggcaccaaaactgaatactagctctgaatagctcgatccctgtgtgtccttcagctgacagtgaatgctacatgagaaagttggtagcacagagtgattgattcagactgtctgctggcccatcagaggtgctaataacagcgtatccgctttctagcatgcactgaagctgaagcctgaatgctccgttgcaaagctcaagtttatgggctgctcactttcactgctcagttagcttggctgtagtgttagctgcaccatgaatccatgattggtaatagtaacttggaaggtaccatgcacatatcgtggctatctaaaactctgaatttgattgcattgtacgctaaaaaacacttaattttcagattagttgatgtattaaatttccgtttagaaattcaattaatatacagatccaaatgataatacatgaaaatagttctagaagtagctgaataaaattcggcccatttactagactcctagattcggccttgtttggatgggctcgagatgaatcctgggctaaccaccatggatgggtcggaatagaggagggaaaagtacacgcaaggtccctcaacttgtcatcgagatacaaaatcgtccctaaaccgcaaaaccggacatccggcatcccccaacttacaaaaccggtcataaaaagtccctcggcggttttcacccggttttgtcccacgtggcggctgactcagcgtgggacccacgtgggccccacatgtcatggagaccacgtcagcctcctctctctcttctctttcccttcctctcccttcctcatctctctctctcacttatctgcaaagctagccggggcgagcaggagaggaggagggcggcgccacgacggcggcggcggcggccgtagtggggaagcacggcggaggcgcggggagcccggaaccctgccgacgacggcgagcccgtagcccttgagcccgacgaactttgctacctgggcgccgatgccgtactcgcgggagtcgacagcgaggccgagctcgacgttggcctggacggtgtcgtggccgtcgtccaggaggttgtaggcgcggtggccgtgcgaccaggggagcaaggtgtcggcggcgacgacgcgggagcaggggagcaaggcggcggcgacgggcgcggccttgacctcgccacggtgcgcaatctcaacggcgtccgcgtggccgacgagatcctgcggcttgtcccggacgccgccgcgttccacaccacgctgcggtgcgtgaaggaatcgacaagctgctcagaggattcgacggcgccgcgccgtcgcatcatccgtcgtcgtcttgcagccagcaaggagccgcggctgcagcggcagcaggagcaggaggccatctccgccgcggccacctcgacgccgaggatctccgggcggcgcggccgacggggaaggagcggcggagaggatatcgaccggccggctccccacccggcgaacgcgagcgcgagcgtgaggttcgtgctgggcggtgacgcggcggcggagacatgggacagcaagctcggcggcggcaggcgagcgcggctgcggatggggagcggtggcgccgacgactccgcaccgctcggcctcatcgctgtcggcggctccgggcgcgggcggaggtctcctctgataggcgatagtggccacggtcaccgtgccactgtacgcggcgggggcgtcgcaccgcctgcttctcgtcgctcgtccgccatcaccgaccgcacgaggggacgaggaggccggcgagctcgcgccgc

SEQ ID NO: 90692 - DNA, 977 bp, Oryza sativa
taattctgtattcggtgtcttaggaactgattgcatgtcaaatgaaaatgaaactcagaatggttccatgctgtcatcgacaccagccacaaatctgggcagatttcttttcattattagtcatatagcactgaatcatttggtttacattgagacttctgttaagaaaattcagaaacagaaacggaagaatgacaaatcagagcctactgccgaggatcttcaggcagatgcctccaaaaattcggaggtattttatttcttagtttgctttgtggcctaatcgattttgggttaccattctttcgtctgagtgtgtattgcacttctcttttactgtgtgatgctggcaggcacaaggtataaatgctgagttgggaattggtgcatctgtagatattgcaatagagtccctcgctgaaaaggcagaaagggagattgtgtccaattctgaaaagaatcttattggatactgtgcaccatttctcgcaaaactctgcaggaacctggctttgcttcaaaaggtcctaatttgtattgagcttcctttattttcttaatgttttgactctactactctctgttttttgttccttacttttttgttaatgcagtttccagggttacaggcctctgcaatgcttgctctttgcaagctaatgattattgatgcagaattctggtaagtatatatttatattccagctgtttcaccttttcaatatgatgtgctccagatatttatattccatcaaatgctcaactttcagtgaagcaaatcttcagatcctatttactgctgctgagagcgcgccttctgaagttgtccgatcaaactgcactatagctcttggtgatttagtggttcgctttccaaacctcttagaaccttggacagagcacatatatgcacgcttacgtgatccttcggcatctgtgaggaagaacactgtgcttgtcatttcacatcttatatt

SEQ ID NO: 90693 - DNA, 1052 bp, Oryza sativa
tttcatttcctgcttgcaaagtgtatttatgtaaagtcaaaaacatttctgcagcatgttctacgtgaactaccatcttctccagtacctgcttcctgctgcacagccttattggaagcttttcgtaagtgctctgctttgttcatgttagcttaaatatcgtcattcacgatccttgataaactttataatgaattcaataaaatacaaacaaattcactaaactacctaatattagaagaagctgcaatattttttagttactaaaactaatcatagatacagccgatgtaagttctaagctttgactgctttgcttacctgtaggatacactcataccccttctggtgtctgttaccaagtactagattattttaaggagcaaacctatacagattcaaaatcagactataaccttttatggaagttgattaaagttatacacttatacatactacagttcaactggtagataatgactgtaacatacaatgctattttttgaaaaaaaatatttacagaaactaaaacagttagtgttaccatatactttagcttaggtttttgtaatttgtttattttcagttatttgcttccatatttcgttccttggcattcttttcatttccttcatacttttccaggtctggagagcaaggaatctcggataaattctatgcgtgcggcaatatctgagacatttcctgagcctaataggcggctgctacagaggtcagtgtacttctattttatgtggatatcttatctgccgagttggctttgcctgctggcatatcagcctgaatattgcattatcactaaagcctgataccttctgagatcagggtttttgtcaatgtttttgtattgattaaaattatgtgtttgatataggagtaacaaaacacattcagctctgtactaatagtgtaaaaattgctagtgatgttatgttatcatttagatagtttatcaacaactggccaaattcttaacaagcttgtaaaaccattttttggcagaattttgagaatgatgcacactgttgctt

SEQ ID NO: 90694 - DNA, 4855 bp, Oryza sativa
agtggatcccccgatgatctgattaggtaccccaaaccgatgcacaatgttgatgaaaaaatctctagctttatctgctgtgattgtgatgaccggtttagcctcaatccacttggagaatttgtcgatagccacaaagagatgcgtgtaatcgccgactgcccttttaaacgggccgaccatgtcaagcccccagacccgcaaatggccaggacaatgggatggtttgcaattcttgggctggcaaatcaatttgtctggcaaaaaattgacaaccttcgcatgtccgcacaatcttgtcagcgtcggacaccgctgtaggccagaaaaaaccttgccggtaagctttgccaacaatggtccgtgcagcggcatggttaccacaaataccagaatgtatatccttcaacaactgtctcccttcttcgaaagacacacagcgctgcagtattcctgatggacttttcttgtacagctcagtgtcatgaataatgtaaagtctgctgcgcctggaaatccgcttggcttcatttttgtcttgaggtagttcttgtttgctcaaaaatttaataaactgttctctccagtcggcttcgatcatgcttacgccttgaatatccatggcttcgactgtctcttttctgggcacggtcggttcgtaaaggtgttcgacaaacacatctgaaggagctgcttcccgttttgaaccaaaattggccagtctgtcggctgcctcattgttatgtcggaggacatgggtgagctcgagtccatcgaatttattttccaacttgcgtacctcttgtcgataagcggtcatattatcatctagacatgatcactctttcatgacttgattgacaaccaactgagagtctccacagacgattagtcggcgaatacctagagatattgcaatccttagtccatggagtagcgcctcgtattccgccacgttatgggacgcagaaaaatgtatccacaatacgtagctcaatctttctccagtcggggagattaaaacaaccccagctccagtgcctgtaagcctcttcgacccatcaaaatgcatagtccaatattccatcttttcctctagcatgtcttcttggcactcggtccactcggcaaggaaatcagctaaagcttgtgacttgatcgaagttcgtggcttgaacgatacttccaaagacatcaattctaaggcccatttcgcgatccgtccgtttgcttcgcggttatgaagtatatccccgagtggaaacgatatgactaccgtgaccgggtgactttgaaagtagtgagataatttcctgacggtaattaagacaacatatagtaacttttgaacctgaggatatcttgtcttggagtcggctaaaacctcgctaacgaaataaattggacgtggactttttgaacatggccttcctcttcacgctcgacaaccaggaccgcactcacaacctgggaggtcgccgacacatataacagtagcggctcttgcggatgggcaaggccaaaactggtggagtggtgagaagtttcttgaagtcttcaaaggctttctgtgcttcgggtccccactggaaattgtcagttttcttcagcagcttgaagaaaggcatcccccgctcgccaagtcgtgagacgaaccggctaagcgccgccatgcatccagtcagcttttggacgcctttttgggagcttggcggtttcatgttgaggatggcgttgattttctccgggttggcctgtatgcctctttgagataccataaatccgagcaatttccctaacggtactccgaagatgcacttttccgggtttagtttcatcttgaaagcacaaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctgcattcttcaatccaaagagcatggtgatgtagcagtaggccccaaagggcgtaataaacgaggtcttcaagcagtcggattcttttagtcggatctgatgatatcccgagtaacagtccaagaagctgagtaactcgcagccggctgttgagtcaaccacctggtcaatgcgaggtaacccaaaagggtctttgggacaagatttgttgaggtcggtataatcaacacacatgcgccattgccccgtctttttccggaccaggactgggttagccagccagtcgggatgaaagacttccttaatgaagcctgctgctaacagcttggttaattcctccttgatcgcatccttcctgtcctgtgcaaaacggcggagtcgttgcttgatgggtttggcgtcttccttaacatgtaaagagtgctcaatcacctctctggggataccaggcatatcggatggtttccacgcaaaaatatctttattactctgaagaaaggtgatgagcgcgctttcctatttacaatctaactcagtgcctattacagcagtcttatcaggatcggagggacctaagggaatctttttagtcttggcatcactttcttcggtcttcgtcagcttggttgcaggcacttctccctcgcttgccgtggttgcagccagtcggatctcttcacgggcgagagtagtctcgtgagtttgggccatctcgcaactttctttatcacatgtgacggcttgcttgatgtcgctccgtagtgatatgacccctcgaggaccaggcatcttcatcgtcatgtaggtgtagtgtgggacggccatgaatttggctagagctggtcgtccgagtatagcatgatatgctgtctcgaaatcagcaacttcgaaacaaacattttttgtgcgaaaattctcccgagtgccgaaggtaactggaagagtgatctggccgagtggtgtagctgacaatcctgggataacaccgtggaagggtgcattactcggctttaattccgtgcgaggaatctacatatcgtccagagtcttagcgaaaaggatgttgagtgcgctgccaccgtcgatgagagtctgtcgaagcttgatattgcgaaccactgggtctagtaccagggggtaccgccccgggtggaccactcggtcgggatgatccgatctatcgaacttaattactatctctgaccaccgaagatattggggcgtgttaggctgaaccgcattgatctcccgttctgttagcttctgttttctcttagattcataagccaggggtccgccgaagatgtgattaagttctttgcgatgatcttgaaaaccaatcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacaggaacgttgtcgggaagacggagaggtggtcaccacaagttcttcaggcttacgcttgcgatccttgtggttgttactttcactccctcctgcggtcggcgtatccttctttggcttccaagtggtgcccgactgcttggacgccgtgatagcatcttcagctttggcatactcattggctttttcaaacatctgtttgaccgtcttgggaggtttgcgtccgaacttgccgactaggtcctcgtggcgaatgcctttagtaaaggcggcgatgatgacgtcgtcggtgatgttggagatcttgttgcgttgctcagagaagcgtcgaatgtattctcgaagagattctccagacttctgaacgatgttatagagatcgaagtgtgtactgggccgttcaaaagtgccttggaagttggcgatgaagtggtcgcgtagctctgcccatgatccgatcgtgccgcggggtagcccgtgaagccatgaccgggcagaatccgctagggccacaggtagatagttcgccatggctttgctgtctcctcctgctgcgcggattgcaagaccatagacggtgagccaagactcagggttggtggtgccgtcatatttctcgattccagttggcttaaagccggctggccaatccactcgacgcagatcgcttgtgaaggcagcaacttcgtccacgtcgtcgtcgtagcgatccggtgaatgatggcctcttgctgcgcggcgctagtcgatggtgtcgcgaagatcgatggggcgccttcgatgtggggagtgtggtcattcaactgagcgctccctatatcgctcgggaggcgaatgaacagaccgttcgtcatgtcccctactactgcgactagattcggcgccgccaatgctaaggcttggctcgtgatagtcttgagatcgaagatgagggactcggctaccagtcggggtgcgggtgcttgcggagttggccggaaccgaggcagcgatcatggtcttcgtctggttcaagatgttgactacatgatcagcttgcttgagtgcgtcttccttgaggagggtgtcaaggagagtgattgctgcaaccgcattctgctggggggtgcgaaagaccgctgtcccatcgacgtcttgttgcccaatgagctctctcgctcgccgcccagattccaaggtgcgttgttgtcgatcttcagcctccttcgcaatccgctcgcgatcttgctgctcacgctgtagttgttctcgctcttgtcgctgtcgctcttcctccagtcggcgacgttcagcttcttgccgtgcgcgatcttggtccgcttctcgggcctagcgctgtt

SEQ ID NO: 90695 - DNA, 777 bp, Oryza sativa
acaagtcgagcgtgctaacggcatgatactgcaagggatcaaagcatgagtttttgaccgactacgtccctatgctggcaagtgggtagatcagctgccgtccgtactttggtctttacgcactactcctagtcgggctaccggccagtcgccgttttttttggtttatggcgcagaagcaatgttgccaagtgaagtggaatttgaatcactacgatttcggaacttcaacgaggagggctatgaagagggccgagtagacgacatcaaccgactagaagaagcccgagaagcagctttaattcagtcgactcaatatttgcaagggttgcgccgttatcataatcggaatgttcgatcgcgagcctttttagtcggcgacctggttctgaggaaaattcaaacaacacaggatcggcataaattatctccctcatgggaaggaccgttcataattgctgaagtcactcggccaggttcttatcgactcaagcgcgaagacggtactctcctcaacaattcttggaatattgaacaccttcgtcgattttatgcttaggcatttcgcttgtatctttcctatttgactgctaatttcaagtttttccttgaagttttcagtcggggggctactatgataataatggagtgtgatttttatcaattcaatttgcttacttgatttatcattgccctgtttggtctttcgacttagccaatgaggactgaaggtttttaatagcttttgcgggttttaggctcaataaggcttgacaa

SEQ ID NO: 90696 - DNA, 8757 bp, Oryza sativa
agatgaagacaaggaacaagaaacgctggtctcagatcgattcgttggcataatcgacatcgattcccacgaaccatcagttctgcatctactcgaggactatgtctcatcgccaacaagtacgccacgcgaggtattagctatcgacgggaccagcacatcagcacacgctaatgcggaagcgcaaaatcaagtgactacaccggcccagcacctcaggaccatcaacgcaatactgagggagaccccctacgatcccgttctaaacgatgatctcacacagtggacagagcggctacgggagtcagtaaccaacctcaacaatgctttcgaagagaccgccgctgcagcgcacccgaaacagccaccaactggtggtatcaatggcgaaaatctcgaacagcgggaatcaccccatcgagctacccctccacctcgcggcgctggcgatctacgcgaccacctcaatggccaccgagaggcacgacgcacacgagacaacgggaatcgctcccagcatcgcgtctcttcacgacatcgcgataatgaagaacgagagggccgctctaacgaagaccgagaccgtgctaatcaccacaatcgccgcgatcatgatgatcgcgaaaggcggacgcagggcgatactggtcgaggacaccgccataacgacgaaaacgacagagaacggcgccgggacaacaacggaggccgacgacaggattctcgagaacccagccgacgacctcgtaatcctacaccggaaccaagcgatccatcgtcatcgtcgtcttcttcttcatcctcatcgtcagacagacatccacgaaggacacacgatcgccgacaacccaccgccccccaccgctgggtgtggagctttcagtcgttccctgcgtgatgtccgatggcctgagagattccgacccagagcaatagagaagtacgatgggagtaccgacccagaagaattccttcaagtctactccacagtactctacgctgccggagcagacgacaacgcgttggcgaattatttgccaagtacgttaaaaggctctgcacgttcatggctgatgcatctcccaccctactcgatttcttcatgggcagacctgtggcagcagttcgtcgccaacttccaaggaacttacaagcgccacgcgatcgaggacgacctacatgcgttgacatagaactcgagtgaatccttgagggaatatgttcggcgctttaacgagtgcagaaatacaatccccgaaatcaccgacgcttctgtaattcgcgccttcaagtccggtgtcagagatcgctataccacccaggagttggcgacaagacacatcacaactactcggagattattcgagattgttgagtgatgcgcccacgcagacgatgcgctgagacgcaagaacgataagccgaaaaccgggggagagaagaaaccagccacggacgcacctgagtcaagcaagaagaaaaatcgcaaaagtgggaaaaagaaagctcaagcggaagttctcgcagcagaatacgcgaacccacccaagcgcccagacccacaaggtagctaggcgaagaaagcatggtgccccatacacaagacggacatacattctttggaagattgccttgttttcaaaaagtcgctcgagaagcacatggcatcggaaaaaggcaagcgagtacacgtggtcgagaaggatgcggaggcggctgctcaggaatcggactcagcatatccagactctgacctccacgtttcacacattttcggaggctccacagcgtactcctcaaagcgagaatacaagaaagtggaacgtgaagtctgttcgacatggcagggggctgcacccaagatgaagtggtccgaacagaagatagaatttttggaagaagaccatcccaagactgccgtcatcgtcgaacccactattcggaacatcaaggtcgcgtgggttcttatcgacggtggtagctcaatcaaccttctcttcgccagcaccttggatgcgatgggaaacccacaaagcgagatgacacccaccgatcagcccttccacggaattactccccagtcctcgtccaaacaaacaacttccgaacggagtagatcatctttgatgtcgctgaattcgatacagcgtataatgccatcatcggcagaactgcacttgcgaagttcatggctgcatctcactacgcgtatcaagtgcttaagatgccgggaccgaagggaacaatcactattcaagggaacgcaagctagcggtacaatgcgacaagcggagcctcgacatggtcaagcaaacgcccaacctacccgccacaactgagcctcccaagaaaatgagcaagacaaacaagacgccgaaaccggacggcgcgatcaagatcgttccactctcttgtgccaaccccgacaagaccgtcaagatcggggcatcactaagcgagaaatagtaaatcgcgctcatcaccttcctccgcgacaatgctgacgtgttcccttggcagccgtccgacatgccgggggtccccagagaggtgattgaacacaaactcatggtgcgatccgatgccaaaccagtaaagcaaaaactgcgtagatttgcaccagaccgaaaacaagccatacgagaaaagctcgacaaacttctcaaagctggctttatcagagaggtactttatccagagtggctagccaatctagtcatggtgcggaaggccaacgggaaatggaggatgtgcgtcgatttcaccgacctcaacaaggcgtgtcccaagaatcacttccctcttccttgaatagatcaactggtggactcaacagccggctgtgagctgttgagcttcctcgacgcttactccggctaccaccaaatcatgatggcgaaagagaacgaagagaagacaacattcatcacgccgttcggggtattttgctatgttaagatgccatttggactgataaccactgggaatactttccagcgcacggtccagggcgcccttagtgaccagctcggcaacaatgtcgaggcatagatcgacgacattgttgtcaagaccaagacaagcgactcattgattgacgatctgcgggaaacgttcgacaacctccgacgatatcgcctcatgctcaatccagagaagtgcacgttcggggtaccgtcgggcaagctgctcagtttcctcgtctctgtgtcacgtcctgataaattcatcccgaaataaaaatcatcttctaaaaggaataatagaattaattaaaattcgaaaagaaattggcaaaccttaaaatacgtacaagaaaaattcaaatgtgacccggagaatttttgttagattctccttggtctaaaaggagccctcaaattttagtggaattttcagagcacaaataataattgagaagaaataaacaaagttgaaaaggttttataaaaagaaaaaccctaaaagaagtcctcttttccccccccttccttcttgggccggctcggcccagtccctccctctctctctctctccccccggcccatcggctcaccgcgcgcgcgcgcgccgctgacaggcgggcccgcccgccactctcgctgacgggtggggcccacctgtcatctccctcctcccgccgcgccgccgcccgcacgtgccctagcgccgccgccgccgcggattccgccgcatcccgtcgtctccgcgcgcattaaagagaggggaatcactccccgtgattccctctcccgtttcccccgattccccctctctctctccctcggattcgttcgaatcgtgcccgcattcgtcgccggcgcaatcaatggcggccgaaatccccgcggccggtttccttcctcctcggccgccttctctcccttccgacgctataaaatcgttgcccgagctccgctcttccgtttccgccgctcgccgctcgctctcgccgtcggatccgtgctcgcgccgtgctccgctctctccgccatcgccgccgagctccgttccgccgccgccgccgctccggacttcctccttactcggcgacccctccgtccgcttcgccgcgtcgccgtcgaccccgtccgccgctccgcttcgcccgtcgaccgtcggagcgccgccgtcatcgtcatcccgaaccgcgccgccgtcttcttccgctccggccgccgttctcgtcgtcgtcgttgtcccggggtgagccgaagaccgccgttcgctttcccccttccctcctctctctcgggcgccgctccgccgcgccggtggtcgccggcggtgaccatcggggcgcgggcgcgccgctcccgtcggccgtgccggcgaggccgcccttgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacccccgtggacccggtccgcgcgtcccctccctcggctgacgcaataaatgggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccattttataaaattatgttgatttaaattattgcattatcgctttatttaaattcccgcgttatcactgttttatttagccatgcctatttacctttgttatgaccatattattattgttattgttattattattaccttgttcaccctagacaaacaaaacctcaactagtggacactctactcatggtatccctagtataattttaggtagatgcttcgcaatttaattaggcaacattaggtggttttataactttagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatattgtgtagttctaagatcgtgtttacaaaatagccctgagcaactaaatgtcttttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaagtttactcttttctttcttcggatttcaactaagtactagatggtcagcttggcgaagaagaagatgtcgtcagttgtttgccgaagctccagaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcctaacatacatcataacagtaaaagacttagatctgttaaggtcctatccttagtttctaatctgtctctcccctttgttttccctctctccccctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcaacaccagacgccaattctgaatttgagtcaaatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatggtcattaccagcacagaatggcctccaccaggaatgacaaaacgtcagagaaggaattccttccgaggtgcacaacagttgacagagcatcttttagctaatggaggtagagtgtctggtagtgaagattcagatcaagtctcctcagatgaggaagatgagaagtctccccaaggtttcaaccagaataaaatagaacttaaggcatgctctcgttgtggagaaatcggtcatgttgccagctcgtgtgcctctacatgcgttcattgtgaggaagaccatccacccaataggtgtccaacgagcaggatcacttgtttcttttgtgaaggaactgatcatgtaccaaaagattgtcgattcagttttctgctgacgaagaagatggccaaccaacacgcccgttccaacggagagaagcatcaaggaaacacaaatcctcgccaagattacagtttcagcctaactccagtgccaggacagaggaaacaaaatgagaaaagaaaatgccgagtccgggaagacatctgttgcttcaattgtcaaggaatgggtcatttcgccgacaagtgcccaaaaccgagaaacatagctgccggcacgtcagtccacgcgactccctgcaaccagaagcttgctcctcaacgaattgtcatccatacatcccgaagcagtcctatagcccgcgttgcaacagctccaactccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctcctgctgcacctgactcggcaataaatcatagcaaccactctctgcatcgacagcctcagcaaagaattgtcgtagatggaagaagttgtgtctctccccgacctactccaggccgagccaagggcaatcaacatccggagggcgataccaagcagaagaccgtcatccgcttcagaaggaagcttctcctgtgaatgatagcattatgcagtcctatcacatcatcacagaaccaatcaaggatgcagtcactagaacaatgccagctatatctccccagaatcaaaatgagcagccatgtttgtggttttcagttcgctacttatcatggtgtaatcgaaagtttgcagcaatcatgtaattcataaa

SEQ ID NO: 90697 - DNA, 1603 bp, Oryza sativa
ttttacggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagccgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacat

SEQ ID NO: 90698 - DNA, 11454 bp, Oryza sativa
gcagccgcggctgcgacctgaggtaacagcggcaatgccgtcggtgcggaggcagaggcctcggagctagtcgcagcggcggcgtcatcggctgctgtggcacggtggaaggaggcacgatggtgcgttcggcagcagcggctgcggtggcggtgaccacggtcgccggaggcgccggaggcatgggggcctcggacggctagctaagggggtggtagacggctacatcgggccggcacggcattgtttggaggaggggtcggagaccggcttggcgaagagtggcgcagtcaatgacagtggagccggctcggcgcgagaggcgcgagcggtggagttggaggccgccttggcacgagaggcgcggccgatggagggaggccggattggcgcgagaggcgcgtccggtggaggaggccggcttggcgcgagaggcgcggccggcggtggaggaggcgacctcggtgtgaggaggagctgccggtgggtgtggcgagtctttggtgcatgaagactggccggcgggggacgccggtgcaagggtcccgcatgtcagcagagctggagaggtggtggagcatcggtgtgtcagccaaggattcacaagggtgatcttgtctttgttcctttgttggtctagcggcagtcagtcacgcttagcggcggccggtctggtactagccttctcctggttgtgtgttggcgctgtcggtgcgtgggtggtggtatattttttttctttttgctggttacgaccctccagggttgtaatcttgtaattttttcctgctctatcaatagaactttgcaccgtctcgtgcgagtcgttaaaaaaaattaatagcctatccgaactggccgtagttttttttttctagtgacactctgatcaggagaaatcaacccggctattgttaacatctgccagttttggactgtagtaagtgtttaagttatgcattttgtccctcggttatttttcaataatagaatataagtttcatcctctgtactactatgtccagccatggacactaacacctgaacctgttcgaccatataccatatccctgcaaacgggcaacaccatgtcacagtctagtgatcttcaggtgcaaacctgcaattggggctctgtttaaaggactgcaaatgtgaagggaaggatcatactgcaaaatcattgctatggaagacatacgacagcacaagctacgatgctatgaatgcgtagtcagtcacaactctgcgagggtatatttctcccgtcaaaaaaaaaaaaacaatcatgctggataacgtgttcttcatctgtcccataaaaaacttaatattaggtttgtatctggacatatatttatattcagattcaaaattaggattgggttttttatgggacagagaaagtatgtataaatacatctttagaaatagatttttcatttttacggggggagtacttacaaatgaaaatacaccagggtgtgcataattgtgggcaccagatttaaatattggtagtatatgtaccatcgatatggattcggcagtggaaatatctatatgtatctcaccgcaacactttttgttctttcgctaatttccttatataatgcaaagcggagagagaatacttgtttgacaagtttagagcatctaagtcagtattatcgattgcaaagttataaaagaaaatttaacaattaataactttgttgagctacctgttcacccctcctaccaaatatcactcatcagccactaataatcaattcaacaacagagccaaaggattaaaaattcacaatccgtctccatccctagctaaaaaaaaaattgctcgcttaccaagttaccatgattaacatttcttttatatatagtaccagtagctgccaagcaaagtcacattatgggcatgtttggattcttcaggctattaaatatccttacagaatcttgctatttagtagtattaaacgtaaattactaacaaaactcattccataacctctaggttattttgcgagacgaatctaacgaggtatattaatccataattagtggatgattactgtagcatcattgtagcaaatcatggattaatatacctcgttagattcgtcttacaaaatagcctaggacttataaaataggttttgttagtaatctacgtttaatactcctcaataacaagattccaaagagtccatcgaatagctcaacgaccagcttgctttctggtatcttagcacaaacaatcatgtcagtctactaataagtgaggaaaatatcttatacacataggttttcccaacacacttcgtgcacatttttctaatagccgtaacaaaatggataaaattctgacatatcattactcttaaaattgtaagaatttttttctatagataaaatataatgaatttaattatgagacttacattgatcggttttccgatttcttcggtctccacatattaaaacacatgaatccgaacaccgaatcttcacctattataaaagttttaagatatttttgccgaagactttcatacgtcgcgcagtctgattccctccagtatgtgaaacggacaactctagggtttgctatatggcttgattccgagatcgatacgatgcgattttgctctaattcttggaaaagggaaatagaaggagataaggatcaaaacccctcaatcaatttcggattatctccgcgaatgcggatggatttcatcgaaggaggcggtggtttctagcggcgtcgggaagctgtggagtcggacagaggtaggagacgacactgtggcattgggacccacgtgacattgggacccacgtgacagggagaggagaagggattctgattagactttctggttgtttgatgggccagatgcgcgctttcaggccgaggtggaagggaggagtatgggctaaagaaaaaatgggctcaaaatggcccaggagaaaagagggttttcatttagattttcatttaaataaatgctaaaataatgtttgtattattaaaattagcaatggagctctgaaaatactgaaaatttttcacatagtgtaattaatcatggagaatttaataaaaattaaatccagccatagtttatttggaaaattctatttccacatttaccgtgacttttatgaccctttcttttcttcaacatcgtataaatgtattccagtaaaaaaacatcggatacatctatagttgcgattttatattttaattaattacataatgtaaatatttctcaaccttttcttaaatttctcatgttttttcccattgcaatgcacaggcattttttctagtaataaaaacagaaaccgaaagaaaagaccgatcaccgaaaaaccgacagtttggttctgttacggtgcggtccggttcggctttcggttgtcaattttttatgcccacccctataatcctgctgtcctggtctcttccctaacatatctctttcctctcctcctcaagtttggtctccactccagtgcaccaccgtagaatccatcacactactacataaatgatattcttgtacgctgggccctgttgtttctaggcggaccatgattgggaccgcatgagataatggggcaaccggcgccgggcggacgcccgcacgggaaaatagattatccagtgcgggcatcttaatccaaccgcacaggataatcctcattatcccgtgcggttgacttaagtggatcgcacagaaaaatcgattttcgcgtgtgggctttttaagtgaaccgcacagccatataaaatatcccttcctattttccctctcacgcacttcaaatttttcacaccctctctcctcccctcccctctctctcctttctctctcttcctctttcctcccctcactgagcggcctctttcctctcctcccctcctctcctcaccgagcgcacggggctccacgggcgccgccgctgatggcgcgggaggcgacgcagctgctatcggcggagcggtggcgaaggcaagcttgcggtgaatacaatgacgcccatcgacggcagtgcgatcaaccagccatgtaggtgaaaacaccagtcgacggcagcggaggcaagccggtggtgaagacgtagatgcccatcaatggcggtgtgaccagccaaccgtatagacggagacaccaatcagcggtggcgcaggcagccggtcggtgaatatgtagatgccaaacaacagttgtgtgaccaacaacttgtagaggcggagacagcagatggcgacagtgaaggcaaccggtcagtaaagatgtagacgcccaacaacggtggtgtaaccatccaaccgtgtaatcaaggacaccagtcggcagcggaagtaggcaggccgacggtgaagacgttgatgcccaacaacggtgatatgacaaccaaaccgtataggcgaggacactagtcggcagcggcaaaggcaagccggtggtgaagacgtagacgcccatcaacagtcatgtgaccatccaaccgtgtaggcgagacaccagacggcggtgacgaaagtaggccggcagtgatgttctgactgatccatttccgacgcgtaggagataagcttaaagccatgaatccctattatgcatatctggatttggatcttgcagaacaaacatataggctaagtagtatttgatgcaaatacagtacttgagaaaaaatcaagtattttaaaatgtttataaatatgtatttcttctgtcgtcaattttgatttcctcgaacagatggctccttacgtttaaacactctgcccgactagtgattgcccccacgcaccgggagtcatccaaggcacttcccagacatgcaaatgagtgacatgagttcgtcattaatggaacaaagtttcacggatcagaatttactactcaggtacttttgcaattgtcaagagcagaaaataaattatctgacctctatgcttttgattttttttttcgagtaatacttagcaccttgtgttactcggtctatccaacaagacccgggtgctaggaatcggtccaaaggcaactatccatcgacaaaccaaacggaaagcatagaaagatagaattccataactcgatagacacttttgtacttagattatgtcgcaagcaatcaagataaatattatgaaatttgttgaaaaaatatgatataacatctgtagcccccgactcactagtcaacagtgaaccagttgatgtagtgaggtagaggaaaaggaaaatatcacatagagaataaaattaatgatgagttagctttttcgtattcccttggtgacagtagaagtagccgatgtggaaacgaagtagtccatcaatggtgacgaaaactccagtcagcggtagcggaagcaagcctatggtatagatgatgaggcccattaacggtggcagaatccgtcaacctcataggtgggacacgatgctaatgaaagcgagaccaagctactcctcattgaagccatcaatggctgccgcccgagcctcgagggtctcaccgtcgagcagattaccagcctcggatggatggcaaatgcacgcctcaagattgtcaacgaccgcctcaagaagctccatgaggaaggcctcataccagcatccgtgtcattgttgggcaccgaggtaccaacccagagggagggatggctgatggatgttgcaaggggcattggctcaatggggtacaatcggttcagaggtagtagcggaagcggcactgctggatacaatggtgacctggcttagcctttcagcagtgttgcaggattctcacaagccaatcaggaattttcagtcccacccaagtaatgcaagattcattatcattttcctgcctggccaacatggcaaaggtggactttttctgagatgatattttgccagagaaaccatggtcaactatcgattttggagagtgtcaatcactcctttatttacatcccaatatatcattcctttctattttgtatcccatcatcccatttcctttttttaatcataatatcccttttcccttttttagatacctacaaactattcttggttcatgtatttattgcatctgaattaccagcttaatgcttataaacaatgaaattcctatctagaaaatgagctactagaaaaacaagatctgagtggatcaattgaaaaaagatctatgttcaacacaagaaaaagaaaaatcttaagtgcaaggaaaatgggttttttgtcgattcagcctacagtaccatatgaaatagttgaagcatgaaacatagtaaaactttaattttcccacaggatctcatgccagaagatgaatcttttcccacgatatttgttgtcctaacgaggcagacatgtttttcctatctttctttgcatcgtgttggtttcaggtgacaaaccacatgtgcactattcagtggcagacgcaggattaaaaaagagttggggcggaaatgctcgcttcataaggacaactaaacacaacaaataccatatttatattgtaatcgtataaaaaaatagtataatcaataaattcaggcagacaaaaaaaattgcgccatacataattcattatacaccaaaagataacaataaacatgtcaatttgtaaatatgagtcaattcataaagcatggtggataaaatctttaaataataataaatatatgagaagacataccgctgataaatcactgagcctttctaaggaatctaggaggcttagacaattctattcgttcatggcctaactgatgaagatgaggttggctgcctagccggctagccaccgacaggctgggccactggggtagtgcaggcgcctaggcggcttgtgcgatggcaagctgctgcctgctggcctggccgtgcgtgtggcgccgccgcggggatggtcggagggtcgcggggacgggcggacgaccggaggacggcgtcgcattggcgcgtgcggcaccgtctcgcagagcaggattgagcggcgtcggcgaagtggcagcgaataggcggaagttgaactgtgcgcgtgcggagtggcagagacaacagcgcagagccgatcgaggcctggcagatgaggagtcgtgtgcagcttgtgtcacttgggctttacttatgggctaattgtggataagaagtggtggtaggcagccccaaaggggtggggtggggtggggtggggcggcgcgggctgtagctgggctggccgacctaccctgcccaatgggtggttccgcccctggcgctatatttggaatgcaaccacgcacaacggacctgattaaagcatttatgtggtacgagtgcttcatattgccgatatattttgtgttttttatgaaagaacatacagtttgttggacaaaatattatctcagcgaacatggcaagtgctccctccatgggagacaaggagagagctcaaccttgaagacctgtagggaggaggtgggagcttgaggaaacaagaggtggtagtgtggagaggatgagaatgggtcttccccaccttttgcccacttgagagtttaggctatgaattttagtttggatctcttgcatgtcctttccgctagttgactgttaaattcttatgaaaaaacacattttgccctttgctacgaagaagcatataaattaatagagtgtattattggagcgtaaaaaattgttagatgggactattatatttatgagttagttatgcaccataatatttgcgataaatatacatttagatatgacataaaaaaatacttaattattttttattgcaagttgtttatgtttcatataaatatatttctcttatacaacaatctattgtattattattaaaacacatatgtgttaacagtaaaatttggtaagcccctaagagaataattacgtcgccaatagtcggattcctgctatattcggttaaggaaattaatcgattaaaggaaacttatccaaaagtgtccgagttcgaggaggatgcggtatggcaagttatctattaattaggaatagtttattagtttccttttatctttagaaaagtgtgtttggtgtcctataaggactttatgttttccttttatctttagaaaagtttctttcttgtcctacaaggactagtatctacctatgggtataaatatgcacacccagggtcattgtaatatctccacgatcaatacaattcggtgcatcgccaccttttacctttcctactttattttatttatcatggctcgacgacggtgtggcggcggcacggcgagcaatgcagccgcggccgagccccctcgacgacaatgacagctgacctcgacgacgacaacgacggcacgacagtggtgagctcgtgacaacgattttggccttggaggaaagtagacgctattgtccaattcatcaaatctgaattgattggttgataactctgaactctcagacatgttgattaaatcctggacttgatacttgagaaacctggagtagaccgtggcatcagctgagggccagagttgtcgctcaaaatgttggagttgcctgctctagagcgaggatgaagataatgactcctggagttgactcgttagctgattaattgattgcttcattttgaaataaagcttgtcgaattttgagccttgtatttgtggagctcctgactatgcttagttgaaaaacaacagatcatagagtcaaaaaccgttgcttgagtgaagatatgcgttgaggatgtccgagtagaaatcttgaagaattcagcaccacatgtagtagtagtttaatgcggtgtcgaatctggtagcacatgccaagatatcgatcctgttgaagacatcctggttggtgaagtagtaaagctcgcaatgtagaggcaatagagttttcggatgccgaagacaatgaagatgaagtcgtcccaaaattataacagagttgcacagccgtggtaacgtgaacatgagccggcagcaagagaggtaaaccggtgatgaagacgcgtagtggaagcgaggagatgagtcggcagcggacgagacaactggtggggaagaagataacgcccatcaacgcagccgtggaggtgaagaaacaaatcggtgttagacaaggcggcaagccatgaagtcgaaagtgtcaagcaatgacgacggagttgtgcacccatggcggtgagataattagtcggcaacagaagaagcagccggaagtgaagacgatgatgcgcatcagaagcggtgtatcaggccagtcatgaaggcgaagacactagtcagcggcgatgaaggctagccggtggtgaagacgaaggtgcccatcagcagaggcatagcaggccagtcgtgaagttgaagacaccagtcgacggcgagtaggcggctggtcaatgaagacttagacgcccaacaacgatggtgtgaccatgcaaccgtgaaggcgaggacaccagtcggcgatgatgaaggcaagccggtcggtgaagacgtaggcgcccaacaacgttggtgtgatcaaccaaccgagaaggcgaggacatcagtcgtcagagacaaaggcgagccggtcggtgaagacatagatgcccatcaacggtggtgtgatcatccaaccatcaaggcatgccggtggtaatgttctgactgatacattcccgaagcgtaggagataaacttatagccatgaatccctactatgcacatctggatttggatccaggagaataaacatgtaggatgagtagtatctgatgtaaataccgtacttgaggaaatttcaagtattttagaatatttagaaatatgtatttatcctcgtatcaattttaatttccccgaggagataactccttgcgtttaaacactctgcctgattagtcatagccccctagcaccgggagtcggccaaggcacttcccagacatgcatatgagtgacataaattcgtcattaatggaacaaagtttcacggatcagaatttactactcgggtatttttgcaatttgtaagagtagaaaacaaattatcttatctctatgcttttgatttcttccgagtaatacttagcaccttgcgttatacactccatccaatgagcccctgagtgcaaggaatcggcccaaaagcaactatccattgataaaccaaacggaaaacatagggatatagagctccataactcgataggtatttttaatttgattatttcacaagcaatcaagataaatattatgaaaattgttgaaaaaaaagatataatgtagcccctgactcactacttaatggagaaccaattgatctagtgaggcaaaggaaaagaaaaatatcatataaataataaaataaatgatgacgtagctttttggtattccccttggtgacaacagaagtggccgatgtgggaacaatatcgtccatcaatggtgacgaagataccaaccgtggaagtagctgagatagcggccggtggtgaagataaaatgccatcgacggtgatgaagataggccggtgataaagacgtggatgtccaacaatggtggtgtgaccaaccaaccatgtaggcgaggacaccaatcgacgacggtgaaggcaaaccggtggtgaagaaacttgtcggcggtcgcggcggcggccgtcttggccggtagagaccatggcgaatttggatgtagctccaacagtaattagatgcatccacacaaacagatcattaaaccgatccatgctcttgccatgcgcgcgtacaagtcacagatccgagtccagatcaaatcctagtccgagggaatcgggctcgggcaactatggtacgtgcaaaataataaaccacagatcaaattgagattagtagtaataaaaagtatagatgtacatgtaaacgcatgcttttgcatactcctgatggcatggaggatcatattgacggcgccatgactggttgatgcatgccgacttggatcccggccagaacaaccgatagttgacgcgcgtgtgggtgtgacggcacagtcaaaggctgtcatgaacagccggttgatcttggtcggcatatacgaacatgcaaaagaaagcaattagtagattaatctgttattaaacggagaaacatatagacttgtatatgtaagagtattaaaaaattaaagatgtttccttcgtccgttaaaattaaaaaagtagcgaaaaaacaacagaaaacctagacaacggtatcccgttggaacgggatacccttatatgagacaagacagtacctgatacctgatacctgttgtgttaccagctgcatggtacccgatacctgtgaaacctgttacccggtacctgtgatacctaggacctgatacctgtgatactcgtgcaagacaattgttaatatgtctatcccgttgcaacgggatcccgttt

SEQ ID NO: 90699 - DNA, 1194 bp, Oryza sativa
tggtcacactaccgttcatgggcgtccacgtcttcaccggccggttttccttcgctgccgcccatggtgtctttactttcacggctggcctattttgccgccgttgaaggacgttgtcacgtcccaaaacgaccctaaaatatatcctttaaattatgcctagaataattaaaatccgtgtgaaagcctccaaaaattaaaatgtgcaaagtaaaagtcaaataaggcttagaggatttttgtatatttcctaaaagcctaaaatgtgtaaataaattttagtggaattttcagagcacaaataataattgttaagaaataaacaaagttgaaaaggttttataaaaagaaaaaaaaccctaaaaccctccctccctctctttggccggctcggcccacttccctcctcctctctcctcttcccccgcggcccactcggcccctccccgcgcgcacgccgctgacgggcgggcccgcccgccaccgtcgctgatgggtggggcccacctgtcatctccttcctcccgccgctcccgccgcctcgcccgcgcctagcgccgctgccgccacgaatcccaccgcctcccgtcgtccccgcgtgaaatcaatagtggggaattactctccgtgatcccttctccctttccccccatttttccctctctctcttgcattcaagcgggcggatttgctcccgcaaatctcgccggcgccattgatggcggccggacctcccggccggtttccttcctctcccggccgccctctcctccttccaaccctatttaaaccctccccgcgcctccctcgcccgtttccgccccttgccacaccgtctcctcactggcatcgagctcgcaccgtcgccctctctctcctccgtcgacgacgaccttcggccggctctctccactcgccgggaccgtttcccgccccggcgtcgcgtcctccggcttcgccgcaccgtcgccgtccccgttgacccccttgtcgagctcgccgaccgccggtgcgccgcggtccccgtcgacccgagcagcgccgccgccttcctccgctccggccgcctttttcgtcgtcgccgtcgacctagggtgagccgtggaccgccgcctcgtttccccctttccctcccctctctcggccgccgctccgccgtgcctatagccgccgccggtgaccataggggagcgg

SEQ ID NO: 90700 - DNA, 894 bp, Oryza sativa
taacagcacaaatcagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagtgctcgagccagacggtaaacaagatggctgaggtcaggcgtcaaggaacttacatttacaatgcgagtcgcttggttgagtgcctttttcagtaggcatacctcttcatcttctttttgccggtttattacaattccttgaggttgcaagttgtcatcccaccacttgaccagaataggagggcacgaatctttggctgcttgtatacgatgaatttctttttcatcaccgatcattggtcctaatgcatccattgacaaaggttagacaatcgatcagagttatttgggtcaacatggtttcagacaaagtgtttacctgtaatgatttttggacaaggacgagtggattcggatacttttaaaggggatccagatctccggtcattgctggcgtcttgtctgcgagggttgtctgcttgggtttcgacttctggaatctcttggcttggccctgcgtccgactggtttccagtcgggggctcctgattaactccggcttcggcttcggccgactggattccagtcgggggttgatcaccggattctacattatcggttgccggttgattgtcactcggatgatcctcagcagttggctcggtttctttggaagaacttgtgtccacgttagtcgggtcagagtc

SEQ ID NO: 90701 - DNA, 1080 bp, Oryza sativa
cgcgcttttcaagtttttttatgggagcacgtacatcggtaggcatgcaaaaatagggcaaaacgtgtgagtacacgtacgtgtttggcgggagttttttttaatgagttctctaaactgttattgaatttaaaatatgattaattagtttttggctggaagcatacaaactaggataaaatatctaatgaacgttgtctagtttgaatgtgtaggaaaatgtgattatccacgttaattttatatgtggctatctatttagatttagttgttatgtaaatattaagaagtttaagagataatatgtaaaaattgtaatgggagtatgtgttgatggcagcttcaataccaccaccattgaattctttttagaggagtatagataatatcttattgggagtatattaatcgatgtttcaactcacatacatcttgtttctaaaattgtccatttcaatcaaagtaaaaaaataagtttgctatacatttattattgaaacgctcagttaggaaaaaaccaaactagacataaatgagtaaaacattacgacaagttttttcttttaatggtatgcaaacttaaatgtaagctagatttccagcacctcggtgcaataatccagagagtgccatgatgtaaaaataacttggccagcactatctcttaggatcattccaattcctcaaactccgatgcgccgtcattcttctgctggccctgcattgcgccggggtattcgacggcacctgacatgttgaaaccagagccgaacctgaactccgatgcgccattgatgtcgcccatctggttaccgaatggagtatcgtcgcggatgaagaactgctgctgtgccggggtggtctgctgcggttgctgcatcatgccattgacatcttcgaacacacctccgttgctgccgccgatgccacttccctgtccaaaaaagccttcttcaatctgtatccttgggttgactgcattaggcctctccatgatcgtggcattgtcgttgctaaggttcttgttggccacgaagttgttgtcgtacatgttcatcagctctgtaattgacctctggc

SEQ ID NO: 90702 - DNA, 1186 bp, Oryza sativa
aaccggcatttggtgaggcatttccaacacccgatacacacgaaatcgtggtatttgctcatttcttctacggcggattttctcttccaaccttaagatttttccggggaattctgaacttctacgggattagcttgcatcatctgaatccaaactccatagtgcatattgccaactttattcatgcctgcgaagcttttctgggcattaggcctcatttcgccttgttccgccgcatcttcttcctcaagccccaaccaaacaagagtaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgtcttcctccagtttatcgggatacttggaattcactgccaatgggagacgaagctgcacaagcagtagaactgatcgagaggatgattaagctgaaagatcagggccttcaaggaaaacagatcacccggcactttatcaagtgtcggttagctctaatcaaagaaagatctcgcacagccttcgaatttgacggcaagcatgatccaaaccgtgaagatccagattctcttgacttcaaggtcatgaaggaaaggatgtataagatcttctcaaacgccatcgttgttagctactctcacttgctgccagtcataccgttcaatgcattcaatcctcctccactggtacgtattcatacacttcaacctttctcaaaatatgatcttgctttcttgttgaatcagttaacaatgaaggatattacacccaggaatttgctttgatgaagtcggatcccccaatcgctcaacgccgatcgccccgccatcaaactgggcaagggagcggaggaccaagaattcggtctgaaactcaaccaagtgcttctgatccaatcggccagtcagattctcgaaagaagaagctggttctaagtgacgacgaagccgatgataccgccaggaggcctggagaccgagagacaaccaagaaactaccaaaacaggctactccaaggaagaaaacatccagtcgccctgtgccaaagatcaggaagtcttctaggtgcaactcatataacgacctctcttgcattgatgcgcac

SEQ ID NO: 90703 - DNA, 1555 bp, Oryza sativa
aggactgaaggtttttaatagcttttgcgggttttaggctcaataaggcttgacaaaggcttttaagaaatcagaagctaagtatggaacaccaagcatagcataaattcatcagtattgtacaaattgagcctccaccgtcattgatcatcaaaatcattgttatatcaatcagtatcagttttttcatcatcagacttattagacccagtcggccgaaggtcgacatattggaatctctcaactacatcagcagcaatcttgtcagccgctttctgcgcatcattgatgaggtcaagagcagcttctttgctcgtcccgtctgcaaagccatcaatggcatcaatgtcaactcttggataaagggatttggtcatcgccaatgccagacttgctcccatacttccagcttctttgatgttcttgaagtaagtatctggagcgactctcagcttgtcgaagatttcggcagcatcaagtgtactcgaaccggcgttattgaagaacatggcctggataagtggagtagcggcattagcgactttatccctggctccttcaagcttgttgatcttgtcaactaagacatcaaattgtgcttgagacttgatcttgcggtctgcgtcaacagattcacattaatgaatcagcatgtagaagataatggcttttgaagtattgattattggtaccttcaacctcctttaaagccgaatccctctgtcttgccagctctgccttgtcattttccagagtttggatatgcttctctagttgagatatcttggcagcttgcactacattaacttcggttaatcaaggttacaaagataacagcacaaattagttgggcagagtttgcgcgaaccttttgatgagccactcagttcgaaattggactcctggagctcagcaatccgatccctcagatcgtgttcattcttcttggcaagttctctggcctcgtgcagttgactcctggtggcttcgagggttccaagatgaggaactagtctctctagggttgcggttttcgcctcgttcctaagatgaatcctctgcggagcagtttaatcagcgctcgagctagacagtaaacaagatggctgaggtcaggcatcaaagaaacttacatttacaatgcgagtcgcttggttgagtccctttttcagcaggcatacctcttcgtcttctttttgccggtttattacaattccttgaggttgcaagttgtcatcccaccacttgaccagaataggagggcacgaatcttcggttgcttatatacggggaatttcttcttcatcatcgatcattggtcctaatgcatccaatgacaaaggttagacaatcgatcagagttatttgggtcaacatggtttcggacaaagtgtttacctgtaatgatttcaggacgaggacgagtggattcggatacttttaaaggggatccagatctccggtcattgctggcgtcttgtccgcgagggttgtttgcttgggtttcgacttctggaatctcttggcttggccctgcgtccgactggtttccagt

SEQ ID NO: 90704 - DNA, 6880 bp, Oryza sativa
aaacaactaagggtgatataacaatatcggccattgtatatcggcaaaccataaccgattacaatttgaaaaaccgactaagggcgatataacaatatcggccatctcaagacgatgaaaatacatcggctatcatgtatcggcaacacagccgatcatgcattaacccaaacacttgggtaatatttcttcaaatatttgccatttagtgctctgccataaacttctccatcgagtccttgcaacatgtaagctcctttagacacaactttataaatttgaaacggtccttcccaattcgccgactacttactgaatttgttatcccgagttccaatcggcaaaatcaacttccatacaagttccccctccgaaaaatctttgggtactactttcttattgtaatgccgagcaacacgcttcttatccttggtaacttttgcaagagctcgcaatcgcgactagactagatcctccctctcatcggccataaggttgtaatattcatctgctgttaaagtattttgcaattccgttcttctagagccgattctaacttcccatggcaaaacagcctcatgtccataaacaagtttataaggagggacttggatcgatccatgacacgcctaccgataagaccacaatgcttcggcaaccgagtatgccattgccgaggataatcagaaattttcttcttaatcaatttgatcaggctcttgttagatgcctcagcttgcccattagcttgtgcataatatggggaagaattcaacaatttgatacccatgctatcagcaaactgaacaaactcatcggacacgaaaattaagcctcgatcggttgtaatagtttgaggaatacaaaactggtagattatatgctcttgaacaaactgaattgcatccccagaatcaactttctttaaaggaatcgcctctacccacttggtgaaataatcggtcgccaccaatataaacttatgtcctttactcgatggtggacttatcatatcgatcatatcaattcctcaacctttgaatggccatggcttaataataggattcatagccgacgccggcactcgctgaattgctccaaacttctgacaatcttgacaccctttgtaatatctgaaacaatcttccagcattgtcagccaaaaataccctgcacgccgaagtaaccacttcatcttatgagccgattgatgagtaccacaaattccttcatgaacttcgccgattgcaactttagcctgatcggtactcaaacacttaagcaacaccccatcaatcgtccgatagtaaagctcatcatccaatagactgtacttcaacgccttatatctcaatttcctagaagccgattgagatggattatgtaaatattgatgcacatcatacctccaatcatcggctgttattgctgcaatttcaaccttagcatctttgatcatcggcttatacctcgatgccccctgggccaaatcattaggttcaatattttgttctcgagacacatgctttaaagtaaccagccgaaattccttcatcagttcttggcacttctcattataaaccattaatgtatcattcttgcattcatattctcctgccaattgactgattacaagcaaagaatcccccatgatttcaatagcatcggcttcaactaccttgagtaattacaaccctttgagcaccgcctcatactcagcttgattattagtcgcataaggtttaatagtataagcaaactcgaaacatgcccctcgaggggaaattataaccaagccaatgccacaaccattagtacataccgacctatcaaagaataaagtccatggcacaatctcgaccgagccgattgaatcatcaggatgttccacaataaaatcggctatagcttgtcccttaattgccttcggcgactcataccgaagatcaaactcagttaaagagaatatctactttccaacccttcctttcaaaattggagccgataacatctatttgacaacaccagccttgcatatgacagtacactcattggatagtagataatgcctcaatcttgtacatgaaaaatataggcacaagcataacttctcgacagggaaatatctagtttcagcatccaagagccgacgactaagatagaatacaactcattcctttcaatatagctcctgaatcaagactgagccgattgacttctcaccggcagatagatacaatctaaaaggtattcctttctatggaggaattaaaacgggaggagaactaagatattccttaatattatccaaagctttctgctgctctgccccccaagtaaactgctgatcggctttcaacctgaacaatggtgtgaaaggctctaacctaccggataaattagtaataaatcttctaacaaaatttatcttgccgatcatctcttgcagctctgtcttgttctctggaggctgaatcttcttgatcgcattaacactcctctgagtcacctcgatccccctctcgtgaacaagaaatcccaaaaactggccagccgatacgccaaaagcacattttgtcggattcatcttcaggccatattttctggttctctcgaaaaccttcctcaaatcggctatgtggtcctctatttctttagacttaataaccacatcatcaatgtaaacctcaaccaaccagccgattagatcatggtatatgtaattcatggctctttgatatgtagctccagcactcttcaagccgaaagtcatcacaacccatatgaacaagccgattgcaccaggacacctgaaagttgtcttatgaatatcttcttcagccataaagatttgatcataatactcccaagcgaagcaatctctgaattcttttaacagctctatcaacttggttctaaattctgcagataaatttttactaataaacgtcggccttggtcggtcacctagacctatatcaatttcttccaaatcatcagccgacataaaaccctacccttgtttgtcatcgagatcatctaccgtgtccttgttgtagacatgtgaatcctccacggcgccctcaaaataatagcttgggctctccatcttcaattggctgtatatcagaatcggacacttttagaaaatctccatcccaaacttttccagataaacaatcaagaccatccatctcccaaagagctaaatcggcacgtgtaacattgactgacctgtcggctggcacaatttcaatcttgtcgccttgccactgaatcaagcattgatgcatagttgaaggaatgcaacaattagcatgaatcccatcccttccaaacaacaagctataagaacccttcccatcaatgacaaaaaatgttgtggggatggttttgttgccgactgtcagttccacgttcaaaactccttcggtttctgatggattgccgccaaagtctttaagcaccatgtttgtcttgatgagatcttcagcgtttctgcccaactttctgaatgtagcgtaaggcatcaagttcattgtagccccaccgtcgaccatcatcttggacatcggcttcccattgacataaccatttatatacaatggctgaagatgtcaattctctgtcccctctggcttctcaaaaactacctgccctggcgacaaaatcaatttagccgattcttcttcaacttcatcgatatcggcttacttgatcccaaactcggcaggcaaagtgaaaaccatgttgaccgaagcagttacgacgctttccctttagctaacctttttgcttcatcagctgtggcttcatcggctacaggaacctgattcttaacacgccacacccgcctcggcttcgttttcttcagcaaatggttaatttcctgctcgacctcctgaaagcgctccctgttcctcaatctttgaacccttctcttttgattcttcgtaaagataccagaaggacaccattgatttttcttgttttcattgtcctcttagccacgatcttgattcactggacccaatctttgatgaacaggaactcttgtctgccttagccgattgcccctactatatgatcggcttgagctctcggcaatatcaccgcacctaggacagtcttcaatagattgcaacctcataccttcattccaacaacatctaaagaactcacaacccaatgaggatcaaagccatcgtcgtcttcttcatgatgcttctcctgctgcttgtcatacttcctctgatatttgttgataatcttagccgaattcacctgaaaaccccttgcacgaccccgatcggctgttcggccagctgtatgcaccatattaacaggaaaaggattgccatcaaccttcatcggcctcttagagtcatcaaacttgattttgcctccttcgatagccgcttggatctgctgcctgaagaccttgcaatcattagtcatatgagacccagaattatgccacttgcaataccttttcttacctaattcttcagccgatggaattgtgtgactggcaggaagttgaatctgcttctctcggagtagcaagtcgaaaattttgtcagccttagtgatatcaaagtcatacctctccttttttcctgagctctttacccattggcatggtataacctttttactccttacccactcagctgcagctatctcataatcatcatcctcatcgtccgatccatatatataagggcaaacatgattaacctttctagaatttttcctagcctctgcatacctttgttcatgcaaggctaccttctgtgtaaggtgtgacaagctttcaaagtcttcatatgagaacttctccttaattagagcaatcataccctaaaaagccaaatcggctaactgggcatcagtcaaactcaagctgtaacacttatttcccatctccctgaatctctgaatatactcatgcactggttcatcatgcttttgcttgatcgatgttagatcagacaatttcatctcatgaatcccactatagaaatagctatgaaactgcttttctaaattagcccaactattaattgatccatacggtaaagaagaaaaccaagtaaaggccgatccagccaaagacaaccggaataaccgaaccctcaaggcatctacagccgatgcttcaccgcattgagctaaaaatcggctaatgtgctcataagttgatgtactatcttgccctgagaactttgaaaaatctgaaactttaaatcggttaggcagaggaactctctcaaactattcaggatatggctgtcgatataggtttccagcgtctttcggcctaagcccgaactgctccttcatgacatctacaatcaaatcggcccatggccgctgttgaggtgttccttgaagttgttgtggcataggctcaaattgattgtattgaggaacaaattggggctgagccgatcctgcttgctggtactgaacatgaggtgatggtgggtgatattgataattcaagttgcccccctggtaattttgaaggtctggctgaatattgcacaccaaatgttcaggaataacttgaggaacaaccgtgccatctggctgcacatgatgaaccaagtgttctgggacaacctgatttgcggcatgctgcatgggttgaccaccaggtgttgcaaacccagccgatgcattcatcggaccttgctgctgaatcggctggacaacctgttgcctcaacagtgtctgctgaatcagctgcaagacctgtcgtcttggtggcgtctgctgaactggttgcacaacctgttggattggaggtgtttggctgaactagttgcacaacatgttggattggaggtgtttgctgaactggttgcacaacctgctgccttggtagtgtctgctgaatcggctgctgctgggctggatcaatggtgtgttgaggacgtaagaacatagatgcaacctggtcttgcgttagccgattcacattctgtccagtgtgctgtggctgttctctcaccaacaatcggggattaattaattggcctggggctgaaggtggtgcagtaggtgcgggagccgatgctggtatcgtcggctgagctgatggtgcattaagagggactgactggcgactggtagattatcggtgattaacggccgataattcgggaacacccctccttgtaggtaaactggtcctgtaacctgatactcggccattgaaccatcaatcattgacttcaccatatttctcagattgattgatcaaagcatggtgtacagtgtcacatcctgatttttgtttcaggatttataaattatttaataaattattattagaatttatattaaatgttctttaatttacaagtgaagttaaatgtggaaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagatctaattttaattaataaattccaatataaaatggggccagataaaatttcattaaatactttacttgattctatagttcctagatttttctaggatttatttgagccaaggaagtatttttaatcaatggaatatcatttcatgaataatttaaattgaaaaaggtttttaaaagtctcttttggctttgggccgaaagccggcccaaaaccgctctctctctcctccccg

SEQ ID NO: 90705 - DNA, 541 bp, Oryza sativa
atggaaaatacccacaaggctagttaaactaaccttttgaataatgcatgtgtccaagcgatgatcagtatgctgtgtgcaaacaatgttggatgaaagcactttcatttctacagcgtggaggaaagactagtggaagttctttcagctttgggcaactgatgaatacatcacgaagaacaggaaaagcataatcgacagaagaccaatatactagttctggcaactgtgtcaattctagtgtttccagggagggaaaaccagcaatcccatagaaagatgtgtctatacattctaatgcatccattctatcaatatgaagtttcttgagagatggtatctggcctaaaggaggaaggaacttccaacatgtgcagttgtgaatgctgatgtgtcgcaatctagatagccactcggactccagccaagacggagatgaacaaccttggtatccatcaacagtcaattcctcagggccagggtgaggtattaaagaattaagcacattctgttcatctgacctgctatctgcattacaaga

SEQ ID NO: 90706 - DNA, 544 bp, Oryza sativa
tgcctactgccgttatagccaacggtagaccttcacacctgccaacaatctgtcttgctactcggtccattgcaggaggacatgtttgatcttcaccgtgccggaaagcccacatgcaaaagaggtcccaagactctgcctcatctaatcctcgtagttgaagacggcgcttgtcttctgccaaagaagcaacatcatttatgcgagtagtaattaccaccttacttctgatgctgctttcatctagaaagccttccaagctgaaccaaacatttgtatcccacacatcatccaagaccatcatgtatgtccttccctgcaaagtctcctggagcatcagcactacgccttcactactcatgcttcctaagtcagctgagcatgtatccttcaatgcacactgtataatcttcctcattatttcagtaatgtcatatgtttgagacacggtaacccagatctggcaatcaaaacggttcttgctagctttgctttcggaaacagttttgacaagagtagttttaccggaacctcccatacccca

SEQ ID NO: 90707 - DNA, 583 bp, Oryza sativa
tccgtttaagtccattcaagtctcagtaaattcataaaaatgcaaggaatccattaaaaatggttttgtttcctgtttcagtagtcttatagcatgttttgcttgtgtgctttgtttgtcgcgtagatttcggccgtttcatcgatccgcggtttcccgaagacgttgctgtggtctcatcagtgcgagagcaaggcaagtcatgcattactattgatcatattgtacccaatttacatagactttgactatgagcatagctttggattggtgccaccgcaatggtgttagctaattaaaatacactggatggtgggctgtgggtgcatggttttgctggtcgcacccattgcagttaaggaccggttcacgggaaaccctgggagacttaccgtgcttaccacaagcgggagtgggtaactacttgatctgaagtatagctcgaccttttcctaggcaccggtggccagggtgggcgtgatggagtcgggtcggccagggtgtccggttgaccagctgccatattcaccctgcgcacgaaaggactgcccactgccttttgaggggcgggggtgaaacctta

SEQ ID NO: 90708 - DNA, 2602 bp, Oryza sativa
tccgcctaagggacttgttcgtgttttagagttgtaatagaagtagagtcgtgtccgacaaggacataatatgtgttttgggtataaatatgacccgagaccttataaacaaagagaccagctcaatatactctcggcgcatcgccaccctttttacttttcattgttgtcaacgagttcttactttcgagttgggctgcatcagtttcgatctccgacaagaggtaaagcttgttatggcggcttgcattctcgggattagtgcttacatctttatgacactctaatcctgtccatgtaaatcgtcgagttatcatatatgctatataatctagatcgaccttactatctgatctcgtcggctagcctctatcatcaaaaacagccgataggatccgatattatcgtcaaattagattatatagcatatccaccatcccgaaaaggcttccattggcttttttagatcttatgtttctctttatgcttaatgctgcatcaattgtgtttgatctactaagcaatatccagagccataatatctagcttgcttcaatctgtgatcactgaacttattcatgaaaatcaatatggtttcataaagcaaaggacaattcacgactgtttggtgtggacttttgaattccttcaccaatgtcatcagagcaaaaaagaaatcctcattctcaaaattgattttgaaaaggcttttgatactgtagagcatgcttgtatcctggaaattcttaaggcaaagggctttgacaatacatggatcaattgggtaaaagatattttaactacagcctcctcctcaattttacacaatggtgtcccaggaaaaaaaacttcaattgtctcagaggtgtaaaacagggagaccctatctctgctcttctgtttgtccttgctgctgatcttcttcaatctatgatcaacaaagctctcaacctgggagtcctctcccttcctattcctcaagttgacaccaagttccttataatccaatatgctgatgacacccttatcattatgaaggcgtgtcaaagagaagttttctgtctaaaaggcatcctgcaatcttttgccatgtccactgggttaaaaatcaattttcacaaatattctatgatcccaatcaatgttaatcaggatagaattgaaatcctggcagagacttttggatgcccaattggatctctcccctttacgtaccttggtctaccggttggaacaacaaaacccaaaatctgtgattttgcacctctcattgatagagtggaaagaaactcctggctataacaatgttttagaatcaaggacagagactaaccatggtcaactcagttatgtcatccctgccaacaaattacatgtgcacacttaaaatccctaaaaagattttgttgcacatcgatagagcaagaaggcattgtctttggagaaaatctcacgaaattgatgcaaaagctcattctttttggcagcatgggacaagatttgtagaccaaaaaaaagagggggactgggtgtcattaatttagaattccaaaactatgcccttttgatgaatcatctcgacaaatttttcaacaagaaaaatctcccatgggtaaaacttctttggacatcattttataataatagatccatgccaccgcatgcattaccagactttggatccttttggtggaaagacatcactcaactaatacctcactttagaggtttcagctctattcagatcaacacaggggacatagctcttttctagaaagatctctggtcagacactttacttcaaaactccttttccaccattttctcttttgtgaaagtgaaggcattcctctggctcctgtttatggatagattaaacgagacatgctacaaagaagacacctctctattcaggatggaccctcttgccaaatctgcagcttagatattttggaggatatgtctcatctttttttcacgtgcccatttgcccaaaactgctggaattctcttgcaatctatttggatgtgaatcttgatctctttgacatgattcaaactgcattcagaaattttggtcaaaacttctttgtggaagtggtgggtacagcatgctggcaaatttggttgaaaagaaatgctctcatttttgacaatgtccaaccatctttcaatatttggaaagctgatttcaaggaggatttcactcttcttttgcatagagtgaaggaggaagacatgcctaaatatcaatcatggattgacaacttattttatttttttcctctttagtacatattttgtaattttgatgtaactcatgttcatatattaatataattaccacagtaggagcctctcctattgtttaaagtcaaaaaacagggatagtatcggggtttcagctgatcttacctggttcagttatcttgttttcttatatgtttacttggtatactgaatctgccctttatattaagatctcgtttggttgaaatacgttaagctcactatcggtctgttagggtatactgacattgattcgattcttatttagtatatttaatccatactagtatcttagtataaagtagtaccgagt

SEQ ID NO: 90709 - DNA, 2762 bp, Oryza sativa
ctctcagctgacaagttccctcaaatccagtttgatttggcctttgacaaagagtttgagctgtcacacacttcaaagactgctagtgtgttcttttctggctacaaagtttcccagccggctgaggaagatgaatatcctttgtaatgttttaccatgtttggtcaatatatgtaatgcatataatgtcatactctattttattttcattaaggtatgtattacaatattgttttccttgacctgccttttttgttgttccacaatggattttgattctgaagaagttgaaggtatgattgctactagtgcttgtgttctgcctagagagaatttaacgagcctgtttataatttatttcagatgaagaggaggaagaaaagatcattccagctcccagggcaaatggtaccatagtttctcctttctgattatgattggaatcacagaatccttttgcacctctctttaaaactttataaggaagtacttatgactaaaacttttctaaggcaaagttgaagggaaggaaaatgagcagaaaaaacaaggcaagacagattcttcagcttcaaaatcaaaggctgcagtgaatgacgatgatgatgatgatgacacgatgaggatgattatgaggacgaagatctttctcctgaggatgatgatgatgtgagtaatttatgggtactgttgtgtattattgtggaggattgttccatactaacagtggtgcaatggcctgttataggattcttctgaggatgattccagcgaagatgatgaggatgagagtgacgaggaagatactcccaagaaggtatgtgtatgtgtttgaaggatatagtctgcttgtttctgtgcacttatatgtgtttgaaggatacagttagtttgtttgttctgtactcttaccataaacaatgtgatgacttgcagccagagactggaaagaggaaagtagctgaaattgtgttgaagacaccttcgtctgataagaaagcaaagattgctacaccgtcaggccagaagacaggttagtagctgtgaagctgcgcctgcgatgaataaattggcactggaagtagtgatgaatttgtatcatttggtcctcctgagcaggtgacaagaagggtgtccatgtagcaactccacatccggcaaagcaggctagcaagacccccgtgaatgacaagtcaaaggagaagtccccaaaatccggtggtgggtcaatttcttgcaagtcatgcagcaagtaagtttagatgcgctgtcttcttgttttggagtattacgtaaggaaatgattcaaagtttgcatgaatgcattgtttaggacgttcaacagtgaaatggctctgcaatctcactcgaaggccaagcaccccgccaagtgaagaatgagacaacggatgctgagctgagaaatattggtgtcgtttgagttggttatctgaaatgaaatgaaatgctgcaaactatttggtgttatgagtagtgtcgtgacggtttatgtggtgcaaactatttagtctagaaaaaaaaaatctgtggtgcgaactgagctacaattttattcggtcaaggtcagtggagtgattggtttattttggatggaattattgttcttccctgttattcggttaattcccacgagaaaggattgataacaccacactgaattgactagctgaacaaagtcgtaatatctggttttgccctcggccaaatccgaatattagggtgtgtttagttcgtgttttttgggtgttacattggatgttgaccttagaaaggatttttttgatacgaatgaaaaaaattaatttctaacttgcttggaaaccgtgagacgaatttattatgtctaattaaactgttattagcatttatagattactgtagcacttatagttaattatggactaattagacttaaaagatttgtctcgtgatttacatttaaactgtacaattagttttttaatgtatatttaatgctctatactctgcacatgttacatgtgttcaaattttttatatgagtaagaactaaataaggccttagtgagcattttagtagcggctgagcgcttgatcgtttgctgtctgcagccgcaaggcccgcaactacaggaagttttctccgccaaaaggcagcgacaatgcaccagccttaatatcagacaaacagcctctacccaacaattcggctcctagttggaactctttgttcaccaacacgagatggcactgcagctaggcagtagacacgagagtcattccagtttgttcgcatttgtccctgcccatccttttctatttttcgcctacaatataaccataagtatatcatcattgaatatggaatatttcttctcctttctaaaatatataacttttagccttcacaaccaatcacaactttccacctcttaatatctatgccttctccttaaccaatcacaaccatcacatatctaattttacctacttttttaatactcgtgttcaaccaaaactcaggttgtaataaaattttggagttacaacaacgagagtaacaacagcatttgcagttttacttaataattagtcaacagcatttgtgtaacgagttgtgtcgcatgctttattcacagtttttttttaaaattcaagttctttgacttacactcacccgacccaaaataaatcaacttttatatatctatgtcatcctttttaaagtgttagttttgaacatagtaccctgtaaaaaaaat

SEQ ID NO: 90710 - DNA, 4692 bp, Oryza sativa
  unsure (1)..(4692): unsure at all n locations
atcatcacatttgtgcttgcataaattttatttaaattctctcaggatttacttattgaagctgttgctctcaaatggagttgcacacaaaagaacatggcttccattgagctcgatacaaaggtatgctttgtgagaaactagttactttcataacacaaaacttcttgaattgaactgtgcatatttcttgcattttgattaccttgcagtgacccaattaatctccgcttggaaactttgcaattaatcacccaattaatcacagctgttttacaaatgtttggctgcttgcaataagatatataaattactaaaatactagtttggtctaaagcacacataatttgcacatgttacaccagaaaattgccatatttgcttatgtcttatcccgttccttgtaccgaaacaattcgcacatgtaatcatctgtccttcattaatcatctgatagatatgggagatggaaaaggatgtgaagaaacttgaaaagaatgctattgaagctgctaaagaatatgaaaactgtgagttgatgtttcaatccattcttttgttgtttctaaccactcagtttggcaaatattttggaaagtggcttagggtccaaggcaattttttctttgagtttttgcctttgggttgacaaatcttatgctcactttcatgtcatgctcattcctcaggtctgtttggtttgtagaggtgaagactattcaaaatccatcatgcatctcctgagtagatttttttttgaagtatagctatatcagaaccatgtgagttcttnngctgatnnnttttgnanactgggnnattaattaattncctttaaaaaattttaaattttttccctaaacaacgttagactttagtcccaggcaagtcatgggtattctaacatgtcgtaagttaacaactactctactaaaaaagtgtatttttattttctgaggtgttctaagaatctgttaagtattgactgacaaagttgaacagatgctctcttgggcttttgagttttgaataaagacaactatgttttgagactggtactataaatggtcaactgcggttgaatgtgcctggcaagcttataaaggcctttgtaggaaatttcatttctgtaatgattgagagtagtgtagcatatggcaagttggcaatacattactttcgtgattgattccatttgtctcatgctggcactatcacatgacatatgttcctctaatcaggtaaaagaaaaactcaagagcataagcagcagttgtctaatgcaaaacagcatgcagagtcaatagctatgatcaccgaagaccttgcaaaaaagtttcttgaggtactgtttgaatttaattttgtacttttcttgtcttatttgtgaatcagcattcacatattttagttgagttagcataccaactgtaaaatctccctaatctgcaaccactagatccttttataaaattatttttttaatgataaatttatcacaaaaccttagttaccagatttgcagcatagtttgtcaaacccaaaatcagatcacatgatttggggtttaccagcgatctacctgcacgtaccgtgaaagtcaagcaggaactcaatcaggatgagcttaacgatgttgctgggctgagccagtcaactacaagctcctttacctttaccttttctttttaatataaggccacggttcgatattcaatgaaactttgtggcattgtttgggttatgaacctcagattggattcataaataggagaggtacatccctcttgctaaatcctaggtttgtcaagtgatgaattgcgcaggcagggacacgtaccaggaaccaacagatcatgattctggcaactacagtagcaacaacttgatgttcaaacaaccacgaatggctgaattctgtctgaagcacctatgctctagggtgttagtttcttctcataagaattaactcttctgattttagctcatttagttgttggaatgctccataaggccacagtaaaagatcctcactgcttgtttggttgtttaggatttatgatgtccctctaattatctgctgtttacaactggatttcttatgttgttttctctattacttccagttttcctttttattattatgtgaataatttgagatgcattgccatttactttggccaaaaaaaccacatgtattatcagcatatgctggcacttagcacccacgatcctgcttccactgtttctgtttgcagatgcctactaccatagaagaactggattgtgcaattcaagatactgaatccgaagcaaattctatgctttttcttaatcaaaatgttttgttggagtatcaaagccggcagcgtgaggtacaatggattaataagtgtacctcttttttatttcatactttctttacttccagtgttgcaatatgcataagttgttcagcatcagtttgtctcatcaggaatagcacctagccacccagcaggttttgtattttcagaataggactgggtggtgccttcatagcagttagttgagagacccttattttctcctaatactgctgcagagttgcttctaaacaaaacagaaataagctagagtctgaggtttcatgttggtattattaaagggactatttcctgaagagtattaaaaattttgaattccccatagtgatctccttcaggattcccatgtgggaatatttttccttacagacagaatattgcactatatgctgaaattttgacaaaatgacttttagaaaactaatttaaaaaataaacgtggcaaaaactaattgagaaaatgaacctttgactccgcgccagcctcgacggcgctgagctcttgtccaaggtgccccaggtttgctgactcatcagagctcagctccaagcagcctagcatgttggtggaggtcgtcagctataaacagtgtgcagggttcgatttcgattatcccctccctccacaccttttttttgttttctcttactttcctaattttctttttagtatacttctttttgcttgatttgaaatatttgtttacaaaatgtttgctcaaatagacagaggcgtacatccacatccaatagccagtatttccacatgtaaaatggcctcaagagctcgttgctcgcattcaccatgttcctgttactcgctagcctgctatctcccgtgaaaggcattgatctgttgacctcgccggtttatcctgaccctgccaaggattcgaccaaaatcaactccaatggtgatggtcagtagtaagcacatcgccagatatatacacatacacattatgtttttgtgttctttctcagataatagaacaacttatagttctttcatatattttttcaaattcaaaataaataaatttacaaattaaacatgtcatttatgaaaagaatattagatcaaaataaataaatttgcaaataaaacatgccatttcttaaaagaatatgagtattgtggtggaggaatggaggatcgaactcaacaccacctggtaggctggcacacagctgatgtcctcccccaccatgctaggctagctttgctgatgacgttggtgctgaggcaaaggttcatttttgcaattagtttttaccaaggtttattcttcaaataagttttctaaaagggtcattttgtcaaaatttcggccaccatatgagtgcagagaagatacttcattcagtttttcttttcttatatatttgtcattatactatatgttaataaggtagtatagcagataaaggagatcggagcgttggactatttaagaatgctgcttttgcaacacagtatatttctcatgttgctggttttgttacccataaatctacgggaaatactcgatgtttcacatgtgctatgaaaatgtttctattagaacttaatggcatttcatcataatataatcatgtgatatgttgttttagatttaattgcaacagtaatcggatcgtagatttgttaagtaatttaaaagaaagaaaaacatttgaagcttgcaaatagagcttcatgcgtgcatgcaaaagaggttggcctactgtacaaagagagaaatgtagagcgggtacattgcaaaaaatgacttagaggcttgcatatgcagctgcagcacgcagaaagtgtgagagggaggcaacatgcagcagctgccagatggggatagcacctgattttttgtgttttactgggcgcccaatgcctagtcccgtcctaaatctactactacactgattactttgacagtgacaatacctattttaactgtgtagatagaatcaatatccataaagctggaagatgataaaggagaatgtgaaagatgctactctgatatagaggctacaaaggtctggacattttcatattgtcagctatattaccatactttgtccaaatcttttttggcatcctgcctcacttgacttgactttggcaatatcctagggcaaatggcttccaactctgcgcactcttgtttcaaaaataaacagcacgtttagtcgtaactttcaagaaatggctgttgctggagaagtttcacttggtatgtgtggcagttccttctttgcgttatcacactgttatttgtactattttcagatggcataccaatctgtaccaaatttcctgcagatg

SEQ ID NO: 90711 - DNA, 669 bp, Oryza sativa
ggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccattacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgc

SEQ ID NO: 90712 - DNA, 1370 bp, Oryza sativa
cacccccgcccccgaccgcgcgagctccggagcagttggcgtcgacaaggaagggaggtgaggcggcggagatgttctccggcgagtggacgccgccgtgcggcagctgctgcaccaagaagtacgccagcctcgtccaaatcccatgtcagtgtgctaccgcccaatacttccctctcgcaagtccccggtagaggatttggtttaatttgttgtgccatttttttgttttggcgcgattgggcttggatttgcagggagggtcttctgcaagaaggggtgcgacgcggacggcgacacctgggacgagtgtgagtattatcatctgccaaatgtcgctgtgaattgattcatccgctcattacccgattttggttttgctgatggtttagttcatcgccgattcaaatattttccataggatgagatatttatgttatgttattcgtggctgtccttgtgaatggatggaaaattaatattaggcgtatatgctttacaccgttgatggaaatcatgttttggagttcaatagtactagtatgtggctagttatctgacaaaataggcatggttaacataatgacccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccg

SEQ ID NO: 90713 - DNA, 1539 bp, Oryza sativa
aattcctgcagccctggaaaaataaaaccaaccacctacattattttattcatgggaaaggaaacatctaattagcgtaatacttattttcctttcccatttctacgaatgcgcgcttgatcttagcgcacaaaccgcgactaagggtatcgaaattatttctaatttcagcaagctctacccctagctccgtgttgcgatccctaagctctatattctccttgcggagtttcttcacttgcacggcgagcttatggatcgagggctctgacgacttcacctcatcttcttgatattggccgggaacccgtcctgagatataccagccatgggtgttcactaggacttggatcaaaggtttttgagggtgaatgggagattgaatagagaggcttttgcaaaggaggaagaaagagaggaactagctcaggagagtgatccgatcgctctacctccaaactcgcatctaaacagactcaggacgggcgggggagtctaccatccaaaaatggggccgaacgggtgccgccctggttcggccgaaccctggtgggtccggcaggcctccattttctttcctaagcctactaatttctaagctaagcacaaacatgacaattataaagggttttaagcatgcataagatgagatcatcatggttcataattgattaattcaacgacatccacttcttcatctaaagtttcatttggctaaaggaaaatttttaagcgttgaccgtttaccttgaatatattacctgaatcgttgcggagagtgattgccccgtgcgaagaggtattgatgacgttgaacggtccttcccatttactacgcaattttccgtgaccgaaaagcttaacctcggagttgaacattagcactttgtctcctggcttgaatttcttgatttttatccttttgtcatgtcagtgcttcgtcctttctttatatatctttgcgttgtggtaggccttctctctccattcttcaagttcggtgatttgcattttcctccattctcctgctccgtcaaagtcccatgttccagtttctgatggcccagtatacttgctcaagttccacgggtagtcgacatgacttcctgtagattatctgatatggggacattccaatgggtgtctcatacgctgtccggtatgcccacagtgcgtccgacaatttatccttccatcctgtttccattttgttgaccgtcttctacagaatattcttaatccgtttgtttgatgtttctgcttgaccactggtctgcggatggtaaggagtggccacattgtgtttggctcccatctctcgtaggaggtcttggaaggttttgtcaatgaagtgagaacctccgtcacttatgaccattctggggataccaaatcttgtaaagatgatttctgtgaacatcttcttggcatgcctcgcatcagcggtgttgcatggcatagcctcaacccacttggagacatagtcaactgccaccagaatgtactcgcagttgcgagacttatggaaaggtcccataa

SEQ ID NO: 90714 - DNA, 827 bp, Oryza sativa
tgagcttttccatgaaatagctcctactgtgagggtaaatacgtatcccgatgttgactttgtattatcttttgcaaagtcagaatctgaataccccactgtctggagcgattctgattttctgtaagacagcatgaggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagt

SEQ ID NO: 90715 - DNA, 4143 bp, Oryza sativa
cattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcaggaaattcttcccgggtgcacacgagtgaggacaaagtgtgcagaaaagacttgtgttagtctgtgagggcattctatgacctatgagagctatcagatgtaagcggcccggcctgggagaggcggaacgttacagtcaggatcaagtgtgggcaaaatccatagaatattcaagtggtcgaagtggagcatggtgaagttcatgcagaatttcctgaaaaaggaaacaacgtttcccaggaaccgttattggaagacgctagtaaaatccagtacaccggccaagaagctagagcaaccggctcagaagaagccatctcccgcaccaaaaccaaagagggtgtggaaggaaaagccaaagacgcccgctccatcacctccggagacgggtggaaaatctgcgaactaaactgaaaggaggtacggtcttgcacgtcggacccaaaatgacacgaccctcgccaacaggtaaattggtatgtatccgcatatttattttcatcaatttgaatttttgcatcaacacatgtttgcatcaacacaggtaaattaggtttactaacctcttgcagagaatgaactcaaaatggaggagaatggacatcaaatcagacgatcaatcaatcggacgatgtcgagaatcagacttatcaatgaataggccaagaactcagaaatgacacgactaattgggccaaagttcagaagtctgtggaggggagaagtccaagaagccagcagccaaattatgggctggttgggccggcctctggttcggccgaacccccctcatcgccgttggatgcagggtttctcctggacggtgtagattggcccccaatgccggttggagggtatttccgaccattccaaccatcacaaccgtcattgggaggctatataaacccctcactctctccatttcaaaacacactccaagcaaatctctctcattttctctcaagtttagtttagtgttcttaagctagtagagtaggaatagaatagaaatcagagtccgaaagccttcgaaagagttcgggtatgactctagtagctctcctttcctcttttgtaagctttgtactttatttagaatactcttctttatacatttcttgtaacaaacccaaattgtagaaacttggaaattcaatataatgaaaaaaatattattgtggtgaaaatttgttttaggtgtttttggatcttctatgcatcatttcattttgcatatataaattaaattaaacaaaaaagggtaatacgattagtgatgagtataataaacaacaaatttaattagttataactcagcttttgcatctcaattaaaaagatgaaggcaaccacaattaatttaaattggaataaaagaaggaaacttgtttgaatttccaaaaaataactgcacatgagaaaaatctcaaaaaaaaaatcaccaaatggagttcaccactacagtaacttgcagtaaaattggcgcatgcttttgagcagtgtagtcattccaaaaaaaaaaaagaattcgtcagaccctcagccctctctaaaaatccctgggaagaaatgttcctcacctcccctattcctgtacttctctgatcaacgggcccaagcaccctggaccccacctgccagtggcccagcaccccatcccactctccttctctttcccatctctttccttgcagatatttcatcgaacacataggatgcgagccgaaagtcgtcgcctccaagccgcccattcctcctctgcccgcgaatctcactgcaaggctgtgcaaagctgacgacgcctctgccccgcctctgcccgatgccctgccgcgcccagcgctgccctcgcagccgctgcgcccaaccgacgccgtccctctgcccggagcgacgagacgctacaaactcgaccgttgcttcctccgtctgcaaagccgccgacctgcgtctgccgtctgcaaagccgacgcccctgcctccgtgtctcccggctgcaaagccggcctcgcagcgcgcctcgccaacccggagccgccgccctctgccaaagccgacgcccgaagcgacaaggcgagaccgaccgcccctggcttcctctgactacccctgcactccctctgcaatccctgcgcaaagccgacgcctgctgcccgccgtgttccccgccgaccaccgcctgcgcgcgcgagagacgccgaacgcgtcacgacaacctccgcgtccgcctctcgctcctccctcgcctataaatcgaaccctcgcgctagctaactctccagaccaccttcaacctccactcctaaagcggaagccctaaaccctctgattcaccgggaacggccgcgccaccgtcgcgccccgcgccggccaaacagaacgccgccgctgagcccacaccatcgagccgtcgcctcggtgagtttcctctcgattcctcgcgccatcaggctcataggacctccataaatccattttcgaaatctcttttatgacccctcgaccggagagccgccgccaccattgccgccgccgaccgcctcgggagctcgtcgccacgccacctcggaccgcctccgcccaaaaagaacgcggggtaagccaccacatagtccctaggtgcttccctgtcctttaatcgagtcgccgttcgccatagccgccggccgccatcataccgaaccactgccgccgcttgccatggccagccgcctctagccacccccggccacgccaccgccactaggagatgcacgtgaacctcctctagccacccctgcctctgccctagccagccccgcggccgctcgccgccggccagcccatccggagccgccctcgtgctcccctctgtctgttgcgaacggaggaagaagacaggacctgttcgtaaataagaaaaactctagggctcttgatacaaagcgccaatacacttacatgttggaccgagacctagatctcaatagccgcaagattagggtctgttctgtgaaacatcgagacacttacatgtggaccccactgtttaaagtggatgcgcgctaccgtaatacgttttgcatgtaggaaagcgtactctatatagtacgcttcagccttttgtaaagagaaattaataaatctaagaaaatggtttcggttaattatttatgcactataaaatgctgaaactttgtaaaatcatagaaaattcattttaactccgattgaggtgaaccaaatttcgttagattcataataatgttgtctttaatactgtacactcaaattatcaccactgttgtgaaaattttcactaatttaaatttgaatagtaaacttcgtatttaccgtactttaaatattagaaacacgataacttgcacatacaacatcaggtttaggcgattctttctcatttatattaaatcactctctttacactgaacatgttcatgcaccatgcatcatattttatcttggagttttattggatgttcatttgaatgtacgtttaaatttaattagaggacgaatcgattgttgccgttggcgagagtgtgcaggaccaagagttatttgaggaaccaactgagcaaggcaagtcctattcaattcctacttcgatcatgttgaatcctatatcttcgcaaatgctttattattttataaattgcatgcgatgttttataaagaaaatggggtattggtagaaataacctaattgctgcattacctaccttgatatattgattatcgttgaagccctaggctgagaatatgtgtgtgttgtacatgcacaatgtgggtatattcgagctgctactatagctacttgcttagccatgcttagaaaatttccaatggttatatatgacatggtaatcattctttacaaatggagggctgcagg

SEQ ID NO: 90716 - DNA, 2312 bp, Oryza sativa
  unsure (1)..(2312): unsure at all n locations
gagtccagcaaaacaacatggtaatttttggtgtcaaagtatgcaacaccgacagtcattgtaatgccacgctccctttcatcagcactctcatccattgcccaagcatatgcaaatgatcctttcccctggaagaagaaacgttatatatgaacagctcccaagatgcataaaaggcacatactgagataacatcaatcattaaaataagagaaccttttctttagcttccttctcatatttatgcatttgcttttttgaaatcctccccagggcatgtaacaaacgaccacatagagttgatttcccagaatcgacatggccaacctagcatgtttctggtntgagttattcataaagataggcagatagaaggcaaacaagtaataagcaaaatgatggatacatcaaatatatcgtgtatatatagatatgtagttgcttacaatagcaagatttaattgtctagggatgccttcatcttcatgctggagcatccatggttctggcttgtacagggatgaagaaactggctttttaatattggctttacttttttgtgacttcctctccaaactcaaatgctgtagctcatggtccaagcaaagtgtttcattttgactaccaacagaaacactctcactactttcaccgaattcattcgactttacaggcaaatttgagtctgcagttgtatccttctcaggtgtagaactatcattatccatcaccctcttttcagtgacatggggagcatctgtgtcaactgatgtgaatcaagttactatggaactatagcacgcactgcacaaccaaaattattcaagtgtggaaaagaaactttgtttagaaaactatcttagcataacctttcattggtaccaaccacataaattttgaaaataacaatatctataacaaggaacagttcaaatgttcaagtgtgttggcacacagtagttctctatctgaccagactaactcattcagcataaactctaatcaaactaattaactgaaaaggttccacaaagactcgcgcatagaaaagaaaataaaggtttcacatatagatgttaatgttaagttgttaagatgcatccttttcactagtctgagttagtctaactacatgggagtgggggaatgcagagataataccttttctaaaacttctcgacgattttagtcctgtagcgaccacgtcatccggagatggtgtatcaaacttgaaaggcactgtgaacatgaagatatgcagtcatattacagatttctccatcaggaagtctaataaataaatgaaacataagttcaacatatggatctcccattggaaaaacacgggtcaactgaatgcttaccctaattcaggggaagaactgaacattcataagtaggttaaaatttacactgactatcttcatatttcaaagttcaggtaaaccaaattatataaaaccctgtaaactcccaagacctgtaagctacctcccacatatgtgcttcagtttgtttgtttgcagaaggaccatggcaggctagctaagcttatagttcagacagtcacttggttttgaaacaggaaaattttacacccaaaatggtagtcacaccagatgcacaatgaggcaattgagagttaagctatgcaaatgactagcatatatagaatcatacaacattaaatatctggtttatatatagcagcaagtacatataactacaagaatttggataatgccataaattaaacaaatcaaattaccaaaagcgcttgatgtacaaatgcagtgtacctatgttaatgtggcgttctttacgggtcatgtatgtcttatgcagcgcatccacgtagctcgtgtacttcctgttgcatttctgctagctttaaagccaccagaaagaacaacgtcttttgacttggcactggatggtgagaaaagagttcttgccagtacagataccgcataatgcttgtctctccgtttagctggatgtcatgatagaaaaataaataaattaacaggctagaaaacataaatatatctaatcaaagccataagtcaacagtgcaacaaaaaactaaccataccagggaatggaacaacaaggaatacactatacctctgccatcaacttcaagggcattattgaaatacagcgagaaatatcgaagaacaccgcattgctcacatgattttttttttgcatcatttccgtgttcgcaaatggtgcattgccaaatgccaggatttcttgatggctcctgaggatcagaccggttatctaattcaggaataaactagaga

SEQ ID NO: 90717 - DNA, 606 bp, Oryza sativa
ggcatatccgaaggacgatttccccttgccacggatcgaccaactcgtggattcgacagctggctgcgaactcatcagcttcttggatgcatattccggctatcaccagatccacatgaactcggccgacatccctaagacagccttcatcacgccatttggcaccttttgtcacctcaggatgtctttcggcctgaggaatgccggcacaaccttcgccaggatggtgtacaaggtcctttacaagcagttggggcgaaatgtggaatcttatgtcgacgatatcatcgtaaaaagcagcaaggctttcgaccacgtgttcaacctacaggagaccttcaacaacttacgcgcggcgggtatgaaactgaatcctgagaaatgtgtttttggtgttcatgcgggcaagttgttgggtttccttgtttctgaaagaggcatcgaggaaaaccccgagaaaatcgatgccattcatcaaatgaagcctctgtcgagcgtacgtgaagtacaaaagcgcgcaggccgaattacggcactcagtcgattcctctcaaaggcagccgaaagaggtttgaccttcttcaagaccctccggggcacccgtat

SEQ ID NO: 90718 - DNA, 675 bp, Oryza sativa
ctttttggtctattgaaagaccttcggtcattgtctacgaaatttagacaaagtcttacaacgatgccaagagaaggacctggtacttaattgggaaaagtaccatttcatgggccatgaaggaatagttcttgggcatcgagtgtccgaacgaggaatcgaagttgatcgggttaaaattgatgttatagatcagcttcctcctcctgtgaacatcaaaggaattcacagcttcttgggacatgccggcttttatagaaggttcatcaaggacttttctacaatcgctagacctctgaccaatttgctagccaaggatgcgccctttgtgttcgatgacacgtgcctaaaatcttttgaaattctcaaaaaggcactcgtctccgctccaatcattcaacctcctggatggactctgcccttcaagatcatgtgtgatgcaagcaatttcgctgttggtgcggccttgggccaaaccaaggataaaaatcatcatgcaatctgctctgctagcaaaactctaaccggagctcagttgaattatgcaactaccgaaaaagagctgctcgcggttgtttttgctatcgataagtttaggtcttacttagtgggaggcaagctgataatctatactgatcatgctgccttgaagtacctgctcactaagaaagatgc

SEQ ID NO: 90719 - DNA, 1734 bp, Oryza sativa
ttcaagtttgcatatgtcagtgacttttttttaatctaacgatttttttgttcggcttcgtttgttcatcaggtttatgtagatggaacgaccaccttgtcaactcatgaaaggaaagcgagcattagggaattctatggtaaatgctctaaaatgttgagctgagattttctttttctttttcttggttcacaattgagaggtgtttactgtctaaagtgttaacattagcctgcattgttttcagctgttatatttccctcactcatgcaactccacaagggtatcagcgatgtcgatgaccggaggcagaaggcaatctgtactgagagatacagaagaagagatgaggatgagagcaagaggcatgtttctgagattgatgtcgagagagaggaagagtgcgggatttgcatggagatgaataacaaggttgtcttgcccaactgcagccatgctatgtgcatgaagtgttaccgtcaatggtgagaatcaaatccttccatcccaaaaattgtttgtcatgttcatcactaatggttaatcgatgccgtattggtccttggtaacagtctgagatgtgtttagttcttcaattcaaagttagtttagtcaaaacacgagtaaaactctgtccagatatagtggaccattttggttctgagaggttaatagcagcacgctgttttactctgtatgaatggctctgcacaataaataagatggtgctatgctgcaacctcattaatagatctgtacctgattattacagcaagacattgcatatttttcagtcattgcagcaaggttgtcagctttgtgcttaactcttactggtctttcagagatcactttttctttgacactataatttagctcctgtgaaatcccttctatggcataaccccactaagcaaatgatcccttgcaaagggaaaaacagccttaagaacatcagttcagtttcataatttcccaaacttatgtcaatacatagctctgcaaaaactctgccaccaaagcatgtagtaccgcacgtaaatgacagtactaatgtttatgtataaaataccttaccagttacatgaacataaggaattcaaaggacatacatatcaatttatatcttcagtacatgaacttaaaaatagcttctctgctatatgaataactatgtggtcactggttacgaactctcttaagatattgctgcattctttgaaccatgtgctatccttgttgcaggcgctcaagatcccagtcctgccccttctgccgtgacagcctcaaaagagtaaattctggtgatctgtggatgctcacagatgaccgagatgtcattgacatggcaacgattactagagagaaccttaggcgcctgtttatgtacattgagaagctgcctcttgttgctccggacaacatcttctatgcctatgattctcatgtaaaataaccagagctactcataatgacctactcataattgttttcggagagtgacgcatgtcttattcattcatgcagaggatgttccttgtcgtaggatgtggctaaccccaggagcagactgaactttgacaagagaacttgtgaattctgactagatccaatgctgtggtcagatgttgtaaatgcttgtacagatttgtaatttgcagtgtaaaaaaattagtgaggaaaaaccttgtgttccacattgaactcctagtgtgaaattccaagtacatatat

SEQ ID NO: 90720 - DNA, 1787 bp, Oryza sativa
gtacatgctaaatatctctacttcatagagttggctcctggaagctcgtcggaagtcctgattacctctgcagattcaagaatccgtgttgttaatggtgatgaactcgttcacaaattaaaggtaatgcttcattcactgtacttgtgtatcctctagacgttgacggatgtagaacacctagaaggaacctggccgatttaaagtagtaagtaacccaaattcaagtgattcatactttggaaaacccccacatcccacctatttacctcagttcctaacatgttcacagatcaaatcataggttccatttccccaatttcccccgatgggtgtgtttagttcacgccaaaattggaagtttgattgaaattggaacgatgtgacggaaaagttggaagtttgtgtgtgtaggaaagttttgatgtgatggaaaagttgggaactaaaccaggccctaatcacaagaactgtgcacttgattggtgcattagctcactcagtaggccagtatttatactgtttcacttacattttatttgatcttttcaccagggttccgaaatacaagtagccaaatatccgcttctgtagctccaaacgggaaatatgtggtctgtgccagtgaggactcccacgtgtatgtctggaggcatgacaatacttcccatccgagcagaagcaggagtgcagttgatgtaaccaactcatatgagcatttccattgccatgatgtcactgtggctatcacatggcccggcgctgaatcccgtggctcattcgggtcccgtagcagcagaaacagtgattcagacgatgcagtgatgaacacgggtcgggatgcccctgtagagaacagtgagcatgatctgaatggcactgtcaatagatgcaccaagcgcccagtttgtgaaggtgttgcaagcacaagcaatcctccagcggatggagtatcaacgtcctggcctgacgagaaacaatcgtctgccaagagcagtcctggtcactgctcatccgacctttgcattggagctttggatgttcagcgccggtcagcttggggattggtgattgtcactgcaggaaggggtggtgaaattagggtgttccagaatttcggcttcccggttcaagtgtaaagctagtgtgagaatattcagagatgtccgtttgtttactgtatagatatcgttagttttttctccatttcacctagttcttttactagctaaaagatttccctgtttcgctgtcaggttgggagccccagtagctcaatccaacttgctaagcaccacactattttttaccctctgttgatacaaggctttgtgtaattgtatggttaacaaccaatacatcgatttgtttgttcatatattgtttcttggttatacactgattgatatatgaagataatttctaactccatgataatccattgtgcaatcttccctcccagtatggcttttattgaactacactgttcagcattctacagttcatttaattactaggagcacatgctagaatcttgatggcaacaaactcttattattgtcattaacactgcacatacgtaaacacatcttccagctacagatcacgattcactgatcccaatgataatcaccacatcattgtgcaagcgtatgaaattggtgagagaagaaaactgcaaacaccacgttggataattgagctgcttaattacattcccaataattatatcataatccctagctcagcaaaatatacttcataccgatcgaagaacacactacctg

SEQ ID NO: 90721 - DNA, 4487 bp, Oryza sativa
atgctaatttcagtcaacggcagctagctcgtagtagctttttttttttcgacagcattttagcaacacactaaaaatttgactagaactaactttttcttttaagataatggaattgatttcattaagatgaaattgcacccgggcaaaaattaagtttaagataattacacacaaaatgcatatataattcaatttctgtgtggtaataaaccttttgttcccagatgttggtgtgatgagcggctgcattctcttcatccagagagacctccacatcaatgaagtgcagcaagaagtgctcgtcgggtgcctcagcttcatctccctcctcggcagcctcgccggcggaaggacgtcggacgccgtcggccggaaatggacgatcggcctcgccgccatcgtgttccaggccggcgcggccgtcatgacgctcgccccgtcgttcgaggtgctcatggtcgggaggctgctggccggcgtcggcatcgggttcggcgtcatgatcgcgccggtgtacatcgccgagatctccccggcggcgtcgcggggctccttcacctccttcccggagatcttcatcaacctcggcatcctcctcgggtacatctccaactacgccttctccggcctcccggaccacgtcagctggcgcgtcatgctcgccgtcggcatcctcccgtcggtgtccatcgcctttgcactgctggtgatcccagagtcgccgcggtggctggtcatgaagaacagggccgacgaggcgcgcgaggtgcttctcaaggtcaccgacagcgaggacgaggcgaaggagaggcttgccgagatcgaggccgccgccgccgtcgcgagcgccggcaagtacggcgacaagacggtgtggcaggagctgacgaggccgtctccggtgatccggcggatgctcatcaccgggctaggcatccagtgcttccagcagatcaccggcatcgacgcgctcgtctactacagcccgacgatattccgggacgccgggatcaccaccgagagccagctcctcgtcgccaccgtcgccgtcgggttcttcaagacggcgttcatcgcgcttgccatcgtgctcatcgaccgcgtcgggaggaagccgctgctgtacgtcagcacggtcggcatgacggcctgcctcgtcgtgctcgcggcgacgctcgccgcgctcgcgcacgggtcggcgtccaggagcgctggcatcgccgtcgccatcctgaccgtgtgcggcgacgtcgcgttcttctccgtcgggatagggcccatctgctgggtgatgagctcggagatcttcccgctccggctgcggtctcaggcggcggcgctcggcgcggtgatgaacagggtgaccagcggcgccgtggccatgtccttcctgtccgtctgccgcgccatctcggttgccggcgccttctccgtcttcgccgtcatatccgccctgtccgtcgtgttcgtctaccggtacgtgccggagacgagcggcaagacgctggaagagatcgagctgctcttcggcggcggcggcggcgacggcgaggcggcgcggggagaggtggagctcggtgacggcgagcacctggtgcacaagggatgaggatcttgagttattgaccaaatggatcaatgtgaacttggccatttttttaggtgggttttaacagtattactagatactggtgttgcggtgaatgcaaattgcaaaccaaattgttttgttttagagcactaataggaaagaaaatatctcatactcttttccaacttcagaatcctctgtagcatcaacgaatcatacagtgtaaatgttggtgccactgtgccagtcaatcagtcacagttggtaatgctagtaagctacacttgcacatccatgaaaccattacagtgaatgtaaatagattctgaactgaattattcaaattcattgaaaaagagcgaatttccagtgagttatatgatattttagcaaatagaagaaattttatgccaaatggaagtttgacatctaaccacatggtataagagcaattatctcgagtgaatattcagaacaaggtgatacctcaagtttaatactctgcaattcagcaattgtgcaagttcatgccaaaatgactgaccacagctccaaaatttcactctaagccttactactgaatacacaataacacaaccatgaaaatgtgggcagattcctgatacaaattttgacaatttgactttttgcaaaaactatttttacaaatgaaccgctgccaaaacttatttcaaatctgacccttttgctcaatgccaaatcatgtggcgctgaacttagacatctcagcgccacgttagctggcgctgaatgcggtgccacgacggatgggagactaagtcagcgtgccaacgtacattcagcgtcatgctatttggcgctgaggtgtctaattcaacgctacacaatttggcgttgagcaaaagagtcagatttgaaataagttttggcaacgattcatttgtaaaaatagtttttgcaaagagtcaaattgtcaaaatttgtggattcctgactccaactcttttaagctgaacaggtagtcatcaggttaccaaacatataaaaacgcctcattagtcttaaacaaatggttccctccttgtttcttcctcctcctacagtctcctccttcctccagatccaattgctagtccttttcccattcacaagccacattcttggagcttgcaagaggagagaagaggatgagccaaccatagccagagcacagcacaagaaagacggtgagaatggggcttcgtgccaccgaggcggcgacgggcaacggcggcggcatgaggagccttccggatttcttggggaggaagagcaagtacgtgcgcatggacgacgtgctcccggatgagcagggagatggcggcggcggcggcggcgtcgttcgtgtccgcggcggcggcggcagcgggagatacgtctttgcctgctctgtcttcgcctccctcaaccatgtcctgctcggctacggtgagcccctctcctgaatttgactgttcttgattcagatttggttgtattacacataatcaggggtttattttctgattaaagcaagatttgcagctagtaaaatatggggattgtatgtcatgttaatatgcttttagaagatgaagtgtttgaaaagttatcatcactgacagcccactctgcttcagattcagatgaaatgtaaattttgaccggtaatttggttcagatacttgttatggttgttaatctttatctgagtctctctctcagacagccattgacattgtttgtctcgtgaacaatcgatcaaactttcaaatggatgaaatatctttgcacaaattgtcaaatcctgtgttacatcgtggctgttaattttcagatgttggtgtgatgagtggctgcatcatattcatccagaaggacctccacatcagtgaagtgcagcaagaagtgctcgtcgggtgcctcagcttcatctccctcctcggcagcctcgccgccgggaggacgtccgacgccgtcggccggaaatggaccatcgggctcgccgctgccgtgttccaggccggcgcggccgtcatgacgctcgcgccgtccttcgccgtgctcatgatgggccggctgctggccggcatcggcatcgggatcgggatcatggtggcgccggtgtacatatcggagatcacgccggccacgctgcgggggtcgtacgcctcgttcccggagatcttcatcagcctcggcatcctcctcggctacgtctccaacctcgccttctccggtctccccgaccacatcaactggcgagtcatgctcgccgccggcatcgtcccttccatctccgtcgcgttcgtgctgctggtgatcccggagtcgccgcggtggctcgtcatgcagggccgggccgccgaggcgcgcgcggtgcttctcaaggtcaccgatggcgaggacgaggcgcaggagaggctcgccgagatcgaggaggcggcgcgcgtcacggccaccggcaacggcaaggccgtgtggcgcgagctcctgaggccgtcgccggtgatccgccgcatgctggtgaccggcatcggcgtgcagctcttccagcagatcaccggcatcgacgcgctggtctactacagcccgacgatattccgggacgccggcatcaccaccgagagccagctgctcgccgccaccgtcggcgtggggctctccaagacggtgttcatcgtgatcgccatcgtcctcgtcgaccgcgtcgggcggaagccgctgctgtacgtcagcacggccgggatcaccgcgtgcctggccgcgctcgccgcgtcgctctccctgctcgcgcacggcgcgctgccgcgggcggcggcgatcggggcggccatcctgacggtgtgcggcttcgtggcgttcttctcggtggggatcgggccgatcaaca

SEQ ID NO: 90722 - DNA, 1634 bp, Oryza sativa
ttcttccctgtggatactctgtgatcataagttcagaactgaaagcgcaactgagtgatggattatacacgatttctctctcctgtgccatgtctacagaagctgttctgttcaattgcccccaaaattaatgtccaacaagcagcgatcttgaattgctctgacgtaaacaagtcaggatcaacctactactatttacaagatctagatgccgcaatttgcacaaggaatggaaagaaacaacacgattcacaattggcacacatctaaacgtgtgccctctatgcactgtcactcaactcaacatgcaaaggtaagacaagaaacatagacccagcatcagcatcaatcagcctggtgatgttttccttccattttcaccttgggctgatctcggacaccgtgggtggcaccaccgtgctgaacatgtcggaggtgtcggacgccgagtgcttgaacctcgagttgctggagttggtggccttggagaccgtgccattgtagtcgtggatgtagcccggcgccgtgagctcgcgctcgttgatgcggatgggcttggacagcatcgtcaccacctgcggcatcgacggccgccgcgccgccgccgcctgcgtgcagaagagggccgtcttgatgtaccggaggacctcctcttcagggtaatctcccatttctgaatccaccagctccttgagcttccctacctcatgtagctcccatgcctgttaattgtgaaagctaggctgagtttggcagcaagagttggtaactcatcccccacacgcacgtaaaacggagcgactcattagtacataattaactaactttttttttttcaaaatatggattaatatgttctttttaaaaacaacttctcttttgcaaaaaaaaaatagcgtttaacagtttaaaagacatgcgcgtggaaaacgatagagatgagttgggaaatatagctgcgtaattaacacggccttaattgatgcagaggctggaattatacttccattctctaataaaagatttagatggagagtccagcgattacggcttaattggaatgtctctagagcaaatgtctgaaggtgaaagcaaatctctgaattttggatagtaaagatgatagtaagactgaccttctctaggagaatcttatcgtcagccaggagactccttgaactactcttgccacttacgatctcaagtacaaggacgccaaaactgtatatatcggctctcttcgtcaattggccatgccatgcatattccggtgcaaggtagcctctgcattgaacaaatagatcagttcagttactgcaactgcaaggttactttctactcaaacaaactgctaaatgctgaaatactcacgtcgttccagcaacacgggtactgatgtgggtgatattatcagggaataacttggctaaaccgaagtccccgatcttggggttgtaaagcttgtcaagaagtatattgctagccttgatatctctgtgcacaatcggtgacgcaatctcttcatgcaggtatgcaagtcctttggcgattcctatgcatatagcagatcttatgctccaagtaaaatttgcaggttcgctattagaacctacagaacacaagataaaaggttg

SEQ ID NO: 90723 - DNA, 2307 bp, Oryza sativa
attcctgcagcccgttttgtgactattggatcgtaggtttttttatttgattgtattaggaaatagtcagttcatgtaaaatttcgtgtaaaaaccatcctttccaaagtagaaaaaagaaaaaaaaaacaaattctatattactccttgtggtagcatgtctaaaaaaaattacaaagcaaaataggcgtaactaaaatgattatcctgtgatagaactagctcacctgagtttaaattctaaacttgacattattacttgtatttgtggctaattattttttcggtggtagacgatattcgtcaacaacaagcttctgatgacagtctaggatttgagaaagatgtatttgtaaaacccaaagatcgaactactcctatatgctaaaatctggctgccaaccctagtttcttagtataatcttactattaattctttaaacaggggtagtgcttggtatcggtattaattgcgtgacagtcggcaagtatcagtttcattttcgtattgacttttgatctgaccatttccagcttcaacttgtccgccggatttttttttcattggttcgtagtacttggtagtaggaagtagtacaggaacaccatttcaaaattccaactactacttgtctacttaaaccacacatgaatttccttttagcaaaaattcaaaaccacatgtattgatgtataaatttggagtttgacgtcgcagcagacgagtgctcggcgaaagtcatgtaacgcgcacctttggttttgtgtggcgaggaagattttaacacggaaagcgatttgacacgtacgtgtacgtcaacattggtgatgtccagactctagacttgtaaattgtcatgttggtgccagtatacctgtgaaatgatttcatttttctagtacattttatttctttcacatggaaaaaaaattggacggctaattgacggattgatcctggaaagtacgagtacggtactgaaattgaaaaaaacgagcaaatattatacacgttcgggggttcttttcatcagattttagttaggataggaaattgtagttaggagtatgttaagcacgttcatgggtagttttaaaataaaagcacattcatgggagcgtgagcgtgctgtgtagttatgcatgagtctttcgtctaaacgaaaaaaaacaagaaaaaaaatataaataattatccatgcatggacaactttgaaacacaaacttgccaatgggccaaaatgggctagggttgggtagcccaatcctttcattcaagaggcctgtagcccaatctaacataaaagggaataagttcacttcgtgaccctcaactgtgatcgaaatctaatccataaccctaaaccacaaaaccggatatttcgacccccaaactcctaaaactggtgcaatttaactccctcggcggttttggagggcggttttgctgacgtggcgcctacgtgacgatattgaccgagtcttcgttccacgtgacacttaggtggcattagaattaaaaatatgtgtggaacccattaatcattcacagaaaaagaaatgtgggccaactgacatgtggggcccacatgttagtcctcttccttcttcctcctccctctctcccttctctctctttctctccccttcttccccaagaagctaaagcggcagcgccggggacctgcagcatccctcggctcgtgctcccgcggtacgacgccgcgttggccgcgcccaccggcaacgtctggttgtagcagtcgccgccgccagatgaatccatcgatccagacaaatcacacacaaacaatctcacaaacgaatccatcaatcgttcacgccatgtatgactatgtgtttgctagctagcagcttataggatctggatcttgtcgtcggtcatccactagcggtgggagttgaagacgaggacgtcggcgcccttccagaaggtggagtgcttgttcatgggggcactgcggatgaggcggtcgtcgaggacagcggcaccgtcagagttggactcggcgagcatgggcgcccagtataactcgatggtggcgtcgtagtccttggccctgaagatgttgagcgagtccaccgtctcgaaggatctggacccgccggcgccgggagcgccgcggtggaggaggcagagcagcgaggcatacagcccacagagcagcgagtcccgaacttccaatcttgccgccgccgcgtcagcttccaccgccgccgccgccgccgccgctcgccgccgctccagcccgtgctccccgcggccggccgaaggggagagaagag

SEQ ID NO: 90724 - DNA, 1022 bp, Oryza sativa
ttggccacatccatgtgtccagtgctagcgcatgtgccatgctgtgtaaccactcccagtctacaccagccatgcccaccatgcctgcgcaactgcgatacacgcgcccgtgaaaccgcgagagttggctctgataccattttgtaacgtcccgcctcccccaggcctgtcgcacccgtgaaaccgcgagagttggctctgataccattttgtaacgtcccgcctcccccaggccgggcccgcttacatctgatagctttcataggtcatagactgtcctcacagaccaacacatatcttttctgcacactttatcctcactcatgtgcacccgggaagaatttcccggtcggtcacccatcccaaattgctccaggccaagcacgcttaaccctggagttctttggagattggcttctgtaaaagaagttgcaacttgttgatatgagtattctattaatcctattaagccctagaccgggatgttacaaataagcataagcacaagagtttatcctatcttactataaagttatcccccactaacttcttaagcttaacatgcaaagatgccacatcatcatccactaacaagatgccacatcatcattcactaattaacaagatgttacatcatcatccactaacaatcatcacatttaaacatcatacaaacatgatatatctttacagtttttataatttaagagcttttcaaatacaaacatgttaaattatcatccaacataattacataatgtttcaatgtatatctttattatgttttatgatatcctatatacttatatagttcattctcacttagttcttaaatgattaatctatggtccaaattatctctctctttttttcctctaattaagtcatatcccatcaattgtttttagcctttagatgattaatctacggtccaaactatctccctactttttacgtttgaatcaccattctacatactatttaaatttaaattatcataaaccacattaatttacttaatc

SEQ ID NO: 90725 - DNA, 807 bp, Oryza sativa
atgatgtcattatcaaatggacagaccagaacgtattaatgattcatctgtttttgtgaagtcatgaaagaaagttctgtctcaaccaaacaaaagaatattatattcacaatcgccgagaacattttacattgcttatctaaactgattatttattgttgatgaaaaagcttatgcacagtggagtacgatttattcaaatgacttatggttttcttggtccatttattactccaattttttatatggttgtaggatgcaaaacaaaatggtgcaagggttagtgtagaaacctgtcctcattacctggcgttttcagctgaagaagttcctgatggagatactcgctttaaatgtgctcctcctatacgcgattcaaccaacagagataatctctgggaagctctgcttgtacgccattcttcttattatgattggtttgttgaactttactaaactgttataggctaactggccaactattatatggctaacattaggatggacacatagacatgttgagctcagaccattcaccatcagctcctgatctcaaactcatggaggaaggtaacttcttaagggcatggggaggcatatcatctttgcaggtaagttttttagtgcatatgaataaatgtaccgtgccaagagtgccaagtaacgattttattttcccctaatcttaatacaaattggtcaacgttccaccgctggcccgtgaaaaacattttgagtaaaatcataatggtgaagtgtgaaggcctccagattgtgcttgcatagtagtaattagtttggtatgaa

SEQ ID NO: 90726 - DNA, 1188 bp, Oryza sativa
aaagggggagagggagccgaacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggaggaaaaagggagggaaaagaaaaagaaaaaggaaaaggattttccctggaattaaaaattgcactttagtgatttttttttaattggttaaaaattatttctagagctctgaaaattccactaaaaatcctgttaatgaatttcgacatgtagaattcaagaaaaattccacatgtcaaatccgattattatttgcattgttttcttagggttttatcttgatttcctctgcattttcttggggtcatttgaaatttacaatttggcttgggaggaaaacttcggggtgtgacaggaagcagctgcgacgctgctggcggcgacggcgcgaccggacgacgctccggcgaggagggagaggcggctggaggcggccggcgtggaggaaagagaagggcgacggcgggaacgtgcctccggcggtcaccgcgcgaaacggagggcaggccggggtggaggaggtggcggcgacgctggaggaggcaacggcgcggccggccggcgcacggtcgaggcggcacaggcggctggaggcggccggcggcgtgggagagagaggagggcggcggggagagggctagggacaacggggaggctcgggatggggttaaaacgatagaacggagtgaggggatcccattttatagcggagggaagcgaaccgagcacgggagagggcggaacggcgacgggaatggcggccggcggccatggttggtggccgggaaaagcgcggccgttcccgacgattgggggcgccattcaaggggg

SEQ ID NO: 90727 - DNA, 845 bp, Oryza sativa
  unsure (1)..(845): unsure at all n locations
attttcttttcgtttccaataacaatttcagtgcaagcctagaatagttgtacatcttttgcgttgcgaggtagttccatctcattccaaggcctgttgtgatcnnnnnnnnnnnnnnnnnnnnnnnncagtcacaaagccaatgaaaatctttccaaatcaaggatccccagtcctcccaaatctctcggcatgcacacggtctgccagtttactagactcgtccccggtttgacgttctccggttcctctcccttccagaggaaagtccttctcattttgtcaatcattttgatcacccactttggggccggcagggcagtgagatagtgcaccggcattgccgtgaacactgacttaacgagagtctcccttccaactgatgagtaatatctccccttccaacccgggattttagatccaattttatcaagcagtgggacgtaatcgattttcctcgacttgcgcagatgaaggggcagacctaggtatgttgttggaaaggatgataaggtactcgggaagtgctggattacattgggggcattcaaatgcgaacatgcaataggaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgt

SEQ ID NO: 90728 - DNA, 663 bp, Oryza sativa
gacgaatggcttggttaagtgtccttgttagcagagacacttcctcgtcttgtttctgcttatttatgactatgccttgcgactgcatctcgtcgtcccaccacttaactaagataggtggtcgtgagtcttcagctgatcggatctgaagaatttcttcttcatcaccagtcattgtgcctttacatgtataaagagaacaataaagcaattgaagaagattttctagatgcaaatatacacggaggattgttacctgttatgatcttcggcggtggacgagcaggcccctctaccttgtcaaaagtactggtttctgcaccagcatcaatgtcattgaagggagggctgctagcgtgcccctccgtttcagggatatcttcatcttgttgttcatcacctggctggtttccagtcggagctcctggttagcactagtttcggcgtccgccgactggtttctagtcggaggcgtatttccggcttctgcatcaccggttgtcgactgactacctatcgggcagttttctctaaaagtttcggcctcagcagcagtagcagaactagtttctttatcacctgtctcggagtttacagccgagtcagagtcctttccggatggatcgatgtctgatggcttcctgaagattgaaaagatgttat

SEQ ID NO: 90729 - DNA, 1277 bp, Oryza sativa
attcctgcagcccgcttgattgccacccccttttcgtattgccgaaatcttggttcgttatatgactttaaatataggcatttccacatatatacaaggcaacatcagtagaagagaaaagtagagatggagaatattatttattctatatggatatcccatatgcatataagtaccttttgttatcttctttggaaaaggtacgaattaccccccgaactatcatggccgaccgaattacccgaccccccgcaccacaaaaccggatattcttcacccccaactatgcaaaccggacgaattacccctctcgacccaatccacggtggttttggtttacgtggcgtacgcgtggcagtccattcagtattctatttataaaaaaaagttggacccacctgtcatactctctcttctctctcattcttcctctctctcttctttcagcgtggggtttagcaggccggcctctaggtcgatgcaggaggggtgccagtgtccggcgggatcgagctacagtaatgctttaagtttctttagtgataaatcatgctacagtaaaaagaaagatgttttgagtaagatggacagtcaaatatgatgtaaaagtttaacggtaaaataacgaaggtagtatatttttggacaaatgcagtagcttatagttaggcaagcttgtaagaatttagaagcagtggtgtctttctcttgggaaggaagcatcggtgatattgttatgtcttccgatgataataagctactggttcaagaaatctatttattttctgtcgattctccttcatgtctacatcaatctctacaaacaaataaaatcctagtacaagtggagatagattattctaaaacaaaatatgcattgcaagcatacctagttctactttattccgggtatattgacggtcgtaattggtttataacaaccgtcaacgcggccatgtatttcactctattgtaatcttgaaccgacatgtggggtatgagggattaggccgcccttatcttacttgttaagtaaaacgaagatagcgactaaaaccaaacatgaagttaatttaaacaaatagactaacttgctagaagaatattccttatttgttttttatgacgtcattgatatagcgcggtacaccttttgggttagtattttttaaaataaaattattccgatgacaactatatcatcaactatgtatatcaagcggcttctgaatataatttgaacctatattcaatgtaatgactactagaagtccctg

SEQ ID NO: 90730 - DNA, 671 bp, Oryza sativa
actatggacctacctatgtgcatcctacctcaattctccccatcaaaaaatccctgcaaatcatccattccagtgacttagaaaataaccggagagagaaaataatccctccaaatcaaccgttctacgttttgtgtcgaacaggtgaaaaaatgtgtaaggtagccagtgcaacggtcgaggcaaggcacccagccgtataaactacaacaaatcgccaccgtatggccttttggacgtcatcggctcatttcccatagccaggaatgggtattgcttcaccaacgttgccatagtgtacttctctagatggatcaaaccagagccccttgggtcaatcacttcgccagctgtgcagaaatttgtgtggaaaaacattatctgccaatttgatgtgctgaaggagttcatcactgacaatgcgaagtagtttaagtctgaaaagttcaaggagatgtgtgaggggctaaacttcaaaatcaaatttgcttcggtcatacacccacaagcgaacggggcggctgaaagagaaaatggcaaaattctggaagccttgaaaaagatgctgcaaggagcaccgaaagggttgtggcgagaggaaatgctttctgtccttgttggtatttcttaacgacattactagaaatatgattcccaacactggcgtagaa

SEQ ID NO: 90731 - DNA, 1183 bp, Oryza sativa
taggaactaaccaagagataattctcacaagataaatccaaattactcaagaagaatattatattgacttcagagtaataaataaaataaaagaaataggagaatattaccgacaactccggacttcttccgactccttctactctactctcttcctattctagtatacaatatagtacaatagagcctcttataattcatctcaagcttgggagtgtgtgttgaagtgagtgagctgatgtccttatataggggtaggtacgattggcgaaggggaaatgtccgaagtgcaatccaaccgtcattagggatgcatctgggacgtccacgccaaaccccacatccaacagtggaggtggtggttcggccgaacctgggctgggccctcctggcctggccatcagctcatgttccccccggtcctcctctattcattcttcggtattttgggccgatttactgatgttttgatgaagttcacaacccatccttgcaggggtaacatttctcctcactttagtctgattttcctcccatcatcgaggtttatcatttgcaaacaaatatataccaacacatatggaatatgtgagattatgtacctatcactatgttggatgttttattatctgaactttatgcagatgttggcggtatagaattgacatttaacagccgccaacagttttctaagaccttgtcattagcagctcgctttttgcctaaagcatcagtggttttagcttgcgcaaagacgagatctttcaaggagggttggttacagaaattactgttattgttacctccttgatagaataggcgtggctggttccaccactgacctcattgtggatgatactcgttgttgttgttgcccatgtacatcgcctcttcacgggtttctaggcaatcaatcccagagtggcctgtgctgccacagactgttggtatttcttacgatcacggatagaatccgcaagcgcacggatataccgatgtagcacttcccctacgaagtattccaagggtatcgaatccaagggaacgtgtgtgtttatctcctcgtcaggttcatccgaggacacaaagctaatatgggcagagggtagagaggatttcctaatgagaaacagtgtctagggaaagcttaactttaatcctaacacaatacttcaggcactgg

SEQ ID NO: 90732 - DNA, 2349 bp, Oryza sativa
acgtcgtgcacgcgcgccgcctgccttgcccggcgaggcgagcgagcgcgcgcgcgcgtgtttcccctattctctccaccacacatgcttcaagtggctagtagggcattctcccttttaaggaggtccccctctcctagaataagcaatgtggtactaaattccacatgcatgccatcccatgaggtgggcttttgtgattttccaaagaattaatcttcgaatgggccttagcccatctattaattccaacaatccccaaccaaatctcaaaatcccactgagatttgccttttccaatgtactgtttatataccagcggttcgatggagaccgattaagattgaatatccacctagaactccaagctacacttactcacaacttgaacaatggactacgccttgaattgcaagtcttgtgcaagcaagtttcactcagagtcttatctggtactagaccgtctgtagactacccctcgggtggagcgtataagtcatactcctaggtctttagtaagcttcctagaagattcacccaaaatctccatagactgcgaccaacagtcaagcttacaaaggtgagttctttcaagactgctctgcaggacaacatcttcactaattaaagccaacagaactcattaaggcatagccaacctgccttgcaactcacaagagtacatgcatcttcacttagagagggtatagattggtactctcctctagtttactaatggtttgttcttcccaggttctaattcacgggatctccgatcacatagactgggttaccaccatagtataactcatatgggtctcaaacccatctccttcgatgcattatctatcacatttcgtgataatccctttcgtgaatggatctgccaggtttctagctgtttggatgtaatccaacgttataactccggagtttctcaattttttgacagacttcaatcgtcttttcacatgtctagacgatttcatattatccttagaactattcactttgacaattaccgtttgattgtcacagttcataaggatagccggcactggtttttcaacaataggcagatccattaatagatcgcgtagccattctgcctcaacagtagaagtatccagtcccgtcagttctgcttccatggttgacctcgtcaaaatggtttgtttgcaagacctccacgaaacagcaccaccacctagtgtgaagacatatccactagtggctttgatctcatccacatcagagatccagttagaatcactatattcctccagtatcgcaggatacccagtatagtgaagccccaattccatagtacgttttagatagcgcattactcgctcgagcgcacgccagtgatcatctcttggattagaggtaaaccggctcaacttgctcacagcaaaggagatatcaggcctagttgtactagccaggtacatcagcgagccaatgatttgggagtattccagttgattcttagcaattcttttgttcttgagaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacagaataactccctcacccccatcatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaaactgtcttaacgtccatttgatgaacgaaaagaccatgtgagcctgttagggaaagtagcacacgaattgtggtcaatctagcaacaggtgagtaattgtcaaagaaatcttcgccttctttttgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttagga

SEQ ID NO: 90733 - DNA, 653 bp, Oryza sativa
ttcattgggaaaaaggctctcaaagaaggtagcatcacgagactccataattgtaccaacatgcatgtcaggtacctcgcatttaactattaaaaatctataggcaatgctatgatgagcatatcccaaaagacacagtccacagtcttaggtccaagtttgcgcttcttcgttattggtacattgactttcgccaacaccccccatgtgcgcaaataagaaagtgatggttttctcccaatccatatctcatatggtgttttgtccttctttctgttaggaactctgtttaacacatgattcgaggtcaacaatgcctccccccaccatgccttaggtagtcccgcggtgtctaacatggcattcaccaagtcagtcagtatgcggttcttcatttcagcaatcccattagactcgggagaatagggaggcgtcctctcatgtatgatgccatgttcctcacagaataagtcaaactcgttcgagaaaaactctccaccatgatcagacctaagcctttttatctttctgtcaaattgattttcaacttccgccttataaattttaaaatagtctagagcctcgtctttcattttcaacaagtacacatagcaaaatctagtagcatcatcaatcaacgtcatgaaatatcg

SEQ ID NO: 90734 - DNA, 874 bp, Oryza sativa
attcctgcagcccgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcggccatcagaaatttctctcagtggattgagaatgagcctaaggagaagtgggctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcagga

SEQ ID NO: 90735 - DNA, 3412 bp, Oryza sativa
caactttgctttgttttatacttatgtttgaagtttgctctatacaggttgcggcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttctagcaggtgatgcgccttccacacctaggaccgaccaccacccttcctccgtactctacagtcgggcctagcaaggcttggttgctccagttcactgtaagtaaataagttgttattatcatacgtgcttatttgcgaccggatcagtgttttgtactaacatttcattcttaactgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgtcctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactggccgcagcgtgtgatgagacagttcggacttaggcaggtgtttcccggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcactggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgaacagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcccagatattagttcatttttgtttcagcttttgcacgaatgtgtcaccatgttttaactgcacgtttcctcatcgcaggacctcgtatgccttcgagcgcgttcgcaggcacgaccggcgcttccgcgagctccgcaggggcgttcgccacctcttcaggcgcgttcgccagctcttcctctcacggagcgtcgatccctcgcccacacggtactttactttttattaatactgttaaatacctatacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatagaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaatccatgccccctcgccgccatttgca

SEQ ID NO: 90736 - DNA, 765 bp, Oryza sativa
attgaactgctatcgtattcctgcagcccagacttatttatgtttaactatatttatagaattttttaaatatatactgatctgcgataacaaatgagttgcattaatattgaacatattttgatgatattttgtttgaaatgttacaataattttctataaacttgattaaacttaaaatagaaaaacaaataacttataatatgaaatggagacggagggagcaccacaaaattaacagctagtagctagcaaaatacaactcggtcgacagcttcggactcggtaattcatacgtatatataatcaatgtatacgatcgagccagctatagagatcccaagcacgtacgtacgcacagatcttagacgtacgcgatgcctgctgcatccgatcttgggcgggacgtcgttgttgtacctccagccggcatcatggacgacgatgatgaaagcacctggtcaccatggccggatctccagccggagctggcaggcatggtgttctgccggctgctgtcccacggcgaccgcctccgcttccgagccgtgtgccgccggtggcgcctcgccgcgtggcagcagcaccctctgccgccggcgctcccctggcttaacttggacggccgcatcacctaccagagtctccccgacggcgaggtgcaccgcatccccgtccccgacgagctccaagctggaggcacggtcgtctgccgcggctcgttcgatggctggctcctctacgaccgcagcgagcaactggagt

SEQ ID NO: 90737 - DNA, 1143 bp, Oryza sativa
aacacaaatgtagtcgacagattcaccagagccggcggaacgtaggacttaccccttcgccggagatcgaaagctgatgcagccctgcgtcaggtgccaaattccgccggttgataagtaaaaacctcaggaaagagggtggcgatgcgccgagagtagttgtattgatcgagattgattgattacagggacccctggtacacaatttatacccttgggtctatggagtccttgtcagacaagaaacaaactttctaaaagataaaacagaaacataaagtccttatcggacactaaacatactttcttaaagataaaaggaaactaacaaactattcctaattaatagatacaattgccttcttcggactcaatccgcatgtggcaatcctcatgaagcaccttaaacgaacccgacaatggttccaacatccccttgtcggaatcggctacatcggcttccttgtccgattcgatatcagttaatacaccgtagccgatgctgttccgaagccgatttatactctgtttctcttaccaatttccttccaaatccgcttcggtcttaactccaaatccgatacatgatttaccaaatttggtcgttaacaccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtacatcaatgaaccaatgatttgtgagtatctcagttgatcccttgctattcttcggtttttccttaatagcacgctgggatcataaggagtaggagctggcttacagtcactgtagccaaagcgactcaaaaccttatctacatagtgggattgcacaagtgtaatcccaccctcatctcatctcagtagcttaatgttaagaataacatcagcctctcccaaatcctttatttcaaagctcttggacagaaagtccttgacctcctcaatcacattgagggtggtcccaaagattaatatgtcatcgacatataaacacaatatcactccttgtccctcaccatagcgatagtacacacatttgtcagcttcgttcacaa

SEQ ID NO: 90738 - DNA, 656 bp, Oryza sativa
ttatgccgaaggaggaggtgccaagaacggcattggcacggatggcatcggcggcagcgtcaccttgggcacggccggcatcgacggcatcggcggcagcgtcaccttcggcacggccggcatgggcggcaacgcggcgttcggcacggcgggcatggctggcatcggcggcaagctcgccgccggcactgcaggcaccgcgggcatcggtggcaacgtggccgccggcacagcgggcaccgcgggcattggcggcacggtcaccgcggggacggtaggcacagccggcaccgcgggcattggcggaagtgccaccttcggcacggccggcatgggcggcaacgcggtgttcggcacgattggcaccgccggcatcggcggcagtgtcgccgccgggacggcaggaatggccggcatcggtggcaatgtgacagcgggcacggtaggcaccggcacggcggcaggaggtgttgcgtcggcgaggtggcgcgccgcttggcagctgcggctgctgccggcgagcaagacggccatggcgagcaccgtggcgaggagacccgaagtggaagccatggctgagagatcagtggctagctagctagaactgcaaaacgagagctgctcaattggtgatgcaaagatgtgcatctttcgca

SEQ ID NO: 90739 - DNA, 755 bp, Oryza sativa
cctgcagcccaattaatacacaagaggtataatataatactccactagctagctagtacagtagttgagcatgaaattttgtctaaattattatttctctctctctctatatatatatatagttaacatacctgacaaaccatatgtttacacgtcgtgttacattagagttattgcgcatatatacataagtttcccattatatatatagcactccagatatattcatatataccatgcctctttattgccaactatatatatcacataagtaagtaggagtaattaatagataaaggcatgcatcgaataattagtacgagtagctaactagctagtacacagcaaaacctctgcagtctgcacactcaccacagtgatcacctattacaggactaattgaaagtgctgcatatttgcatgtagatgagtactcttagaccatgcagaacttattaacgtagagatcgttatactcatcataatatagtctagatgatcagtagtaataatcatattatatccgtaattaaatcaggcagctggagccacatcgacgtcgtcgtcgtcgtcgtcgccgttgctgcgacggttgccgacgaggaggttgctctccagtagcaatgcccatgcaaggcgctcacactcgctcttcgctatcgccattgatgatctccaagcacagtgtattttggctatcgaggaagacgaagaagaaagtgtttctatatgtatatggtcgatcgagttgagtg

SEQ ID NO: 90740 - DNA, 591 bp, Oryza sativa
cccccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaacgtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatac

SEQ ID NO: 90741 - DNA, 733 bp, Oryza sativa
ccatgagatgcaggaacgggttcaccggaggcgcgacgtccatctcgccctccagcatcttcaccaccgcgcccatcggcggccgcgcctccggccgctgctgcacgcaccagaacgccacctggtacatcctcaccaccgcctccttgcaccgccgctcgtcgtcggcctcggccacggtcaccacggcctcgccgtcgctgccactacagatctcgtcgctcggatgattgatggcggcggcggcgtcgtcgaccatcatcaactcgccgcgctcgtacctggcccacgcctccatcggccaccactgctggctctccggcgcggcctcgtcgaagttcctcctccggccgacgatcttgaggaggagcatgccgaagctgtacacgtcgcacttctccgtcacgccggactgcatcaacgtctccggcgcggcgtagccgggggtgccgcgcatgccggacacggagacgtgcgtgtcgccgcggttcaccagccgggccagcccgaagtcggccaccttgggcgtcatgccgccgtcgagcaggacgttgccgggcttgatgtcgtagtgcacgatcttgtgctcgcactcctcgtggagcgtagcggaacccccgcgcgacgccgatggcgatggcgcgccgcgccgggacgccgacgtcgcggctcaggtcgaacaggtaggcgtctagcgcgccgttgcccatgtactcgtacaccagcgcgcgca

SEQ ID NO: 90742 - DNA, 926 bp, Oryza sativa
tcttgaattcaattattttccttctgcaggttgcttatgtgttaggtcagctgcaaaataaagctgcttcggatgcgctttccaccgtctgaagaatgttgatgagcatccaatggtcaggcatgaagctgctgaggcccttggttcaattgcaggtaactaatactgcaagatttgttaagtctcatattgagcgtccatatttcatagttttctgagggtactcccactgtcatctacagatcaagaaagcattgcacttctggaggaattcgcgaaggatcctgagcctatagtctcccaaagctgtgaagtcgcgctcagcatgctcgaatacgagagatccggaaaatccttcgaggtatattccctagatcaacagaaataacctttgtgcctttgtggtatcgtctaaccggcttgtgtttgttccatgcagtttttgtttctgcagactcctggggtgcagcaggagtcctgagtaagatagatatatctactccaggcttctatatcgatctactgccaagctgaccgacaaattttgtcatcaattttgtcaagacgcttcactcctatcaatagttataccataagagtgtttgttgcttatgtttttcaccactattgtttctcctggtctcctgctgcttatgtcttggaccatgagagtcaaaacagctagtaagaatttacctgagaattttcggtttcatggtaactagaaataccatgtaaaactttacacagatagtcaatgatgtatcgacatagcaacattaaatattgaaggacttcatgagcaaacagaaagagaacaataggcggacacgttctagagcaaaggttgctgattacctgttaagagtggattgttcctatcgagaatgattgtatactcgttttacatgattgtgactgttttg

SEQ ID NO: 90743 - DNA, 643 bp, Oryza sativa
tcaaataacaaagatggaattggaaagaacatctgactgcaactagaaagctcattcagcatctgcacaagcctcagtctcaatggtaagtaacgtgtgcctgggaataagtgagccactcctcttattatttgaacaactgaagaaagtaatggatgcatattgtagtccttgtagttacaacaaagaaacctaacccataggtttacacagttaatatattgccagttatctaccttcctgaggtcttcctgcaacaacagtcgagattgcatgtaaatatccatgtggtgccaacaaagcaaaaaagaaagcaaggcgtttaatgtacaagagcagatatcctatccttttcttttaaagatgtgaaaagggcatgtatatcagcaagaagttttttcttgtatgactgtacagaaagaacttttctattcatagcaacctagcaagaaaatgtaattggcatgtcataaattctaaattgtaaaaaagatgtggtgataactgattgactgcactttgtgaattcaacgttcacagtgcaagaaggaactaatcaacaacataacatatatgcctcaggatttcctttgactttactcacttcagtcttcagacagggaaaaaaatatacaaaccagaa

SEQ ID NO: 90744 - DNA, 894 bp, Oryza sativa
tatattccattatactataataattaactaatcatccttttgatattatgcttcaataacttgcagttgctttcaaactttatgatctcaaacaacaaggtttcattgagaagcaagaggtatcttccttctgcttgttcataagccactctttcttgttttgctatttactatactccatgagaagcaagtgttgcatttttttagacacatgctttcagtaccccatatattagcataatttcccacctaataatttagcacaacaattcaacttgtcaagtcatgttccaggataagccgtttactgtactggcttgagtatttaagaattgtgagagtttttatgtctattacggcaaactaaactgcatccctctggaaggttaattgtttatttgtttgagaaggcatacttgatttagcatcaactcatgtagcagctgttggtcaagaaaagttattctagtccttgattatcaggtgaagcaaatggtggtcgccacacttgctgaatcaggaatgaacctttcagatgagattatagaaggcattattgacaaggtatgcatgagaacctgcattgcagtacagtgcgtatatctgttgtatttatactcagttgcttatggagaaaaaaaacatttgctttgttactagacatttgaggaagcagatacaaagcatgatgggaaaattgacaaggaggagtggcgcaaccttgtgttgaggcatccatctttattaaagaatatgacactcccatatctcaggtcactgttgctaacctgtttgtgcattctgtttctttttggtatcttaggtcactgttgctaacctgtttgtgcattctgtttctttttgttcctaataaataacttgtcaacttttctt

SEQ ID NO: 90745 - DNA, 734 bp, Oryza sativa
ggactcatttgtcctctagcaaggacataagtgccacatgacacactcgcactaaacccctttcatttggctttgtcttccttgcgccgaaactacagcgccagcccccgtgatggccgccctttccattgcgctctcttctcctcttgatacagcgcgcttctcctctgaatcctttctatgcctcctttttttctctaaatcgaggcctcatcaacttagacatttttgctgctcaactgtcatggcttcaaggctgcatcacgaaaggatctgagaagtgagaactatcatgccatggtcgttgtgtgctgcaattcaggctgatttggattttcgtttggctttgtcttccatgcgccgaaactacagtgccagcccccgtgatggccgccctttccattgcgctctcttctcctcttgatacagcatgcttctcctctgaatcctttctatgccttccttttttctctaaattgaggtctcatcaacatagatattttcgctgctcaactgtcatggcttcaaggctgcatcacgaaaggatctgagaagcgagaactatcatgccatggtcgttgtgtgctgcaattcaggctgatttggattttcgtttggctttgtcttccatgcgccgaaactacagtgccagcctccgtgatggccgccctttccattgcgctctcttctcctcttgatacagcatgcttctcctctgaatcctttctatgctt

SEQ ID NO: 90746 - DNA, 722 bp, Oryza sativa
tgctttgtgggtgagtgttgaacaggattcttagcagggttaatagcactaatattatcacaaaagagagatactttcccaaaagtaagaccataatctttcaaagtagataaaagccaaagaatctgtgaacaacaactagcagcaacaacatattcagattcagcagttgattgagcaacactagattgtttcctagaagaccatgcaatcaatgatataccaagaaaatgacatgttccattagtacttttcctatcaattctacaaccgccaaaatcagcatcggaatatccacttaagcatatagaagatgaagtagaataccaaatttcaaactcaagtgtatgattcaaatacctcattattcgcttgaccgcttgacgatgtgaagcacgaggagaagcttgaaagcgcgcacacaaacacacagcaaattgtatgtcaggcctagaagcagttagatacaacaaagatctaatcatacttctatactccttttgatcaacagcttcaccatcttcatcaggatccaacacagttgtagaaccaattggtgttgaaattggcttgcaattctccatcttgaaccgtctcaaaagatccttcatgtacttcgtttgatgcacaaaagtaccttgaggtgtttgttatttgcaatcccaagaagtacgataactcacccatcatggtcatctcaaattccctgcgcatagtctcag

SEQ ID NO: 90747 - DNA, 1512 bp, Oryza sativa
tgaacaaatatgtaggtgaattatcacttgtattagtttgaatacatcacttcatggagctagagcccatctctcaagtgtgatgagatgcatatatatatctttaaggatatataagtggaacccttgtttgacatttcaagcaaaagggaagtagatcagtagcatcgccacttgtgatgccactatttgtgcatttgtgcaatactctcttttagataatggattaactaaaacccacactctacatcctacatgtacatgaccaaaactgtgcaatactcctttcaacaaaaactaacagttgtgcaactgtaacttccaggaaacatccaaattaagagaagcgctaatacagaggtaatgtcaatccaaacaactttatggtgttgcgcaatgcctaacattcatcatctcctctccaacttgcttcaaaccaacgaccactccactctacgagctccaaactccacccatatcttttgccacatactacttcctcagaataagttaattaatctgagattaatttattttggatagacgtctgtccagatttataaaattaggatgtgtcacattctgtgctatcaccgtaatggtatttgattagagcaagtttaatagtatagccaactactaactccaaagcatctacagctaatgtaatagctaattcatacaatagttccttactatactattaatacccggtcctacctgtcatacacacattacgtcttggagtttgtgctgcagctggctacagatctgtagcccactgcttttctctctcttcctttatctatttaaaatatgtttatagctggattatagcctgctattatacctgctcttaacaatgtaatgatccaattggaatgatcacctctgcagactgacgagaccctgatctcaatgagttatcactttcagctgaatctgtagtgcttgtccacctaagcgcagccgccggcgacgcgaccaaatgctggaacgggttcaccggcggcgcgtcgatgtccacctccccttccagcatcctcaccacggcgctcatcggcggcctcgcctccggctgctgctgcacgcaccagaacgccaccttgcacatcctctccaccgtctccctctcctgcttgtccatggcgtcgcagccctcgatggcctcggcgaggtgtccggcctcgtgcttgctccacgccagcatcgggaaccactggtgctggctccccggctcgccgccgtcgtcgaggttccgccgccggcggacgatctcgaacaggtgcacgccgaagctgtacacgtcgcacttctcggtcacgcccgcctgcatccacatctccggcgcggcgtaacccggggtgccgcgcatgccggacaccgagacgtgcgtgtcgccgccgctcgccagccgcgccagcccgaagtcggccaccttgggcgtcaggccgcctgcgaccaagacgttgccgggcctgatgttctaatgcaccatcttgtgctggcact

SEQ ID NO: 90748 - DNA, 1112 bp, Oryza sativa
tgagtaggtgtcgaaaaaatcatcgccttctttttgggtataacccttagccacaagccttgccttgtacttttcaattgtaccatcaagcctaagctttttcttgaaaacccatttgcatcctacaagtttgcacccatatggacgctcaacgacttcctaagtaccatagacataattgagtccatctcactgcgtattgcttccttccagtagtcagcgtcaggagataagtatgcctcttctatggtttttggagtgtcatccatgagttatataatgtagtcatctccaaaggattttgcaaccctttgtctcttactcttacgagtatctacaatgttatcctcctcaagatttccctcaggcgtttgatcattgtgttctatcggtgcaaagtgctcatggggtatgacagtttcttgactagaagtgctaggtgtattttcatgggaaattcattctcaaagaatgtggcatctctggactcaataattgtaccaactcgcatgtcgggtactccagagtttactattaagaatctataacccacgttgtgaatagcataaccaaggaacacacaatcaacagtattcggtccaagtttacgctttttggctataggtacatttaccttggccaaacagccccatgttcgtaggtatgagagatttaatttcttcctttctcattcctcgaatggtgttacttccttatgcttcattggaattttatttaggacatgacaagcagtcaaaactgtctcaccccaccattccttggaaagtcccgtagtgtctaacatggcattcaccatctcagttagagtacggttctttctttcggctaccccatttgattggggtgaatagggaggcatcctttcatgaataattccaaactcttcgcaaaaggatgtaaactcattagaaaaatactctccatccctatcagacctcaaccgtttgattttccttttaagttgcttttctacctcagctttataggtcttaaagtaatgcaatgcttcatcctttgttttcaatagtgtcggtgacatgggatcgggagtatcatgactagaggtttgaggcagacacaatcgcccacgt

SEQ ID NO: 90749 - DNA, 2642 bp, Oryza sativa
tttttttcgtgcattcattttctatgatgaattttggtttcttcttgttctgctaataatgctattgccgtgatgtaggtggaaagaatagttctgatcggtcatttatggctgatcttgtctattggatcgcacagaatcccccaccagcccattttttccttatatctggggataaagactttgcaaacattttgcatcgcctgcgaatgagcaactataacatactgcttgcttctcctggtactgctaccaccagtgtactctgtagtgcagcaacaatcatgtggccctgggaagctctagtgaaaggggaggatttctcacctaaacgttttaaccacccacctgatggtttagctggttcttggtatggtcactataaaggagccctggatgatccctttgtagacacagaacccgaggaactcgttgtagtaccatctgatctcaagcatggttcaatccccaaatatgtggttaatgcgatccagcaggtactaaaatcatatcctaatggagtgaatctgtcagacctccgactagagcttaaaaagaaaaatatttatctgggaaatgatttttttggccacaagaagttctcttgccttctccaatcgctgccaaattttgtggaatttattagtcctccagttggtgcaaaccagccatgtgtagttgcagccaacagaaaattgatgggtcctgacaaacaaaattttgagagttcaactgaaagtaatgtcggggacaataacttgaatcgagcaatacacaatgacaagccacctccactccctgtgtcgacttctttttctgaaaagaatgctaagaccgaaaattcttctcaaaatattgccaagaagctgcagactgcaagcgagaatccacctacatttgctgtcttatcttcccgatcagatgtgttacctgaggatcaaaaggagcacccagctgccaacttgaatgcacagatagaatcaccagaggaccacaaggaagttgatcctacgactgcctctggaattccctcttcctcaggggtggaagacaatgttaacaaggaagggctattcaaaaggatctggctattgtggaaaggccctgagagtgccaagtctgaagtttcccatcttgaaagtacttccactgtagtggttggtgatgcccaatctcctcagcaagagcataatgctaatgagcatcggagacttttgaagagagtctataaaaaatcttgtcgaaatggcagcacagacggatctgacagtgtgacaacaggcagtgcatcaacttcatctcatgatgaccgctctaaaaagttaaagcatgtggatgatatgagatcattagaaagggatacatcaaattcagaaccatgtgatagatctgtatctgtttccgtggacaaagctgagaaaggagatggtatttccaaaatggataagggtttatttagctgggtaacagggtggttgaaatttggaaaatcagatgcagataatgttacagccaatagaaatgtgattgatgaagcaagcacagactcactaaaaggacctgaatccttgaaggtttcagcttgtggaagtggagaagaggaggttcatgaaatattcacaaaatctttcttctgggatgttttgcagcaacagctatcaaagccccttggttctgagcttgtttcaaaagcaaagacaaggtaagatttttatgcctttatacattaattaatgccttctggttagttctagaccttactttgcataccaaaattttttgacctgataaaagatttccaataatgtaacatggtgttcttgtatttctttccataccagaagaaatatgtaggtctactgagtatcagcctgtcaattagtgagaagaaaataactcgcaaagctgagttttctactctgatgtcagcaagacaattctgagtgtgtttgtgacagatcaaaaactttggtttatgtgtgtagcttgatatagtgtgttatgagcaagttgaaataactgttattgcccagatggttcatttagtttgtagctggaatgcctgtaagtctatagaagtattagtttttccttttacttcaacttcctatgagcatgtctgtttgggtacactagaagacgagtactaattgccgggcgaaaaaaataattctaacccggattcttatgagatgatttgataaatcatttttggcttgtcccttcgagagaatcttactgacatgattacattttcgtgatcagggaggagttagtgcatcaattgcacaaattagattgttggcctctgaaaggcctagctgagaaagatctccatcagctggtgaatattttagtttcagagaagaaatgggttgaagaaaccccttccaggtattttccgtttcgtcttacccttcctcacaagagaacatgcattccatcgaactccaggaagtttgatggtctcagttctctgttttccaatgggaagccattgccgggcaatacactggtgatcaaagcacaaacagtcctctccctagggaggaaactttgtcggactgtcacaagctgttaaaggaccttcttctggaatatgaatatggttttaacatcagcattttcaagcttcgttttgc

SEQ ID NO: 90750 - DNA, 756 bp, Oryza sativa
tcctgcagcccagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaagg

SEQ ID NO: 90751 - DNA, 764 bp, Oryza sativa
actgaacgctatcttattcctgcagcccgttttccctatgcctccagaccaataattggcaagacagtcaggtattcttcacaacaagtaccctgagtgatactatctataattctcttcattacagcgtctctgccatacagggtgggctctatacttgttggtgcggtgatgggacgactcttagcagtgcttgattctatgctaagatgagaacccatgagctctagattaagaatggctgtaacttttgcacacacaggctgcagctgctctacaataatcttcatttttttggatagacctaccctgtcaaacttcaactttggcgttgatttccctttcacatggtctctctcatcgtgcacacagccataatcatgatcgcaatcatcaactagagaagtcgagaaacaaaggcgtttaccgatagcatggatggtgttgtgtggcgaaccgcagcatgcagcggtaatggaatcaccaggcccgttgttagtagcacaagaagagcatgatgaagagaatcccaacagcttgccagccgctttggccgtgtggtgagcgttgaggaagaggtcgctgacgcagcccttggcgtgctcagcagcggcctcggaggtgtcatcgagctcgtcctggatgcggaagtagtcgagctcgtcgagcacgtcgtcggcattgtacgctaagtcccgcagcttctgcaggagctcgttgaggtcggtgttgtggatctccctaccgcgaacgttggtgagctg

SEQ ID NO: 90752 - DNA, 760 bp, Oryza sativa
agtgactgcatctattcctgcagcccacagttaccttgggacaaaatcaattgcaaatagtactacactgttagttcaaggttagtaagtttacaaacctcagttagacagccttaattactacttagcccttagtacaggttaaaactatgacccctttgaacctgaaagctagctcatcagctacatgaaactctacaacacaatgagtggaatcaatcccaacaattcccccaaaatcaacatattaggtggagtccggactccagactctcctactgagatcctaaatcaagaactggtcaatcaatcccgatcgattgcaggtttgcaggtggaataacacaaaaataatcaagagttaataagcaaatcgatgagtatgcgcattgggcgaacgtaccgtcccactggaactcgttccagtaggtggtgtcgccccaggaccaggcgccgatgccgagcttggtcaccgccacgtccgacccacccagcctcaccttgccgtcctcctccaccgccgccgccgccgccgccgccgacgccgacgccccggacgcgcgtggcgggcgtaccgccgccgccgctcgtcggctggggaggaggggcgccaggcagccaccggcgacctgcagggtcccggccatcattgcaggcaagctacctcctcactgttgctcgggcctcgcgcggcgggggttgctgggcttccactgccagtggccgggaggcgcgagctttttttgggccacaacgagag

SEQ ID NO: 90753 - DNA, 768 bp, Oryza sativa
ttttgactgcttctattcctgcgccctgcatgaagaaaagattcttggcccgcggatgcgattatcattctgcatatcgtctggaacacggggtgcattcatagctggagaagggatctgaggcatctggtttggcagagaattgttcatgtaatatgttgttctttgcatctgattcaggccttgagcttgaccccaggcatgcatgccgtgttcaatcccatgcccatcggtggcatgagctggtgggtaccggggaacatcatcggcacaatcccggtagtcatccacatgatctgaacatgaagcaacagtctcacaatcaggcaccgtgatttgattcatccagaaggattgaaattctattgctactgtggagaaatggggaaagtttgatttcaaacctgaacttgcatttgcagggacttcaagtactcaattgcttcatctagtatggatgctttgtcagtctgagaaacagctagaatcatcaaattgccacaaaattcaaccatggcaatagccaagaacactatactattatacaggataacaaaaattcccacaacttttcgcagaaattattttaccttgttgcaatgaggtaccagttcttgcaatgctctcaacttctcattgatcctatcccttcttctctgcagcaagaacagcaaaaaaaatcaagaacattcaccttgttgcaaatgatgcaacaccatctattcatcaatggttggttggggttcttgaggtcttacacgctctgac

SEQ ID NO: 90754 - DNA, 764 bp, Oryza sativa
  unsure (1)..(764): unsure at all n locations
ggtgaactgctatcttattcctgcagcccagcaagccacagaagatgccttggaaatcatggaaccaaaggaagggatggcatttgccagtgtgaatgatgcttttgtgttctatgagagatatgctcagaagaagggattttctataacaaggagaatctcaagcactttccaatccttcaccttcgcttgcagaagacaagacaacgctcaatgctcctcaaacaatgcatggaagcatcatcagaatgaatgtccagctaagataattgtggatcttgatggtcctgacgacaaattcttcttatcttcagttacgcttgagcacaatcacgatctcagtccaagtgaaacaagtcgaatggaagttttcatatgtaacaaaaaactgattcgtgtgctaaaagaagaagggtgtcaaatgggagagcagacaatcatgccaacaagaagtccagtactccttgcttgcaagctgaaaatcgcccatttggtcaaaaggatcccatgaacaatttgcaattggaaagaaaactgaagctcagtgatgcatataggctntatcattacttcttctgcatgcagttcaagaatcctagctttttctatgctttggactttggcaaggactcctgcctgagaaatgttttctgggcagatgcaaaaagtagggcttcatgtaaatatttctcggatgtcgtgacagttgacactacatacttaatgaacaaggagagcatccctcttggccttttgttggtgaa

SEQ ID NO: 90755 - DNA, 761 bp, Oryza sativa
  unsure (1)..(761): unsure at all n locations
aattagctgctatcttattcctgcggcccgacttcgtcaacgcctggccgagatcgcgcgcgctaagctcgagaacgcggtggcgacgtcgcgcgcgcctctcctggagcgttggtcgcccgacggcggcgcggcggcgccggtggtgctcccttacgacgacctggcggggctcatcgcgaggacaacgacgacgaccctccgctgctgcgcgagcggatgctgcacttctcggcggagtcactggcggcgctcaaggagcgcgcgcggtgggagctcctcgccgccggggacgcagccggcgcggccgccgtgacgaggttccaggcgctgagctcgctgctatggcggtgcgtcacccgcgcgcggcggctggcgccgggccgggaggtggtgttccgcgcgtcggtcaacagccgcggccgcctccgcccgccgctgccaccggagtacttcgggaacagcatcctccccgcgtcgacggaggcggtgccggcgtcngagctcctggcgcgcgggcacgggtgggcggccgccgccgtggggcccgcggtggccgcgcacaccgacgagcgcattcgctcgcgctcggcggcggcgccgtctgagtcggcgttcaggctggtcgactcgagcggcgtggtcgtgagcaactcgccgcggttcgccatgtacgggtgccaactctggtgggggaaggcgcgatccgcccaggatccgctagggggacaagatctacggggacgtgtccttgttctcct

SEQ ID NO: 90756 - DNA, 782 bp, Oryza sativa
  unsure (1)..(782): unsure at all n locations
ggtgagctgctatcgagttcctgcggccctgcctgatacatgataggcacgctggcattctgcgagcgatagaagagttgcagtttgggagtatggaacgaggataccccggtgtttgggaagatgtacagagtaggtggtgcatgcgtcatatgggagctaatttcttcaagcaattcaagaacaaggagctcatgaacatgtcaagaggctgtgcaatcagaaccaggagaaaaaattcaatgagctttggaagagattagatgagttgacagccaaatgtagtgatcagcgtgcagcggctccatcgaccgccgttgctgaccctcctcaagctcttggacctctcccaacggatagtccaacattggttagaagaactgtattggagattcggaaattttctcagtggattctgcatgaaccaaaagagaaatgggccaaggcgtatgacacaggtggtgctagatatggaataatgacaacaaatttggcataagtttacaactaggtgatgcgcggtgtccgtggactgccactagttggcatagtggagttcattntacatgggacatgcaggtattttagggatcggttccaggcagttcttccctctatgccgaacaaagcattttgtttggagctttcatgcagaaaaagctagaggagttgcgtaaaaaggccatgaaacatcgagctctagtgaaggtacccaacaacacaggtttgagatactatgtcaagataaggcaagcangggtatctaccgcaagagagtgaat

SEQ ID NO: 90757 - DNA, 2435 bp, Oryza sativa
tggtcttgtccgagttctccaccgccttgtccatatcagcatcagccttcttggtctcgttgaaaggaaccgatgtcaccatggctgctgatgtaattgagggtacagatgaagctgtagtagcagggaacacgcgttctggtgcagcagcagtactcttggccactggcctggcggtggcgctacttggtaccatcgtcgaacaggtggtgtgcgtggcagtggcgccatctccagggaacatctggacgtgctgcatatccagtaagcagccctcgtcgtagatgtcgtgaccatgggtggtggaccgagccctctccgcgtcatggctggacatgaacgacacaagagccttgacttgccatgtgctcaccgcaagaacctgcaccgccactgctccataggtatcgtacacttgatgcaacacctcagatgtcactggatatatgatctggctcacggtgacgcaaaggacagcagctgagtcgcctcttggacagctcggcatttcattgaacaggtggtgggcatctcctccaaagacaccaccaccaggttgctggctgttcctctgaccaccagcgctcttccacttcatctccacacctaaaaccccacgaatcgactgctctgataccatattgtcacgaacgcactccattccaccccaaatcagcaacaaacacacaagagataaccatcaattctcagcagtaactcagttactcaagatacaatgtggcagaatagaggcagggattgagaagaagcaatctagacttggatttgagagaagaaaggttgagaaatcagataatagaatcaggggtaggggaagagagctcgaggaggaggaagagaggcatagccttctgtttgttcaattcttcgatgccctgttctgtggctgaagggaagtatttgtactcctgctcattgacttgctcccttgttaggtaacttgggctaagcccacttttagctgcagcccactatatggcccatcgtgtatccgaccatggggtacatgacattcctcccaccttgaaattcgatttgtccccaagtcgatccaaaggatggtacccttgccgacattgaggagatgctgaactggaaacaccaggatcccagggccagttcttctccaactcaataactatagcctcctgaattgcagaagtttccacaatatcaacagtttgtttctccttcatgccttgaaaactgctgctatcatttctcatttgaaaatgcatgctcatgaaacaacttgctgaaaatattgaattttcaatctgaagtcgaacttggttgcacctgaacaaacccatctccaagatggagcttggaacgatctgtgccgaagattgcacaagcaataatgccatagccatgatacttccaactgaatgatttggtaatttatccaaactgaacttggcaacaccaagctttggtccatccatttcatccttggagacagattgttccgtcatcttaatccgagtcaccatttcttgatcttctacagtgaccccttcaggaagtaaaaatgacagggaatcatccccttgcaaagctagattttcaagcaatgagctaccagcaaaatcaaccttgtactggaccaattcagcactttgcaacatggtgaagcaattggagatatgactgctatcttctagtgattctccccaaaccatctcattgtgaataccaccaatggtatagttaattgagaaattatccccattacacaacgtaattgtagtgagcactccatatatctgaacagtcaagtttggtggtggccatggaattttgagctctgtaggaatcagcactccctgcaaattcctaccattgaccaataccttttgggcctcctgatcttcattagcacaattaaacaagcactcaccccatgtgtcatgcattggccaggaaattagcttcagttgcacaaacataccaggatcatcaaatgaccaaccatagattgaatactgcatatgctggtaggcagtccaacatgtaccagatgaatgcagctcatagcaaatacaccatccaacaaccagattttgcagcaagcccttagtggaagtaattgttctactcatgaactgggcaacactgtagttcaaagagatttcaggatgctcaccatgtaaattcagtgcttcaatttcagctcgaacaccttcttgaataggagacgaccagggttgtaagagctttaccaccacacctccgttgccttgacaaagctgtggatcaggccatggtaagggccgagaacttgaggtcatcttagccttgttccatggaattactgctctccaaggtggtactggtggagatctaactgtgtattctgagctccggtcaaagcaaccatagattacttccaatttcgatgaaacgaaaga

SEQ ID NO: 90758 - DNA, 3943 bp, Oryza sativa
tagatttaggctagaaagaagaacattgttgaaagggacagattagactaattgatattcatcgcctaattgataatagatacaatcccatccttatatggatagtacaacttgactcctaagtaagaacttaatcttatcttatctctaacttaattggtataggctgcctatatgcctctgccttccggcccaatacccatgacaatcctatagaagtatttaatgcatatggtttatttagtatctaaaaggttcattgtctacttctatataactaaggacgaatgaaaattgctaacatatgcttacatgcatactgaaacataagacaaaattagaaacacaagaaaaggaataaggccataggtcactggtggagaaaccctttgtagtcccggttcgtaacccccctttagtcccggtttccaaaccgggagtaccaatccgggactaaagatcgctatctttagtcccgggtgaaataaccgggactaaagatcgagctgaccatttttttttgcatggccctgttgctgcatggtttatatatatatatagtttatatatatatatatatatatataaaccatgcatatatatgtttcaatacatatatatgcatacatatatatatatatgtatatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatcctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaatttaaactaactctgtgttgtatggcaacagttgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggcttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgg

SEQ ID NO: 90759 - DNA, 3181 bp, Oryza sativa
cgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaacttacgtgctaagtctaattacaaatcgtgatataagctaagtctaggtgacgtatattatacaaccctagctagtaaataattatatactaagtctaattacaaataaagtaatcttatattaaaactcaaataatattacatgctacgactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtacatgctaagtgtaattaagactacaatagtcaattgctacttgtcgcaccacttccgtagtcaataattatatactaagtctaattacaaataaagtaatcttatatatatattcaaataatattacatgctaagactaaaatagtcatgtatgctaagtgtttcgtgcgtatatgctaagtctaattaagactacaatagtcaattgctacttgtcgcaccacttccgtagtcaataattatatactaagtctaattacaaataaagtaatcttatatatatattcaaataatattagaacactacacaatcttatatgataagtctaattacaggtctaataatcttaattaattgcattacaaatataacaatcatttatattattacgtcacttgcctgctccaattccttctagggctagctcttccactcaggcttgacgacgactccgacaacacgtcttttctgcaagatacaaaaagatgtatatagtcaaatgcgaagtaacatatacatatatatatatatatatacatatatatatatatatacatatatatattatacatatatatatatatatatattgcatttcacgttaacgttcgtcatcgttcgttcgctcgttcacgttccctagatcgttcacgttcgttccctcgttctcacttgtcatcgttcgatcgttctcgttatcgctctcgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcgacggttggcgccgtggcgacggcggcggcgtggcgacggcgtgaagacgccggcggcgtggcgacggcgtggcgacggcggcgtggcgacgacggcggcgtggtgacggcgtggcgacggtggcgtggcgacggcggcggcggcggcgtggcgttgcggggccgtggcggcatcggggcggcggttggcgccgtggcgacgcgggcggcgtggcgacggcggcggcgtggccacggcgtggcgacggcggcgtggcgacggcggcggcgtggtgacggcgtggcgacggtggcgtggcgacggcggcggcggcggcgtggcgttgcggggccgtggcggcggcggcgtggcgtggcggcggcgacggagagagacggagagagatcgagctgagatcggagagatcgagagataaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgcggcgcaccgggaatatatatacccccggatcttactcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaacctctaatgaacgtacatatgaaattgccacctgtatgatttaaaacttttaaaaattgtaagtatcacatataactagcatatacatgattt

SEQ ID NO: 90760 - DNA, 515 bp, Oryza sativa
aagacttgcgttacatcattggcaagaacaaaaggtttgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtg

SEQ ID NO: 90761 - DNA, 633 bp, Oryza sativa
ggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaac

SEQ ID NO: 90762 - DNA, 1089 bp, Oryza sativa
tgagtactggcaaacctgaagagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaaccatggctaaggaactcgaactccttaagtgtgtcttacccgacaaatttgtggccgggtgtattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacatcaatcctaatcaggatgagaggacttgctttgtgtgtggccaagttggtcatctggctaggaagtgtctacagtgcaaggggatgaaggcacctgcagggcagacttctaagtctgctaatgtgaccattggcaacactggagatggaagcgggtatggtatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgataggaatcttgttagtggctcccgtctgactagagacggatttaagttggtttttgagtctaataaagtagtcgtgtctaaacatggatattttattggtaaa

SEQ ID NO: 90763 - DNA, 719 bp, Oryza sativa
aggttgtgcattaagtgcattagacttcagcggcaatatgattcaaggacagctaccaagatctttggttgcctgtaggaatctggagatccttgacatcggcaacaatcaaattagtgaccacttcccatgttggatgagtaaacttcctgaacttcaagtcttggtcctcaagtctaacaagttccatgggaaaataatggatcctttgtataccagagatggaaacaactgtcaattttccatgttgcggattgctgacatagcctcaaacaacttcagtggcacattgccagaagagttgtttaagatgctcaagtccatgatgaccaggtcagataacgagactttagtcatggaacatcagtattcccacggccagacataccagtttactgctgcactcacatacaaaggcaatgacataacaatttccaagatcttgagatcacttgtgctcattgatgtctcaaataatgaattcgatggtagcatcccttcaagcattggggaacttgcgttgcttcatggactcaacatgtctcataacatgcttacagggccaattccaactcagtttgacaatttgaacaaccttgagtcgttggacctctcctcaaataagctttctggtgagattccacaagagctagcatcgttgaacttccttgacattgaatttgtcctataatatgttggctggaagaataccacaatcg

SEQ ID NO: 90764 - DNA, 2008 bp, Oryza sativa
  unsure (1)..(2008): unsure at all n locations
ttttgcaaatgtctaaaatttatccctgaactttaaaaccgaacaattactatctttaaacaacacttagtcatttttcattctttaaccagattcaaagtgattctggattacatggtattgcgatttaaggttgaaaaatcttttggttcttaaaaatcagtgcatgataaatccataaaattccttaaaagtataacttactttttacgacatgaataacatattttttttaaccatgtaaatataataatttggctgcacaaaatagttttgtaatatatttaaaatcaatttttttcttggaataatatttattttggaatggacataatttatttagatttaaagctagatnnatnaggtccattccaaatgaccaaatgaccggacaaatcacacacatagcaaatctgtcatcctagttcggattgttcttcttcttctttttcttgaagtcagtggtctgttgaactttgaagaatttttctttgttcttgttttgggctttgtgcatcacattagcactagactacctaccatcgcccttagacacaacgtcttttccttaagctttctcctcaacattaagagacattatactatcaagtatcaaccactcaatggagtactcctgtctcctatctcttgtgtttgagacattatactaaaatttctccatgaagaaggtagtttcacaataatgcatgcagccacaaaattgttgagtaaaacacacttggggagtttgagttccttctattaaaaaattataagcaatatgctcccgataagtgtcctgactctataggcaatgctccgaataagtcttatgttttctggaaaaaggtagttttgcaataatacacgcggccacaaatttattaggtaagacacacttgaggagtttggagtttgagttccctcaactgtctcttgtgttagagtgcacaaccgaagctgatttgttaggtaagacacaattgagaagtactagttttcttaactgtctcttgtgtttgagtgcagtaccgaaactttccatgaaaaagataagtttcgcaataatgcaagcagccacaaatttgtcaagtgaattcaagttcccttaactgtctcttgtattttagtgtagtactgaaactttttcatgaaaaaggtactttcgcaataatgcaagcagctaaatttatcaagtaagatacacttgaggagtccgagttcattctgttaaaaatctataggcatttgcttcggataaccatgcaaccacaaatttgttgggtaagacatacttgatgatgcggtggggagcgatgcagtgggaccggcgagcgagatgtgggacggcgcggatgcgggatgcattgtcgatcgaacggttttggaaaaactaatgacgtgggaagcaccaagaagcagagaatttctggtagtggggatgattgtatatgtatatatgatttgagttccttctattagaaatctgtgggcaatgcttcagacttcgcacaccgaattattctttctagttttctccgttacgcatgtctcaagtgactagctaggagatcactctttttttaaggagatcattctttcctaggatggacaaggtgattctaagcatctcatacatatgtcttccataagatagacttgtgtgtttttccaaaaaattaatctccaaataaaccttatctcatctattaattcgaacggatataacgaccaagcgtgtactactgaaaacttgctcgactactggccccagaaaattgacgtcctcgagtaaccaacattgtagaggtcaaactgcatgcgacaatatggatccacgaaattgacagagttggaggcggcagaaacaacagacgaaaatccaacaacatggaccaatttcacagatcgagagatattcagatggagtatatacctctcagtctcagagacggagatgtcaagctgttccagtcaagtctgcacctcatcatctatatattcatct

SEQ ID NO: 90765 - DNA, 1436 bp, Oryza sativa
tcctgcaccccgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaaacgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatagcgatagtacacacatttatctgcctcattgactgcaaagcctgcagatgtcaatgttttgtcaaatttctcatgccattgcttaatagcttgtttcagaccatacaaagacttcaacaatttgcacactttgccttcttgaccttcaactacaaacccatcaggttgatacatatagatctcctcctccagctctccgtttaagaaagctgtcttaacgtccatctgatggacgagaagaccatgagaggctgccagagcaagtgcacacgaatcgtggtcaagcgagcaactggtgagtatatgtcaaagaagtcctcgccttccttttgggtataacccttgggcacaagccttgccttgtacttttcaattgtaccattaggcctaaactttttcttgaaaacccatttgcatcctatgggcttgcagccatatggacgctcaacgacttcccaactaccattagacataatcgggtccatttcactacgtactgcttccttccagtagtcagcgtcaggagatgaatatgcctcttctatggttcttggggtgtcatccacgagtgtcacgcccggaaattcactagtaatttccgaacttatttgtgcataaaaccctcgtccaggaatcagccgaggtacacaaactgactatttaatatacaaatccatcataataataacgttacatacttacaaaagaaaagaaaacagcagcggaataacggtctagcgatggcttctgctccactcccacaggcagctcaactggggtataagccaaacgtcttctcctcctgaatcctttttcttcaactgaggtttgatgattattgcaaga

SEQ ID NO: 90766 - DNA, 1271 bp, Oryza sativa
atctttctactagcttccttgatgaagagctggatgaagagaacagtgtattgtactacacctcatactcactctcgcagctctcagagccaagcttggacaccttgctggcaaacctcaccaacctgcaggagcttcgtctgggcatggtggacatgtccagcaatggagcacggtggtgcgacgccattgcccggttttccccaaagcttcagatcattagcatgccttattgctcactttctggtccgatttgtcggtccttctctgccttgaaatcacttgttgtgatagagctgcactacaattatttgtccggtccgattcccgaattcttggccgatctgtccaaccttagtgttcttcagctttcaaacaacaacttcgaaggatggttccctccaatcatcttccagcacaagaaattaagaggtattgacctcagtaagaattttgggatctctggaaatctgcctaatttctctgcagatagtaacatacagagtatatctgtgagcaacaccaacttctccggcacaattccaagttctatcagcaatctcaaatctctgaaggagttggcacttggagctagtggtttctctggagaactgccttcttccattggtaagctgaaatctttagatttactagaagtgtctgggttggagctagtaggatccatgccgtcctggatctcaaacctgacttctcttactgttctcaacttcttccattgtggcttgtccggacgcttaccagcttccatagtgtacttaacaaaattgacaaaactggcattgtacaattgccacttttcaggagaggtagctaatctggtcttaaatttgactcaattagaaaccctcctgctccattcaaacaattttgtcggcaccgcggagctagcttcactcgcaaaactgcaaaatctgtctgtccttaatctctcaaacaataaattagttgtgatcgatggagaaaatagttcttcggaagcgacctaccccagtattagtttcttacgtctatcatcttgcagcatatctagcttccctaacatcttgaggcatctccctgagattactagtcttgacctttcatataaccagatcagaggtgcaatacctcaatgggtatggaagacctcaggctatttttccttgttgaacctatcacataataagtttacgagtactggatctgaccctttacttccacttaacattgaattcttcgacctcagtttcaacaaaattgaaggggtaata

SEQ ID NO: 90767 - DNA, 1508 bp, Oryza sativa
gtagcatcccttcaagcattggggaacttgcgttgcttcacgggctcaacatgtctcgcaacatgcttacagggccaattccaactcagtttggcaacttgaacaaccttgagtctttggacctctcctcaaataagctttccaatgagatcccagagaagctagcatcactgaactttcttgcaacattgaatctgtcctataatatgttggctggaagaataccacaatcgtcacacttctcgacattttccaatgcctcttttgagggaaatattgggctgtgcggagccccattgtctaaacaatgtagctatcgatctgaaccaaacatcatgccacatgcttccaagaaggaccccatagatgttctactttttctcttcactgggttgggatttggtgtctgctttggaattacaattctagtgatatggggaagcaacaaaaggaagcagcaagcttgagagggaaccatattatagaatggcagaatattttgttagtcactcttgatcactctagcaacattcagaaagactagtattaatagtgatgtatgaattaaataaaggataactatgtttataaacctttgattctacattattcatttcagtttaaaaaataaggagctaatgtttgttcaaaaaactatgctgataacagatagtggcatgaatgttaagtgatctattccctgtgagccgcatgtttagttgtttattgtaagaaaaattggtttcgtgatatccaaggatgctaacttcagaaatataccatccaacttctcaagtaccctttagtaccatctaaagtttcccacatatagataatgactatttctgtcaagtagagggcccctatgaagcacctgatgccaacaaggagaaaagatttgcatgtcgggactccatagcaacagaacaacttgcacaaagacatgaacaagaatattacagctgggggtaaaactgaaagaaccgctgcattaactgaagcaattactgggggtggcgaattgttgggcgttcgctgcatccttagttgctgtcacctggtgactaggacatgcactgagatgtccaccaatcttgacaggatacggatcacaacaaaggtgacgaaacgtgaaagcgagcaacgtgaggagattggaatggtagatatacgaaagcgtttagaactttcagatggtactaaagtgtactagagatttctagtggaatgtttctaaacatgggatcttcggatgtcacttaaccaattgtaccttttttgttcgaaatgctcaaattctaccgtgaagttctgctggaagcttgtacaatgaaatttatgatgattggttcataataggtacaattatttaaatatctgctccagcttctgtagcggcgctgctacaatagctggagcagatatgttcattagattcggcagaatacccctcacacgttgtaggcttggagcacatccaaacaattcatttgtggttaggactggaa

SEQ ID NO: 90768 - DNA, 1775 bp, Oryza sativa
gcgatcagaacagatcggactcgcggcctccttatctatcaggagaaaggcagtcgtgggaacgtgggaacgtgtacgcgctgttgcggaggcagtcgtgggaacgtgggttagtggctgcaaaagagtagcgacgtgacgcacgcacgcacgcacgcccgccagccacacctcgccccggccaggcccgcgcgcgcgtgtggctttccgacccccacctcaaccagtcaacagggagcctccaataactccctatttaggttgagatattcctcgcttaaatcctgatgtggtattattatacttaacacttattatgggcctttgagatttaataggataagttgggcctagcccaattattctaacaatccccaccaaatttcaaggctcataagaaatgttctcaatgttgtgcctgtttgatataccagggttttggtggagactgttaagttgaacttccacctaggaaatgagctacatcagaccacaactgaacaatggactgtgccttgaattgtcagttttgtgtgatcaggtttcactcagaaccttgactggtactgggctgccgttcgcatcccctctgtttggagcatataagtcaaactccaggcctttcatgagtatctagagatcgcccaaacctcatagactgtgactagcagtcgaactcatataggtgtgttccttctgaaatgttctacaggtcaacatctctgcttggaaaagtcactcggatcacattaaggcatgagccatcctaccatgcaggaaagaagagaagtatatcatgaaaatgagcccttttcaagggtctcttctctcagtcacacaatagtttgtttcgccatccaaattcacgagatctccgatcacaatggacaggtttccactattgtgcaaccttaggtaggtatcatgcccatttccctcgatgcactatctatcacattacgtggtagccccttggtaaactgatctgccagatttctagccgtttggacatagtccaatgctatcactccggagtttttctactttctgacagatttcagtcttctcttgatatgcctagataacttcatgttgtcctttgaactgttcaatttaataatcactgtttgattatcacagttcattaggatagctggcactggtttttcaaccaccgacaaatccatcaggagttcacgaagccactcggcctcaactgtcgcagtatctagtgctgtaagttctacttccattgttgacctcgttaagatggtctgcttgcaagacttccaggaaacagcgccacctccaagtgtgaacacatatccacttgtgacttttatctcatcagcatcagatatccagtttgagtcactatacccttctagtacttttggatacccggtatagtgaattccatagctcatagtgccctttagatagcgcattactctttccagagcctgccaatgatcatctcccggatttgagacaaaccggctcagcttgcttacagcaaatgagatgtcaggcctcgttgcactagccaagtatatcaatgaaccaatgatttgagagtatctcagttgatcccttactattcttcggttttttcttaatagcacgctgggatcataaggagtaggagctggcttgcagtcactatatccaaagcgactcaaaaccttgtccacatagtgggattgcacaagtgtaatcccaccctcatctcctctttgtagtttgatgttaaggataacatcagcctctcccaa

SEQ ID NO: 90769 - DNA, 8202 bp, Oryza sativa
ctgcagcccaaatcaaacgggcgaggaggaaagggatgctgatggtaacaacttgcggatgatcttggtcagatgttgcaggacgccaaggaggattgagaaagtgaaaagggggcccataaattggacaagatgttagaggaccacagaatgtcgttgtacccaggttgcgagtaggggcacaaaaagttggataccactctggagttcttgcaatggaaggcaaaaaatggtgtcagtgacaagacatttggcgatttattgaaactcgtcaagagcattcttccggagggaaacaagttgcccgagacaacgtacgaggctaagaagatagtctgccctctaggactggaagttcagaagattcacgcatgtccgaatgattgtatcctatatcgcggtgaggagtacgaaaacctagaagcatgccctgtttgcaaagcactacgatacaagattagacgagatgatccaggagaagttgacaggcaactaacgaagaagagaattcctgctaaggtgatgtggtatttctctataataccacggctaaggtgtttgttcaggaacaaggggaatgctagaatgatgcgatggcacgctgaagagcgtcaacaggacgggatgctgagacaccccgccgatggttcgtagtggcgaaacatcgatagaaaatttaaagactttggaaaggacgcacgaaacatatggtttggtttaagtacggatggcatgaatccttttggagagatgagcagcggccatagcacttggcccgttacgatgtgtatctacaacctccccccatggctatgcatgaagaggaagtacataatgatgccgattataattcaaggccccaagcaacctggtaacgacatcaatgtgtacctaagaccattggtcgaagatcttaaactgttgtggaagaaggaaggtgtccccatgtgggatgaggacaaacaggaggagtttaacctacgagcgctgctgttcgtaaccatcaacgattggcctgtacttagcaacctatccgggcagtctaacaaggggtacaaggcttgcactcactgtatggatgaaatagaaagtacgtatcttaagcactgtaggaaggttgtgtacacgggtcatcgtcgatttcttgcagcaaatcacccgatacggaagaaaggcaagcactttgaacataaggcggaccaccgtatgaagcctaaacatcgcagcgggaaaacagtgtttgctatggttaaagatcttaaaatagtgtttggaaaggggcctagcagccagcctatagagagcgaagatggtcacgcggcgatgtggaaaaagaactctatatttgggagttaccctattgggaattcttggatgtccgccacgcaatcgacgtgatgcacctcactaagaatctttgcgtaaaccttcttggcttcctaggtgtatatggaaagtcaaaagatacactggaagcacgtaatgatctgaagcatatggaacaacgcggtgaccttcacccggaaccaaaggagaaaggaagccattacttgagtctagccagctacactcttagcaaggcagagaaggaaagtatgtttgaatgcttggagagcatcaaggtaccgtttggatactccacgaatataaagcgaataataagcacgaaggagaagaagttaacaaatctaaagtttcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattagaagccctgcagaatgatgtggtgcaatgtcttgacagctttgagttgatatttccaccttcatttttcaatataatgacgcatctgctttgtcaccgtgtcaaagagatcggtactctcggtcctgtgtacctacacaacatgtttcctttcgagaggtacatgggcattctaaagaagtatgttcgtaactgtgctcgtccagaggcaagcatcaccaaggggtatagaacagaggaggtcattgaattctgcgtaaaatttatcgaagacctttgcctaatcggggtacctgaattacgccatgaagggagactacggggaaaggagactctcggaaggaaagcaataatgacagtagacaacaatttattccgtaaagcccatttcatggtgctgcaacaatcttcattggtggctccctacatcgaggagtacttggctctagttcgcgccagaaacatcggtaagtccgatgcatggattacaaggcatcacattaatactttctccacatggctgcgacaacatctcatgggtaacgagacgattaaccaacaactggccttcctggcgaggggaccatctggctcgatcgcgacattctagggatatgaaatcaatgggtacacattctacacgagggcccaagacatgaagagcacgaatcagaatagtgctgttcgtatcgatgccatgggacacgatggtacaactggcacgtattacggtgccatcgaggacatatgggaacttgactatggacctctcaaggtccctctgttccggtgccaatgggttaggttgactggtggaggcgtaacgattgatgacagtgggatgacaacggttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacaatcagtttgatgggcaaccccctttcacggtgacgattgaccctagcatcctcctatcaaatgaagacaccccttactcacgtagcgatcacaaggaaggaacaatagtgaggagaaagtacgtgcggtcaaccgtcaccgccgatgtattgccataattgttctgtacacgatgtaaactatgttggatgtactgaatatccatacaaatcaattgttgtatggcatatattaaatatgtatgattattagaatttttatcaaattgaaatcatccatatgctagttatatatgattattatattttttttaattatgtatgattattagaattttaatcaaattgaaatcatccatatgctagttatatatgattattatattttttttaattatgtatgattattagaatttttaaaggttttaaatcatgcacgtggcatttacatatgttaatcataattttcaacaatttaatatcatgatatgctagttatatatgattattagattttttattaaaatcatgcatgtggtatttacatatgttaattagaattttcaacaatttaatatcatgatatgctaattatatatgattattagattttgtattaattttaaatcatgcatgtgctatttacatatgttaattagaattttcaacaatttaatatcatgcatatgctaattatatatgattattagaatttttaacaattttaaatcattcatgtgcttattatatattatccacgtattctactacgtacaacaataacttttcgaaggttttatcattaattgttcgactttaaataattgtaatgcattaattactatcttagaaacacatatgcaatgaaattcaagacacagctgctattatctttagtcccagttcctaaccctaacctggtttaaaaagaatttggaaatagcgaaaaaagatctttagtcccggttggtgtcaccaaccgggacttaaagatccgggggtatatatattcccggtggccctcgtcttctccaccaacacttagacgtttttcgatcttggcttctccttcgccgccaccgtgcctagggcaaccccgcgccgacaccgccgtcgtctctcgccgtcgcttggcggtcctcgccgcctccgccgcagacgccgccgccgcatcacttgggtgagagccgccgctgactctctctctctctcgatctcgacctcgatctctctctctctctccacggccgatgaccgacttcgacgcggccgccgccgccgacgacgccgtcgccactaccacgaacgccgcccccgcctcgagctcgccacgccgccgggccgctacgccacgccgccgcgacgccacgccgtcgcccctgccactccgccgccaccgcctcgagctcgccacgccgccgcggccgccgcgtgccgccgccgcgcccccacgccgccgggccccaacaccgccgccgctcccgcacgccgccgggccccgatgccgccgcacccccacgccgccgggccccctcgccgccgccgccgcacccggaggccaccaggccggcccacggcgccctgacgccaccgccgcaccgccacgccactgccgcgcgcgcccaacattgccgaacgtgattgaaacgtgaccgaacgcgaacgaacgtgaacgatacgtggacgacctttgaacgaacgctgaacgaacgtaacgaaacgttaacgaacgtggacgaaacgttaacgaacgcgaacgaacgtgcacgaaacgttaacgaacacgaacgaacataacgaaacgttaacgaacgcgaacgaacgtgcacaaaacgttaacgaatgcgaacgaacgtgaacgaaatgttaacgaacacgaacgagcgtgaacgaaacgcttacgaacgtgaatgaaacgcttacgaatgcgaacgagcgtgaacgaaaagattacgaaacgtgaacgaacgtgcacgaaacgcttacgaacgtgaatgcacttgtactaaaagtgtgagaacgaacgcgtttatactaatacgatttactggtaatatatatatgattatatatgtaacttggcccgtctagactaatacattttcctggtaatgttgcagagaagacgtcgtcgtcgtccctcaagacgaagtggtagctagccatcgaaggaattcgcgcaggcaagtgatgtaaagaagtgattgttagatatttaatatatgattgttagacttagcatatatgattattacaattttaatataagattgttatcgatttaatataagattagtagcgatttaatataagattgttatacttagcatatatgactattacaattttaatataagattattagagattaaatataagatttttagagatttaatataagattgttagacttagcatatatatgtatgattattacaattttaatatgaaattagtagccatttaatataagattattagacttagcatatatgactattacaattttaatataagattattagagattaaatataagattgttagagatttaatataagattgttagacttagcatatatatatgattattacaattttaatatgagattagtagccatttaatataagattattagacttagcatatatatatatatatatatatatatatatatatatatatatatatatgattattacaattttaatataagattagtagcgatttaatatgagattagtagagatttaatataagattagtagcgatttaatataagattgttatacttagcatacatatatgattattacaattttaatatgagattagtagcgatttaatataagattgttagacttagcatatatgattattacaattttaatataagattattagagattaaatataagattgttagagatttaatataacattattagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgcagagggaagcagccagtactggaatgaaggagaggggaacgaggatccaaaccagtacttgaacgaggaggggaacgtggagagggatgcggagggaacgaggaggggaacgatgaggaggagactagtggaagtcatccctccgctagacagaagagggcacgtggacaacaaggtgccgcgaagaagacagagggtcggcacatcataactgaggtggacgaagacggccgacctagtgccccggcagaagcagccaagaattttgtacgccacagcggttgggttgtgagggacaacgtgcctgttagcacggtgtactggcgcagaacaagggcacgcggggataatgacagctttggtcccgcgactcagagtaaatgagcatgttgtggaccacaatggctcgagacgttcacgctacccgcgggtacggagaacatagtgaaacagtggactatgaagaaaatggcagaacagttccagagcttcaagggagatctctacaagaaatacatcctgaagggactaacactgaacttcgacgtattcccaaagctaagggatcattgggacgagttcgctgcttacaagacagggcaacaagggcaagcgatgatggccagaaacaaagacaatgccgccaagaagaagtaccatcaccacttggggtcaggcggatatagcgtcgcaatgccaaagtgggaggagatggaggcaagtttgattgagaggggtatcgaaccggccaccgctaaatggccggatagatcgaagttttggtactatgctcacggtggaacgcttaacccagttgatggctcccttgtcttcagcgatcagatacgcgaggctgccagtcgactaacggacgcagtggtagcctcttctcagggtacattctgacccgacagagagaaggatgagctgtcactcgccctacagactcccgagcatccaggatgaacacgagggaaaggcgtgattccctggaagattggatttaaggaggacatccacacgtacaggagtcggatgaggagcaagagagataccgaggcgaagattgcagatcttgagtacagggtatcgagctacgagctcagcatgcaagaggaggtgtcaaggaaggtggatgaacgtatggccgcacatcggtcccaggatccccagccgtaaattcatcctgcaatggtcagcccatcaggcaatcgtagcagctgcgcctcaacggggcaggtcggatcacagagcatggacgccatgcaaacccatgacgaaaccacctaccccgttgatgagatcatgcagcggacaccatgtgagctgcatatttccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttggactacccaggaggagacggtgagacgtatctacgagacacaagccacgccatcatactatggcgcaagcggtacatcatccttcctgggagacaagcggcgtctcgtgcaccatctcctctggctccgccatctcctcctgcaccatctcctccgattcctccaccacgtcctcctgcaccatctcctccggctcctctggctcctccgcctcctccgcctccaccgtgtctgcctgcacctcccaagacaaggtctcgccaagctccaccacctgctcgcacaagggcaacgaaaaaggcgaaagttgacgccaccaaaaacaaggagccaccgtacgattgcagtcaagagagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccgttggtgaccggcgaaga

SEQ ID NO: 90770 - DNA, 2117 bp, Oryza sativa
gacggccgagatcgatcctatccaaaacggacggcggagatcgatcggtccacgtccggctcacagcagacggccacgatgacgtcagtggtgacgtcatcgccggcggcggcagcggctcggcggcttggcggctcgggcgcgcaagcttgccggcgaacgacggtgcggcggcgcgaacggagagcacccacgggtagcggacggcgcggcgaactcaccggtgaccaaagaaacggcggaggagcagcggacggtgacggcgacgaggttgaagcggcggagaccttcggcttgacgacggcgacggtgctccggcggtcttcagcgacggcgaaggggcggacgaggacggcgacgcgacggcgaccacgaaggcgacctccccgagcgacggcagcaactggagcgacggcggcgcacggctggagcggcggcaacgacggcggcgcgaggtcccacggcgctagggctcttccgacggcgagagacgaaggcgagggtggcgacgggtagaggagacaccggggatccttttaaaggggctaggaggcggtggcgaaggcccacggcgaccggcggcgggatggaaagctcgggctcggagaaagagagagaccgatccgaatcgacctcgaatcaaacactttccaagtgattttagccgatgattccataagagaaaaggtagagaagatcccgaagattgtttcccctcaatcgatttcaccggatcgggaaaggagcggccggatttggaaggaaacggcggcggcgcggcactagggtttcgggcggcagcgacgcgaggaagacgatcggtctgacagatgggccccacctgtcagcgaccgagcacgcgcgcggctgcggactgggccgtcttgagccggggggagagagagagagggttttgggccgactttcggcccaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacaagacatcggacggacgagggcagattcaaggtacaagggttgggttaggcagccttcagtacctttgtttaggacaggaaataacatatacctttatttaggggaaaaagtacgaattatactctcgaactatcgcggtcgaccgaattaccccccaaactcgaaaaccagacatagctcaccctaaactttcaatattgcacgaattacccccctcaacccaatccaaagctaggacaatttagtcgggggtggcgtgcacctggaactaccatcagcttattttttttatggtggggcggagggatcctgcactcttttaccctcttcctcctcttccctctctcttggcgttctcgccttctcagcaaagcagcgcgcggcggcggacgatgggcggcgccgtgggatgcggaggcggcggcggcgtgggatgcggagccggcggctgcgtcgctttctcctcttcccctctctctctgtctctctctctggcatcgttgggcgcgggtggcgggtgcggctgggcgagcgacgatgagctgcgggcgcggctgggcgagcggaggcagctgcgggttccccggacgccgcagcagcttcaggagatcagcgacgacgcaccgcgcattcttggtgatcggcgtagagaatgccctgcacctgacgcccgacgcggcaaagacgaagcatgtcgctgcagaagcaggagcaggcatggttgccatcgatctcgccgaaccattcggagctgtgtcgagcaaagcaagtgatcgataatagatggctaccaaaaggtagaaagcagttaagcagaagattgctcaaatgctgttcacggcttgagcataacacacgggcagtaggtattagtagctagtcgtgtgtccctcggctcggtcttcgttttt

SEQ ID NO: 90771 - DNA, 707 bp, Oryza sativa
gcaggagtattacgacacacaattgctgctgtttccttaacgaatgaggaaaccgtcagtggacgagcaattcgctcgttttgttgaagtaatccagaagatccacatcaatgtcccgttgttggacactatgcaagtgccaacatacgcccattatctcaaagacatactcaacaacaagcgaccactcccaacaacggaggtggtcaagctgacggtgtaatgcagcaacgtgatactccacaagctcccggagaagaagaaaaatccggggtgtcctacgatcacctgctcgatcggggcacaacagttcgaccaggccttgtgcgaccttggagccagtgtcagcgtcatgccaaaagacgtcttcgacaaggtcaacttcacggtgttggcaccaacaccgatgcgccttcaattgactgactcgtcagtccgttacccggcagggatagcggaggatgttccagccaagatacgggatttcttcatccctgttgactttgtggtgctggacatggacacgggaaatgagacgctgctcatcctagggcaaccgttcctttgcaccgcaggagccaacattgacgtgggaacgaggagtatctattccacatcaacgggaaggaagagaagtttgagtttcaaccaaggacggaacaatgctccgtggtcaggataaagtatggccgaacccacagaatatt

SEQ ID NO: 90772 - DNA, 713 bp, Oryza sativa
tcctgcagcccgatcagttggttcgaggcgcaccaatcccgaggcgaagtgacatacaagtttgaactcggtaaaccgcttgtcaaacctaaaaaactgcagtccctaccgacacagatgtacaaattccatgaacggtgcatggaaatgagcgccaaatgtagagagatgttcggagcgaggtcagaaaccccgacatcttgcaaggagaagatgttctctggatccatttcaaggatctcttcgatctataccagttggacgccctcgacgtctctcttttgagcgcatggattttgtgagtatctttgagttcgatttgattcgttaataattagctcctggcatatatgtaagcaataatactttcctttcatcgttgtagaatggagattcaaagggcccgacagaggagggtctacgatactaggttcatcgaccctcggaaaatcaacatcgaaatgatcgacaagtacgagaaagacacagaggacaatcttgtccatctcctaacgcagcagcatttcaagacgtacatactactgccgtacaacacagagtgagtttttattgtcgttcgaacaaatttcgttcccatacatatagcatgtacattttcgatcatatatatctcatctcacgcatattccagattccactgggtcctgttattctttgacttggacgcatgcagagtcactgtgtatgactca

SEQ ID NO: 90773 - DNA, 1746 bp, Oryza sativa
attatgtctaacctttaaatttttccagtactccaaatcccacagacaaactctcctactccaaattttcacatttgcagttttgtcactatccaaggcagaacgcttccttttcctgctctccttttgcttgatcccaggtttgacatgtctaaccttctctaattctgctagtagctctgcttttgtaaatttacctggtggatcattggttccatgaaggccactgtattcattgttcctcctcaaacgatgtccccttggcaggaaacggtagtgtccaatatatgcaattttattccttagtgcataagacagaggatttttgtcacagtgaatacaagcaaaatagccttttgtggtacgcccagacaaagtagccagagctgggtaatcatgaatgcaccataacactgctgcacgaagtttgaactctttgtcaataatggcatcataagtatgcacacccttccaaagctcaatcaattcttcaacaagaggctgtagaaataaatcaaagtctttcccaggtgaacatggacctggaatcaacagagccatcattagattggattgatccatgcatgcccaaggtggaaggttgtatggcacaacaaatacaggccacatgctgtacttcgtgttaaaattgccaaagggattgaatccatcagtagctagcccaagtctgaggtttctagcttctttagcaaaatctggatattccctgtcaaaatcttgccaagcctcaccatcaactggatgactcatttccttctcactaggctgcctctttaacttgtgccattgtgcttgttctgaaccctccttggttacaaatagcctctgtagcctaggcaccaatggaaaatgccgcaatactttctgcggaatcttcttcctctgtgggtctttccatcttgacaaaccacaaactgggcaattatcaagatcagaataatcctttcgaaacaaaatgcagttgttgtagcaaacatggatcgattcatatccaagtcctaattccttatatcattttctttgcttcatcgtatgatgttggtagtgtattaaactctggcaatgcttcagctagtatcttcaagattgcagaaaatgcagtgttggtaatcctataaaatgacttcatatgaagtatctttaccacaaaggagaactttgaaaatttggcacacccaggataaagctgacgcttagcctccttcaccagaagtttaagaaaagaggtttgactgtttccatcattgttcccattttcaggttcagagtcatgactaccatgtcctcttgcagtttgaaggtcactaagcaaactatctaaccgatcaccaacattgttgtcagtctgagccataccaatggaaccctcatcagtgtcaaaaacagaaacagaagcagggacttcattaacatgtacactaatgtcctctccatgatgtacccaccgagtatatgtacagtccataccattcatcaaaatgtgtttcttcacagtgggctgatgcaggtacttctgattaaggcatctagtacatgggcatagaatctcatcatcctcagcatatttttctttaatgaaatccataaattcattgacaccattgacatattgagtagaaaatagtgtgctgtgcacccaacttctatccatctgaacatgcattggggaaacacacaatttaattaataaacgtgcacagtacaagaaaatcagagagaagatgg

SEQ ID NO: 90774 - DNA, 1562 bp, Oryza sativa
acctagcaattcggttcttcagccactcgttgaaagaagacatgtgcttatttctgacccaactctctaatcggcctgggttctcctgtcggagaactgcaatgtgttcgtcaacgtacgacaccacctcagtcatatgctgcagtaccgtgaaatgagctttatcgtacaccttcccatccaacctaacagtctttctttcaacagtaccaacaccatcaagcatccctttgtgatgagatcgtggtaatccaattgaagatgtttctgacatgtagtccacacaaaaattgatgacctcttcgatagtgtaactctcgatgatactcccctcggggtgtgaacggttccgtacataacccttaaggatccccaggtacctttcgcaaggatacatctgcgtcaataatgctggaccgcagcactttgtttgcctcacaaggtgcacaggaagatgttccattatgtcaaagaaagtttgaggaaagtacatctcaagatgacatagggttctcacaagttctgcctgtagttcatctagtccctcgggatcaatgatcttctggccgattgcatggaagaaggaacacaaccgctggatcgtgtgtcacaccttaggaggcaaaatattccttattgcaacgggcaacagctgtgtgataagaacgtggcaatcatggaactttattcctaccaacttaagatcttgcagtgaaacgagcctactgattcttgatagtaaccagatggaacctttataccactcaaacatgttagcaaatcaatcttttcttctttcgagagagtgtagcagactagaggaaggtaaaccctgccggattccgtagttatgggatatagttccgagcgaacaaccatttcttccggatctcgtcgagcgttgacaccatcctttgtagtacctgggttaagcagtaatcccattaaactctcgcatacattcttctcaacatgcatcaaatctatgcagtggcgaacttcaagatccttccagtatggtagtctccaaaatattgacttctttttccacatgctcctctcttttgtcttttgttttttcacatgctcctctgttttttccttcgacatgctcttctcttttgtctttccaactttcctcttttttccaaactcgttggttattcccatcactaagttgtgcacctctgtccctgttagctctgccgggggtccggctgtatctctgtgtccattgaaattctttttcatattcctatacgggtgataccttgggagaaatctcctgtgacccatgtagaccgtcttgtgtgaatgcttcaaccatttgctttttgtttcctccatacactccgaatacgcccatttctctttcacagtttgcccagaaaggttgccaagggctggataatcgttgatggtacaaagcagcatcgcatggaggttgaaatactcttgtgcatatgcgtcccatgttcgtgtgccctcattccatagcctttcgaagtcatcgattatcggttcaaggaacacatcgatatcgttgccaggttgtctcggtc

SEQ ID NO: 90775 - DNA, 719 bp, Oryza sativa
tacttgtcctcctgacgaatagccttatccaccaacttctggaaatcaggataatctccagtcatgagggggtaagaaagctcatcattaagtccttccaagaacttctcctggcgctcttcatcattgcgcacatcttctggagcataacgagccagacgattgaactcgtgcagatactcggtgacagagcgagatccctgggtgagcgacctgaattccttcttcttgagagacaccactcctgatggtatatgcatcttccggaaagcagcggtgaactcaagcaaagtgataggttcagcagtagtcctattaaggcggaagtgatcccactattcagaggcagggccatgcagctggtgtgatgcaaatgagaccttctcctgatcagtgcactggagcaaatccaacttcttctctatggcatgcagccaatcaccagcttcaacaggattagtggtgctagagaaaataggcggcctcacacgaagaaattctgctaacttgttctgcggcggtggagcattgttgttcccttggttgagctggttctgctggttctggagttgctgcatcatcatgttcataagctgtgcctgttgagccaggacttgggcaagtgtgggattctctccattgttgttgttattgttattgttgttgttggggccattcccgttgctgcgagtgagcaccatctggcatggacaggacac

SEQ ID NO: 90776 - DNA, 1890 bp, Oryza sativa
taaactaggtctcacgtgtcattgactcaaagaagtgtggcgatgctcccttagatttgataaggtgtgccaataatgtgatcgcctcaacttaggcaagtggtaatatttgttagcaaattagtcccgttcttttcttcaacaagagttggatgaaaattaagatttttgtggcacacttttcaaactgctaaacggtgcgtttcgtgcgaaaactttctatatgaaagttattctaaaatatcgtattaatctagttttcaagtttgtaataattaaaactcaatcaatcatacgttaataccacctcgttttgcgtaaaaaacttaatcttcatcttcatattcatctttaggagaaatgaacaccatctaagtgtcattcactttcctacttttggcagcatatacctatgttggtgttggtgtagaggccaggttttacctattattttaaaaaataaatccactttcctactaggaaaccacatcattgaaaatcaccactatgacaaccaaaacatggtgattgaaagtttaaggtaaaaagatatactttgaatacagttcaatggtcaaaaatgaacttatagttgccccaagaacgtaattgacagtttttttttcttttgtgtggggagcaattgatagtaactgaccaaacatattaagaaaattaccatgattgtgggtcatctggatctcgatttgctagaatcatctctttgacctccaaggatgttaatgcatctggtctattttttgcgtgtttcgagaaaatttcctcaaactttgcaggaacaaacctgaaaatcatcatgtttaatatatatatagatccaaacaaagtgtagaaatcttcaaaaagagcatgcaattaattctaaagaccaggcctaaataggcctcgcgcatactgaatatgtgcaaataagatgcaatataattattaaaattaaaacaaattgatacttatggaatttgagtccaaaaataattgagttttgcatggtttcatgacaagaaagaagtgataatttgaaccataaatatattattcaaaggctagaaataattgaggtgatgtggcttaatgagagaagagaaaaataacattaattacacttagtggggatgaactatataagtatataggattacactcgaataaatgtaggatgatgccatgaccattttgatttaaggaaaaaattagtgtgttactattatgacctctgaattaattgcaacacataccgtacgagaaaagagtgtgtgggaggaatttttgccaaggcataacttaattaatcatgtatagtattactaatgtatgtaaagtggaataaaatatgcatctaaaagttgtatttcctattaaacaaaagatagagtatatcaagcaaatgttcaaaactcactaaagttcttttgtatgtactcctaaagcatttaaactaataatatgtaattatcttgctatttagatacatatgcatcacatattattgttaatatgcttgacattaattatatgatatcatgtgatatcttctaacacttatgtaagatatgtatatataggcatgtggttggtgttaccttcctttagcatctagtgcacctgtgtcactcccgtgcattcctttatagatgttctttatgtatatcgacaagtgaggtaatggtgcgtccttctgcacatttgaatacggaaacaatatctggtcaattatttccttgtgtgtacaataaattaaatagcatatctagttagtctattttggaccaaattcataataaacatgtcattatttttatatgatttgtttagaattagggttatgagagggattgagagagtacggggcttgttttaggaccaagacca

SEQ ID NO: 90777 - DNA, 1521 bp, Oryza sativa
cctccacctgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagctgccccggaggttgtcgcctgagcgtcacccgagggagtgggcccgagcgacgcgccggcggtcttgttgtgaaccgcctcggaagacgccatcgcctcagcctgcgagcccgggcggtttcctcccgagtggcttcttcagcctgacgagcccgggcggcctcctcccgagcggcttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctctgttcctctgcggccgccggatcttcggcctcggattggccggacttgggatggcgggagggacgcgacgggacatcgctgaagcagaagaaaaaaccagaaggcaaacaaaataggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgtgccgccccgccccctcggggaggagatgggggaggtgttcctcccagtttcctcttcccccgggcgtcggtagggcggttgctccccgagcccccgacgcggggcccagaagcacgaccccctccgggggtaggttgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaaatcctcgggggcccaatcccatctgaccccctggcgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgacatagccatcccccagatgtcgcgcccagaaattcacgaaccagaatttctaagctgaatgtgtattaaacccctgtccaggaccagccagggtacacaaacgacaattgttgacata

SEQ ID NO: 90778 - DNA, 759 bp, Oryza sativa
ttcatcagtgaagttgccaccataggcatgattcaccatgttaatgtcgtgcgtcttgtggggttttgctccgaggaaatgagaagggccctagtttatgaacacatgcctagaggatctctagacaagtatatttacttgtctgagagaagtttctcatgggacaagatcaatgagattgctctaggcattgctagggggatcaactacttgcaccaagggtgtgatatgtagattctacactttgatatcaagccacacaacatccttcttgatgataactttgttccgaaagttgctgatttcggcctcgctaaactgtacccgagggacaagagttttgtgccggacagggctttacggggaacagtgggttatatggctcctgagatggtatcccggagttttggtgtcatatccagcaaatcagatgtttatagctttggaatgctactacttgagatggctggaggaagaagaaacgtgacccaaatgcagattcaagtaaaagtaaggcgtactacccatcatgggtttatgaccagctaatagcagatcaacaatttgatgagatatcaaatgttgctaacatgcatgagctggagaggaagctatgccttgttgggctgtggtgcattcagatgaaatcacacgatcgaccgacgatgagtgaggcaatagagatgctcgaagggggtgtggatgcgctgcaagtgcccccgagaccatttttctgcgatggggatggcattggcaatg

SEQ ID NO: 90779 - DNA, 617 bp, Oryza sativa
atgccttcagacttgcaatatgatttaaatatcttagaacagaactccatcccattgtcagtacgaaggattttcacctttctttcagtttgtctttcaaccatagttttccactctttaaacacatcaaaagcttgatatttgtgcttcaagaaataaggccaaacttttcgcgaataatcatcaacgatagtcattatgtaacgagcacctccaaaggatgtcttacgagcaggcccccataaatcagaatgcacataatcaagaataccttcagtggtatgtgtagatgtgttgaacttcaccctcttatgcttgccaaagatgcaatgctcacaaaatttgagcttcccgatgctttgtccatatagcaatcctcgcttgctcaattctgccaaaccaatttcactcatatgcccaagacgcatatgccaaagattagtagcatcggaattagataatgaatcagaaactgcagcaacattacctaatatagttgtacctcgcagatggtacaggttggcagatttaatatcagctttcatcacaacaagagagcctttagttaccttcaaaattccgtctccaccggaatatttgtaccctttgcgatcaag

SEQ ID NO: 90780 - DNA, 1941 bp, Oryza sativa
ggataagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacctttcggtggggccgatcctctttgctaggggccgtatccccggggcgttcttcattcaagtggcctttcggggcacacttgtcttctgtgccgatgacctcggggtcggaggatgaaaggggcggccttccctcagtggcctcggggccgtcctgggggtcgggggctcctggcatcgtcggacaagcaggcaaagggccaactccggtcgtcaggggcctctggcctccgttcgactcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcagagggccgactccggtcgtcaggggccgtaggccaccgtccgactcgggggcctctcctccccgctcgctcccgggccaagttagcacagaatgggggtgcacgaaatgaggattgtcttcatcgcgctccacaaccaacgctgcactaactacttggggggtcgccgctaagtaaagtagcaggggctcatttggctccggggcgactagaaccgggggagagctaagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatgagcctcaacattacgtcctatttggctacccaaagaaattcgagtagtacgttgaaaagtaggacctgcattctttaacccgaagggcattgatgtataacaataggttcctacgggggtaatgaacgcagttttctcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagtgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctcgggctgcaggaat

SEQ ID NO: 90781 - DNA, 1879 bp, Oryza sativa
aattcctgcagcccatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacggctggagcaccatccccggggccttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcaatggtggccccaggttcttggaaacctaggtcatcatcaccatcatcgacgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacaatccgcgagatcgtggagggaggtgttgtggacggagcaccacttgctggctgggcgctccctgctgggagtaccagcctctttctttttgtcgctcgcaggcctcccctttcgggtggcccgcggaacgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagtgattcatcatcccctcgctgtactgcgtgcaagtccgcttcttcacctgggcgtggataagtgccttgaaagttcatggtgaactgctggcacaaatcctcccaggagtggaccgacgcgggcggcaggttcattagccaaccccgcgcctgtcccttcagggccatgggaaagaaattcgccatgactctgtcgtcacccccagcggcctcaatcccggtcgtatagacctggagaaactcggtggggttgacactcccgtcatacttctcggtgatggtgggccggaaccttgggggccaacggacattccgaagactcgccacaaaggctctacagccgacaccaccagccgggggcatggagggctggtcctcacgtccctgtcgaggtgacactctggacgaagaggcgccctccgttgcgcggggagtacgccggctattacgccgacgctcgatgtcgaggcgggcatccggctctccatgccgatcctcccgagtcggaggtgccgacgagggagtggcagccgaatggcgtgcaacagccgccgctcgccgcgccctccgtctcgacgacgcggaaccggtagtggcggcgccggaggtcttggtggtggcggaccgtccaccagcacccaggcgctgctgtgccgtcatgaccaagttggccacgtcggggctgcaggaatt

SEQ ID NO: 90782 - DNA, 555 bp, Oryza sativa
cagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcaatgtcgaggcgggcatccggctcttcatgctgatcct

SEQ ID NO: 90783 - DNA, 615 bp, Oryza sativa
aacagactcgttgaggcaatctttgatgagaccataccaagtagtccaaggtcctccatatgtaggaaatttgacggcaaatccacccctcatggattttacaacatcttcatattcggacagattaatgctgttaccgttactgccaccgccgataggagtcatggccaagtatccacaagaaggttcgatgtcttggatagatggtgctccaaacgatgggagcatataataaacgtaggacgaagtcgtggtcaggcaattcatgggctggtatttgctactactgttcgtaattagttcctgcgaacaattgacaaagccgacccaagtaatcatatcatcaaggcccaagtcccagctgtcgtgtgatcctgggatacccagaccaacgtaaggcagctggtccgagcgaggaagagggcagctgctgtttgcatcatcctgcaggttggcgtcgacgacccaaaagatggaagcagtgtagtcgatgctactcacatagtatttccctgtgttgatccgaatggtggccttgccatcatcgctgctgcagtctaactcgtacgacgagacgccgcacctgcgaaggtcgcctcgccggcgaaaaggatg

SEQ ID NO: 90784 - DNA, 645 bp, Oryza sativa
ttctatagccacggccttctcttcatctgccttcctcgccattacactccatggacttgccaaaacttctcttcacagtactcatactctctcttctcaactacgaatcctcttccgccacagcatgggatgatgaagatttcttcaagacttgctcatcacacaggtgcagcaagcatggaccagagatcaggttccctttccggctctcgacacaacctccatcatgcggcgcacccggcatgcacttgtcatgctctggacaggacaccatcctcaatcacccagttcttggtccctgcaaagtaaccgagataagttacagttatgctaccatgaacgtcatcccacctgtagattcctcacctcactgcccacttcagaagctcatgtcgaaaaaccaatcaacttctgtgtacaaacctcaaggtcctcaatcgcagggagctacccttgtagtttgttcaagagatcccatacctgcaaatcaatacgacatagttggcccaatatcttgcctcggccataataaccagttctggtatttggcagatccctatacatacatgtctgttcttcccttggactgcacagttatttctaaaggcatcccaatgccctatagttatgataaaaaagggagaa

SEQ ID NO: 90785 - DNA, 676 bp, Oryza sativa
tttacatatttcacaaaagtttttgaataagacgaacggtcaaacatgtgctaaaaagtcaacggtattaaatatttagaaacggagggagtaacaatgaggattatttgttcttaagtatacatggttctttaccagcaatccacttcaaagtccacatggccagtggtattacacccacgatcagttggacaactggatgaggaagcaggcaaccccagaaatgatagtcaaatatcacagtgtagaaaatcctgaaagacgttggtcgttcctcttggacgatatttctgcagagacaatataatgtaaagcgtaaaaaaaacaatataatgtaaaatgaacttaagatgcccccgagcagtttctgagcagataagcaagagaaatccatgcatatataaaaaatcgactaaaagagaaatatgaaaccacatgcaggatgtcgcaaactcactggaatgactgtgctatgcactgtttgattttggaggagtagacataaaaacgacttgtgtatggaaaccgaatggcaaatccacctctcattagtttgacaacatctgcgtagcttgcattctctagcaccagtgggcggtcgccggcacccagaggagtcatggccaggtacccacaggaaggctcgagactcccaatagaatcagagttcatgcca

SEQ ID NO: 90786 - DNA, 3363 bp, Oryza sativa
cgactccattccacaggcaatccttgacggcagcgacgaaaccaacctcttcgagacatcttcaactgagaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttcattaagctaaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgtataaccccctctaaccgatcgcaccacaccttagggttcgcccccgtccccagcaggcaacgggcagcccccctttcgtgccgcggtgaatccggcagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaatcgccatgggcacgtctagcaaaaccatgcacccacagcccaccatgtagtgtattttaattagccaacaccattgcggtggcactaatccaaagctattgccaataatcaagtctatgctttaatgtggtccccctttgtgcactagttgaactaagcatgactaagcatctcctaaaccaacatctagtcattttaataccccagctatcaatggcatacggaaaacaacatatagctgagtaataggacccatcccacatgatattgtaaaacaatgcaatatttaatagaaatgcgggacatttgtaaattaggtacaatatgatcaattgcaatgtatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaaacggagctcggatgaattagttatgatttttagaagattatctgtgtttttactaataaagaaaaactcttaatcaatttattgcgcaatattgccccagggctgacgtcagcaaggggtggggcggcgccgacatgcgggacccacgggtcagtgactcaaggagggagaggggcggctggcaagcgggccccaccgagcggcggctcaagagagtgagggagaggcgccggcacgcgggccctactggcagtgacacaaggggggggggaaaaggcggcctggctcggctcggcttcaaagccggcaggccaagcatggcgagcgacggcggcacgcgcggtcgccggcgacggcaaccggcggcacggacggcgacggcagacggcgcgaaaagcggcggcggcggccgaagacaacgatgcgcgcgcggaggacggcgacgcacacggaagagagggaaagggggaggagggggagtttttcaccgaggttggccggcgcgagtggagacgacggcgaacgacgacgacgagcgacgggaggacgacggcgacgggcgaacgatctccgggaggacctagagaaaaggttgggaggggttagagagagggagatggaccacggcgatcggaaaccatggccgacggcggcggtggaggtggtgctcacccgtgcgcaagaggatgagggctccggcgacgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgaaatggggaaaaggagagagggggtgccggcgatgcttaaataaggggagagggggccggacgtggccgggagcggcgggaatcgccggccgacgtggggagtgggggaggagagagaggcgggatccgattttcgaatcccggccatctcgggcgcgggcgcgagcgggagagagagggaagtgggcgcgggggacgcggcgcacgcgcgggcgtggtcgacgagggccggggaaggcggagacgtgggcgcggcgacggttgcgggcgcggcggcgcgccgggatcggcgggaggagggagacgggcccgacaggtgggccccacctgtcggcgaccccgagagaggaggcggcgggcggcctgggccgccggactgggcctcggcctgtcgccggcccagcagagaggagggggaggaaaagggaaatgggccgacggcccatttgacaaaaaggaggaaaaagagaggaaaaagaaaaagaaaaagaaaaaggattttcccagggatttaatattgcactttgctcattttaattggttaaaattatttccaaggctctgaaaattccactaaaaatcctgttagcgtattttgacatgtagaacccaagaaaaattccacatgccgattccgattattatttgcgtttattaatttagggtttctctctaggttaaattaaacaatttcttcgaacgatttattttatgaatttagagcaagggaggggaacttcagggcgtgacaccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcatagaactccagaacatccataaagaaagaagaaaaaggaggaaccaacccggccattgcgaaggggagga

SEQ ID NO: 90787 - DNA, 1521 bp, Oryza sativa
gcacccacctgagatataagcccagatacccaaattattattttttccattataaatagagtcaatttgaacactggcatgttcttgatccatacatgactgaaacacaaacacaagaatacgacaacacctaaaataccacatgaaaatgcagggtcagcttggtagggctctttccgactgtttcccattttttttaaaaaagaaggaattctgcagtgatcatgtggcacggacacatggtactggtctatgtcttgtctgtgatttacaagggacttcaagaagatccttactccctagtgttaaacttagtaagtgctcagcaaaaagctaggtattgacagtagcttatgatttgtgcagttgacttgtgtgaagatcaggtgcttcaattagtccatttggtaaagatgtataaaaatatagaggaaggcgtgcaaatctgcagtcagggacttctaaatgccaaaggaaagagttagggtgcaggatatggaaataacatgcattattattggttcagttctgtatatatgtgctttgaatgaagtttcaaggttgaaatcaagaaaatagaggacaggaacaggaattcgtaagtgtcttaagtcacctattgacaatatatcagattgctccataaattgaatatgcaccagaaagtagaactaacaacatcaggatatacaatcttgtacaagatgtagagctagcagggacttttctggcactcacacgaggctcgatacgcattagccttcgctccaacctttgtattctagaaagcagggcagcttcgacaacctgaatataagagaaggcaataaataaccagatcatcttggcccagtatttggcaggaggatggtactctcaataatcgggtgaaaatgcaagcatagcatgacatgttggcaaatgcatgatggcgataaaaatgttttttgtcagcaatatatgttaaatgatttaatataataactaatgagaccaaaaaagatattgtacaatcaaaaagaacttttaaaatcaaagatgataatcctattcttgttcaagattccattcgaccgttaagagaaactaggaaaactcatggatgacaatcttattcctatgtgagttgaaaacaaagtaaaccttccatggaggcaaatataaatgaaacaattgacaaggaaaatatcatcatattaagactgttccagaccacaaatatggattaatataagaatatccatatgcctgatacctcaagttgaaatggcattgctggtccaccattgatatttcttggatttaaccgtggcagtaatgaatctaagaaggcctttcctcctgggctactcaagtcagataaaataattgataagtttcataacaatagtgatgttcaccaagtaaaatacaatttatattaaaatgactagtgtacaaactgacctgttgtaattgaatataagaacgcgttcatgcatagcaattgctcgcaaggaaccaagatttactaatatggct

SEQ ID NO: 90788 - DNA, 551 bp, Oryza sativa
agcagcagcagaacatgcagtttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaagagaaggttgcttttgctacacaccagctgcaaggtcccgcttctatttggtgggacaactacatggtgacccgtccaactggggcagaagttacttggacagagttttgtcatagtttcaataaagcacaggttcccgagggaattgtggcacaaaagaagagagagttccgtatactatgtgaatctggccatggcacggactgtgtgacatcttcttgaagcttctgtatcgctgatagcaaaccggcgtgtcggtcatgtagaacacacacatttggtctattttcaacaacacacattttaatgtgccgcaaaaaccatagccagcttgatgtgttctcgcttccaacaaatgcaaaagcaacaggaagcccatggcta

SEQ ID NO: 90789 - DNA, 546 bp, Oryza sativa
tatgtacaatttttcggctgtagtaaaaatcattaggtgtttccatttgggttaattttttgagattggatgaacacattccagttggagtcttacaacaaatctaaaaacattcttagatcatacgtgaaatcaatactaatactagcaggtgacaaaatcttgcagaaatacaacatgtttgttgcccagattggttgtgcggcatttggtgtgttagccctttccttatttgggcctggatggttggcaagaggtgctgctctttctgcatccatagcattcatgacaattacaggcgcctcacaccctccaggtatataatctttctttcaacagggatgtggtgctttagatgtgctcagcaggatttaaaaaaatatttctgattgacatctgtttttgtactctacttaaatgcatcatagcaaagctcaccatttccatgatgattgcagctgcaagcttgcctctcttgtttattgatggtccaaagtttcaccacttgcaactctggtatgccctttttcctggagctgcaggctg

SEQ ID NO: 90790 - DNA, 557 bp, Oryza sativa
tcctttcaatgaaaaagctcttagtgcagctcgtggagcctcattgcagcttccagttgtttttggtaactggtctgatctgcatgctttgatggctaaatttgatatgaagatgctggcaggtcatccagaaagcagcagtaatggatctgaaagaacacatgttctatctaaagaactagcggattcactgatgagtgaatcagtgtgcttagtgttaggaagtgagggcaatggcctttcggcagatacccttcaagcctgtgagcttgtaaacattcctatgcaaggtacatttgaatctcttaatgtttcagttgcaggtggtatcttcttatttatgttacaaactaaacagcaaaaaatggcagaacgttaactgtttaagtcatccttgattttttaataattttattgttcttgtccaatctgttacatttggttcttctttctgacatcattgctgatagcttgatatcaatccaaagtgaaggaacaaactgttaagaggaatgcaagatcttggttgacaaacaaaacaaaatgagaacatttta

SEQ ID NO: 90791 - DNA, 548 bp, Oryza sativa
tgtgttatagcacgtggaagcagatggaagactatccacgtcctggcctccaattgtagcccaaagtgtaacatcacatggaacctagacaaaaacgatagaacataaaaaattgaacaatgagcagtacaaaacaatcaatgtacacacaggactataaaaaccaaaccttatgaattgtgaaagaaggctgcaaatacttgaatccaagtaatggagctcgggaacagcttgtcacaaacttcagtagcatgcaacgttctgttggcttaaatcctttgataacctgcacattccaaaaaccatatttttattatgatcattccacttcagccttcaccaaaatttcttttgtttattgtcaatcagtaaaaatagcttcatctttgataataagctaatacgagtagcttccatcctttgtcttggaggcaccttttcaagggagatctcttcttcttagattaaatgaaagattggatcttgtcgttgtaattttttgtaccttctgattttatcaataaaaatttaactgtaggggccctccc

SEQ ID NO: 90792 - DNA, 652 bp, Oryza sativa
ttatgaagcctcatatgacaatttgccacgtctgctatctgttatccaacaaagaaaccctgggacgtcttgtgcactcaagacattcccctcaattgaacatcctggcaagactgtgctgcaaagagcgttcttagctctacatgcatgcaagatggcattcgtgcactgtcgtccagttctttgtattgatggcacatttttgaccgggaagtatcggggccagatactaacggcaattggggtagatgggaacaatcaggtattgccgttggcatttgcttttgtcgagagcgagaacaccgacagctggtactggttcctccatctggttaagacagaagttgttggtatgaggcccaatgtgtgtctaatacatgacaggcacgccggtatgcttcgagcgatagaagagttaaagtttgggactatggaaagaggataccctggccagtgggaagatgtacaaagcaggtggtgcatgcgtcatatgggagctaatttcttcaagcaatttaagaacaaggagttgatgaacatgttcaaaaggctatgcaatcagaaccaggagaaaaaattcaatgagctttggaagagattagatgagttgacaggcaaatgtagtgaccagcgtgcaacaagaccagcggcc

SEQ ID NO: 90793 - DNA, 732 bp, Oryza sativa
tccaaaaattttaccaatttctagaaactttttattattgttctctaactttgtcacatgtttattatccaactgctaatataattttgcacaaccttcttgaaattgttactttatttaaagaatacgaaaatgatgacgttctaactgaacctgtctttcacatgaaacaaaaatatttgaaatattggaaaaatatacctatgttgtatgctcttgcttttgttttagatcctaggtgtaaattaaggggattgtctgctattttatcacttgttggagatactataggtgtagattatagttctttttatactgaggttagacgtaaattatatgaggtttttggaagatatgaagtaaagtttcaggaagttcgccagcggagaccccctcctatccccactacaggtaagaagaagatacagtggggtaggatttggggtggatcgtcttcaagttcaatccaaggtggtggcagttcctctgctacaagtggagacgcctcttagcatgttgtggccgcaaagttgtccggttatttggacagcgactgccatccaccacgaagcacaagatttcaacgtcctcgggtggtggaatgaccacaagataacatatcctgtgctttcaaaactagcacgggatgtgttgacggtgcccgtgtcgacggtgtcctcagaatcggccttcagtctatgcggccgaatcatcgaagaccggaggacgact

SEQ ID NO: 90794 - DNA, 506 bp, Oryza sativa
cctcctcgagaaggagtgtccacacaccgtctcttgcgccgacatcctctctctcgtggctcgtgatagcgcctaccttgctggtgggctcgacttcgagatcccaacaggtcgtcgtgatggcttcgtctctaaggaggatgaggtcctctccaacgtccctcacccggagttcggtgccaaagacctcctcaaaaacttcaccgctaaaggtacatattatatacttgcactacatagatacgcatatcatcggtaacaatttcatggggtcatcatatgcacttgccagtttatctaaagtcttgttaatgctctccctcataccgatgtcccataaatcatcatagagcgagttatgaatgcaagatagtgagagttgtttagctctgatatacggaaagtgtttttatccctcgagaggatatcccaacgtttatgattgccacttaaatagttataaaagtatgaaaaaaattaacaagatagattaatataatatatat

SEQ ID NO: 90795 - DNA, 1118 bp, Oryza sativa
tgcagcccaccattttttacaattagagcaccaaggccagttggatagccaaatatctgcaggtttgccaaagatatcgatatcaattggtgacttctgtaggaccaagcatttcaaaacacaacaggtgcatgtggattaccttgtagaaggaacatacaacaaaatcagcaggatacacagttaaattcggtggttcagtggcacatccttttgcagcatctatcagaaccatccatttacccctatattaatgcatttaataagcatgctaaagacactagagtccaaggaaaacaaggcaatgatcctgcaagacaaattcaatgcatcttactgctgctgcaatgggatttttccttccttgatgagcttaaccaagctcagactgaacttttgtcctgaaaaattgcattctgacgggaatgcaaatatattccaattgttccctacagaagaaatgaatggggagtgagcataaatattaagcatcgcactggaattaatcttccaaatgagagcaaaccaaaagttttgctatcaatatttctagttatccatgttcattccacattgcatggtcatacaatatgaccatgtcaaaccaataaaccaaataaacaaacttcttaaggaaaaatccaggaatgataaatgtgttcccagttaactccctcataaagaataaaagaaagctagagaaaactgaaaacatcattaacagattggaaataagacaatcaaattctctgtgtaaattctacaatattgatcaataattgaacctgatcaagaatatgttattcagcaattgtaaaggacaaaaataaaaatcataagggactgacctgaaatatctgaaagacttccgttctgacaattgtgtgaaagcacatctttgcttcttctttggtttgtgcgtcttgaaatcttatacaaactataacttccattgtcttttgccagatcagcaccctcctcaacatcaacggccaacacagtagctcctttactcagagcatatctagaaatttgctaagggaagacaaaatttacaagatactatgtgccaatgtgaatttcatgatcctacacatagactgacaggaataaatgga

SEQ ID NO: 90796 - DNA, 583 bp, Oryza sativa
agtgagacagccgatgtctcgtcctggtgaaaagaatagaagatctcgtttggagcagcgtcgagttgtaagcccttgttgagcttaatggtcggcaggtctgtaaagccaacttacacgcaacttgggataaccttcttcctgtttctcaatccagcgtatcaatccaatgaaagggggtacatcgacagcccgaaaaagagcgcaatcacccactctgaactcacgtccgtcctgaaaaatcaataaatgatttattacctcttgtaaagaaaatagccttcgcacggcacacgatagtttagtacttcacaagcatggagcaaagcaggtctctatgactgagggatcagttgttatgttatgcaagaagttagtatcttacaagcaaaaagttgcatacaaaaaaaaaaagcaaccatgtgtttcggaaacactatacaattcagttttataacatgattgtgaacccaaggaacgataactatgttaaacatgtaacaagacgttggttccactagaacatgtgtttttaaccatgccaatgaccttggtcgactgcaaggtatagagcatgcttatt

SEQ ID NO: 90797 - DNA, 4007 bp, Oryza sativa
agcggttgccgctgttgcgtgattaaagggggcgtccagagctcgtcacatcactctcctgttgccttcgtggcttcgtgtcagctagcgagtgtgccccgcctgcccggggaccgcgacagcgaccgtccgtgtcctttggcttggcatttcccttccgtttcgtgcttcgttttctcttccccttcggctcgttcaattgctcataggagtataatctttctttggctttcctgatttcctcgccaggttagagaaatttgtacagtagtcagcagactattttagccaggttacagaaatttgtacggcaatcacgaatcagcagactatttgatcattctatggtcggaatggaagtaaacattccgttgagttgatttttattggtagtattaattagtagaggaatcaggttaattaagcttaccaagaactaaaagacacgccatacataatcgagccagccagcaaggagctagccacagcgagatgtcaggaaatatggacaacagcattctagtcatcaaacatctacacagtaggaagcgtcatggacgaggacgaccaacaactttggaggtaatcaggtagaggaaggcatgcagcaaataatataaccacctgcatattgaactatttcaaaaacaaaatatttttttgacatgaaaaacaaaataatttgcctcgcagaaagcgcctagaaaccatcagcgaacctcaatgactgaaaaatagcaacagatcattgcttatcggtccactaaatttcttaaccattgcaaggcaccgatggatacaccagaatgcgctttacaggcattcaggaactgcagatcgagtgtcatcccccaggatagtccactagagttacatgggcaaacagatgtaacgtttccacataaaatacatgttacatctaaatcatatgtaaggctgcagatgtgctccaaaaagagaaaattggtctgtcataagaaactaaaaacaaacaaactgaacctaattacagcggcttcagatgtttcttgaggcccaggacctataccgtttccatctccagtcataccctcccaagcaaattagaagcatgcctgagtccctgacagctaagaaaatctagcaaagcaactgccaatgccaaggaaaattgtttccaggaaagtatgaaatatgaacatttacagcaattacatcaaagcatcgttcctctcacattcacatcatcacaaggaaagtatccatgtatgaattgtatattccagcaagggtgcagtacacgaacccaagtaccacatgcagctgcctctgcaaatgaaaacacagcaccttaatatcaaaagaaaaagagctgcaggtgataaacaaagcaggtcgtttaaggcgagaagcaagcacatacaagctcattggatgccgaagtcgctgagaaatgataccagcaaaagctcattgccatgacaattgtttgtatgaagatcgttcggcatcccaactgccctctggttccttcctctttattccaacacctggaggcatttgatacattctcgtatgctcgtccacaaaggcatgtggtggcgcaataaaattttgtctaactggtaaagttactctatcgtccttcacttctacatccacacttccagggccagaattaagatcaagaccctgtcttccccatttccgattattgtcatgtccaacagtgctgcttccttcagggaggtttattgcatattgtcgagtatgctgagcaggtaatgcacctgctgggccaacaagcgtcggagcaattgtagggaaataaggaattcctccaggtgcagaattcgcatatgatgtagacccaattgaaaaccccggtgcttgaaggtggacactaggagtaaaagggaatcctgcatactgataagcaggagggtgaaacatcatagtcggtgaagttgaaataactggagtccggctgggatcacttccatgttggacaccatctgccatcgatgtgatgatcctctgggttccacttccagctgctgtctcgactgggtgaggctgttctcctctagaaggtaaaaacgactttatagctacaggagcacaagcattggcagaagcaaaccatggtgatatgttactcatttcagcactgttcattctcatgctagcgacttgaggtaggaatggtatgctactggtatttttagatgacagactccttggtgcatgttccgtaccagcttcatcaagagttggtccattattaagatcaaaatcccttgagctatttgcatcggaactagagaaactccaggtaatggtcttgataataatgggacttcaaccctgtggttagtgttagacacaatttgcccattctctgcaacttcatcggccctattcaagtcaagctcaaataccaacactacgtacaggaccattgcttcttctagtgttgccagattcagaaccagttgtctgaacagaactctgagagacgtcttcctcaagaaattgctcatctgcaacatttaagtcaatgtcaagtgctgggcggtgtttatctgcagcatcagaaactggaatgccaggtgcgctgagagtcatctcaaaaattttccttggttctgcaggacgaaatgcacttgtggctgctgaacctttccagccagtctcaggctgaaatcttagtaggttctcaggaggaacaaagggacctttagctgtagcagctacttttatcggagcaggtagcccacttgacataggtgatataaatggagaaagacaaggtaaattaattgcaaagaacacacagcaggagaggtttctgcctcagactgatgcacgtcgtctccaggtattccttcattcaagtcaaaatcaagcttggctgtagcacttggcctgatcttggcagcaaaagaagaaccatcatctgatgagacaaggtcctcgttcccacttgcatcatcactcgacttctttgagctgcgccttgcactacgttcagtatcctgtgagacagtagttccaggtcttgcatgactacttgattcactggaattgtcttttaattctttagaactaatcccattttctggaccaaatggtacacctgctggtacagctagttttgtagcatcagctgaagtggaagaaggttgttccttcttttcatcctctctcagcactgcgttaccaaccagcaaaccatcagccttattcacctccacggtcgaagatgaaaatgaaggctccacatccaatttaacagcagcactgtcaccagatcggtcatggcttctgaattatctggtagacactggcgattcttctgatctgttgactttaacaaaccatgagattgtttatctccaccacgtaattcacttgtagtagatggatatatattcaattttgcgtcaatcttgatatcaactggctgttttgtgaccgacttgtcaccatcaccacctttatctgtagtcctcacttcatgattttcagtcttagcaggagattcaacagccttaacatctattccaggtggagagggtagcccagaagatgtgaccttattgtcctttgcatcccctaggtgttgttcctcctttgcgaccaaacctgcaccaattttctcacccttatcagagatgattttctcagcatcatttgttggccctgcatgccgtgacaagcccatatcactttgtacttttagcttcccaatgttatctccttcacagccctcttcatttcctggtgaatttctaggtgaagcagatgaagaaatcaactcagatttagatatttctccagcaacactggcaagaagattcattgctgtatcatctccagcttgcaaggaatgactagcttcagagtacttgatttcaatcaaagcattcatagggttgaacgaatttctccccccattttcacttgagcaagccgcctttcattagcatctgagcaaacaactcgggaagcacatgcatctttgc

SEQ ID NO: 90798 - DNA, 694 bp, Oryza sativa
tcaagcatcagcagcagtacacaggagagcgaggaggaggtatctataacaataggtagcctcctcgcccaagcaaagaacaacagtgggcatagtcttggaaggcgcctctctcaattgggttcaatcccggtaatatacagtcatccatatttttctttgttccccccttggcatttgttcccttgaactcatcttgagctgtaccatgattaaatataggaattctctctcaattgtacataaatattccaatacagtactcaatataataactaatacgataattattacagtttttaactgcagattgttaaataaaaaaataaagttcttaatttacaatagtgtgccttcggctatgttttatgacaagttactaatgccctcatgtatggcagcacactcctcgagttaatggaaaaatccctaatcttgataatgcaactttggatcatgaaagattgtcggaaaggtaaaaaaaaaacagacctctctctctctctctagaacagtatggccattgcgcttcttatatttctcatttgtcctgatccttcttgacaggttgggaaattatggtttggccgagtttcaaatagagggtgatggaaattgtcaggtttgttttaccattgaacctaaatcatcatttcatttatagatacggtgccgcatcatctacactatttca

SEQ ID NO: 90799 - DNA, 1920 bp, Oryza sativa
aattaacaatcgccgagaagcacggcgcacacgggacgacgcaaatcgctctcggcgtcatgtttcttcatggcgccatgatcgaggaaaccgcccaaacgaggaccgagaatgcaacgatcgcgaacggcgggggccagacaatactagtcatggccgtcgccgcaacgacgacgacgaaggagatcggcgccgagataacaacgagagacaacaacaagattctcgggatccaggtcatcatcctcgtaatcgtacgccggagccaagcgacccatcgtcatcgtcatcatccgcgtcctcttcatcgtcagacagacatccacgaaggtcacgcgaccgccgacaacccaccgccccagcgctgggtgtagggctttcggtcgttccctacgtgatgtccgatggcctgagagattccgacccggggccattgaaaagtatgatgggagcaccgaccccgaagaattccttcaagtctactcgatagtgctttatgctgccggagcagatgacaacgcattggcgaactatttaccaactgcgttgaagggttctgcacgttcatggctgatgcatcttcctccctactcaatctcttcgtgggcagacctgtggcaacagttcatcgccaatttccaaggaacatacaagcgccacgcgatcaacgacgacttacacacgctaacacagaactcgggggaatcattgaggaatacgtttggcgctttaacgagtgcagaaacacaattcccgaaattatcgacgcttctgtaattcgcgccttcaagtccggtggtagagatcgctacactacccaggagttggcgacaagacgcatcacaactactcgaagattattcgagattgttgagcggtgcgcccatgtggatgacgcgctaagacgcaagaacgacaagccgaagactgggggagagaagaaaccagccgcagacgcctctgagtcaaataagaagaaaaatcgcaaaaacgggaaaaggaaagctcaagcggaagtcctcgcagcagaatacgtgaaccctcccaagcgcccagacccacaaggcagcgatacaaagaaatcatgatgccccatacacaaaacggacagacattctctggaggattgccttgttttcaaaaagtcgctcgagaagcacatggcgttcaaaaaaggcaagcgagtacgtgttatcgagaagaacgaggagacatcttctcacgaatcggattctgcgtacccagactccgacctccacgtctcacacatcttcggcggctccacaacgtactcctccaagcgggaatacaagaaagcggaacgtgaagtctgttcgacatggcagggggctgcacccaagatgaagtggtctgagcagaggatagagttctcggatgaagaccaccccaagacctctgttatcccaggacgatatccgattgtggtcgaacccactattcggaacgtcacggtagcgcgagttctcatcgacggtggcagctcgatcaatctcctcttcgccagcactctagatgcaatggcaattccgcaaagtgcgttgacaccaaccgatcaacccttccatggaattactccccaatcatcgtccagacctctgggcaagattacgttgcccatgaccttcggccaagccaacaacttccgaacagagcagatcaccttcgatgtcgctgaattgatacagcttacaacgccatcatcggaagaactgcacttgcgaagttcatggccgcatcccactacgcatatcaagtgtcaagatgccgggaccgaagggaacaatcactatttaggggaacgcaaagctggcagggtgcagtgcgacaggcggagcctcgacatggtcgaacaaacgcccaccccacccgccacgtatgagccaccggagaaagtgagca

SEQ ID NO: 90800 - DNA, 2468 bp, Oryza sativa
acaagtgccaccagttgatttggagggttgctccttcaagttggttacagcatttcctggttgcatatgttgcaattttgaagaaccagatatcactggactcgatttcgcagcagcatcggcggctacaggtttagaagtcaaggccttcgatgaagaaagctgagacactgggcttttcagactagactcacttgagccacttcgtctgtttccagcactagaaatttctggaaacccaggtttgcctggccaggatacagcctgacctgataccactggtttcacatcatttgacttcatttcagcatcaacgcgcttcttccaattttcgacaagacactttgccttcttctgtatctccggatttttatggcttcgcagatgattaacagacttcccaatactgcaactttgtaaagcagtaagattaataggcaatttcgccagtgcacgaagcagggccaggacaagatcttccataggcttatcagtttctttaggactaccagcttcaccagacttccctttatgagcttcttgaagccaatcatcaaacacaggaaggcctcgcagttgcacaaacctaccaaggcagtcaggactttctgtagctgcaataatatcagctagaattacccggccaggcaaatctatctttcgctcagttcgatcaagttgcatgagatgtaccagcttctctacagcttcagcatgtggaagtccacctttttctgttatctttgtaatttcagactttagattctccaccttaaagttgcctgattcgccatcctcagcctttaggggacgctcacggtctcgcttagctggatcagttccttgctcacccctgtccctcttcttccctttggaaagaccgcagttttgggcaccatcagaaccagacttttgctgggcagacgacggtccattgagccgctttggtgagcgcccacctgactgaactgctgcatgcatttctagctttgttctgtgtagaagccgatttacttcttcctgccgctcctggtcatgagttgaacaccttagcacagaaaacgattctaataaaggaaggtaactgtagaacttacatttatataatcctggtcggtaagccaccataaacacttgttgtcaatatcatacacgcgccgacacacaaatgaagaaattccagctggaagctcaacgcctttacgcaaaaaagcaactttgcaaggatgcagcagtgagacagcggatgtctcgtcctggtggaaagaatagaagatctcgtttggtgcggcgcacagctgtgttcccttgttaagcttgatgtcagctggtctatacagccaacttacacgtaacttgggaaagccttcctcctttttctcaatccaacgtatcaacccaatgaaagggggaacttcaacagcctgaaaaagagcgcagtcgccaacacggaattcacgcccgtcctggatattcaataaaaaaattatcatgtgtacaagggacaaaacacaattcatgtatccaccaaaataacattgggcatatgaaaacactgaaaaatgcatgttggcatagaagaaatataagcatacttgtataaagaaagaagaaagaagaaaatggtatcatggtgttgttgaaacatacaatacacactaaaaatcaaattgcaacagaaatagcaatagttgccatgccattgaatttgttcgatctgaaagtaaagatcatgtaaagttgatggttacataattcaatgcgagctgtctacgccaatacttgcacccaggcttaattgtgatattccggttgtttttatcttatttctaactttgaaaagaataattattattattattattatcttgtttttatacaatacattaatgaaacaagtattagaagatgtagagatagatggtaataaaccgtaagttacatcatgggctgcacacggatccaaaaataatgccacatgcaccccttagccatatattctttggatatatcatgcccagtgattatccaagaaatgctactcctaaaaaatagacaaatgaattgttcgaatggcttttgagatgcacacaagcaagaacacgccttcacacaaatcttatgtaggggtgccaaaaattgtcaaattgaactgtccaaaagactcaatcaaataatacatggaaaaccatcttaaactactttgatgatagcacgacccacccaatacatccatcaaatgcatcccatatttactcggtgaaaatttgctgatatgccacaggttaccattcaacgatataagtaactacaaacataagtttatctaggcttaaaaacaaaggcgaatttggtcacagcaacatgctcaatttcatataaatctaattaacctttgtaaacatcaaagcgaatcccatcagaggaggcacctttaagaaggaatctgatgaagctggacggggaga

SEQ ID NO: 90801 - DNA, 1882 bp, Oryza sativa
tttcgcatttttgagatatctatgccctttcatcctgggaactgggaagattttgttttgcattttgttgcataaattaactgtagttgttgaatcggtcttcctgtcaggtaaatctggcagactcttctgctagtaaaggggcaaggatacaagaagttgaagctaagtttactcatctgcaggccacatgtaaccgaattacgcaggtatgctataaacaatttggtgttattttgctgcgtaagattgtagtataaggtgatgcaaagtctttcttgagttgtagactactacctaatctgttatccatggagttttactttaattgtacctattccatatgtttgcacagagcaaccgttggttcttatttagtactttcctgtttaggagaaagatctgcttgaaaagcataatctctggcttgacgaggaacttaaagaaaaagtgaagaacttagctgaactaaggaaatcaaacatggatgaggaggctaggatgtcagcaaaggttgccgaggtgagtcctattccaaccttgacatgtgacataatgcaagcagaaagcaaaacctgattatgttggtttcagcttgaaagagagacttctgaatcatccagttccttgaggcgaagcaaagaacgggtttctgaattggagcaaagggtatcatatatggaaaaggtaaattgtcagatttgttagcttttgtattattgccatcatctaatttttgctttgctttgcttttatgatctaaaggagttgtgctcaacaaaggatgctgcagctgctaatgaacaacgcctggctgcagagctttcaactgtatggtttacctttattcccattaacccccccttgtttatttcacccttactgctcccactccctgcttgtttaaattttagaaaggaaatggaagaaaatgtgtgctgagctatttgtactagaccagcagatcagtccatcgttattgtatatgcacacggcacaccacaacttaacccatctagtgtatctaggatatttctttttttttaatggaatgcactgatgttcctctctataagccaagtcgatgacgcttttaattattgccttttgttctgtttcccttaaaaggtcatgaaacttgctgaacttcacaaagaaagttctgaggaatggtcaaaaaaagcgggggaacttgaaggtgttattaaagcattggaggtaatgcctttacttgtatttaattttgccccgctcatgaacatgaaaatctaattattcttattatttttttcggtgtaaaccagacacatttgaccaggttgaagatgaatacaaggaaaagcttgagaaggagacttcagccaagagggaccttgaaatggtatattgacttattattttggatggttttcttattgaaaaatcagtttgatattgtgagtttcttagttgatcttttggctttcatgctattcaggaagctacctacttaaagcaaaagcttgaaaagtgtgaatctgatctggagaatacaaggaaatctagtgaattgagcttcactccattggttgcatcagacccttgtgatctagcaggctcaccgatgaaagaaatgtattatttctgaaactgtatacttttagtctagcgagatatctaaagcaggcgctattagcatagctaagtaacactttctagagagcattgttcaaggctttttgatattaattgtgttttgctcattaaagcttatcttattgaatgatgttaacttctgtttgtgctgtaccgttgtaaacatgatattatctttgtcccaacaccaatagttcccaaacattttgtagtcattccttattgtgttgataagtactgatcatat

SEQ ID NO: 90802 - DNA, 3390 bp, Oryza sativa
  unsure (1)..(3390): unsure at all n locations
atcaataaagcctatttctaggtttcataccacgaccaaagtgttttcactcgacgatcccttactctgataacacctaacgttgaaacatatccttatgaccctttacgccgtctcgacaaggcctccgaggaacctaagggatcttcggctggggatgcccagaaccgataaggccttgtcagatccttcagagacgaaagaccatgtaagatctggtcgtgtaagagttctcgccgtgcgtattaaccaagccgtgtaatcggaaaccgagctttccaacttcacggctgggggctaggatcagagcttattcaacctaggcagatcaagtgtccaagagccttatcatccaagaaaatttctccgacgacaaggctgggggctagggagagtgtacgactcaaacagccgaggtcgttaactaagaacacactctaacacataacatccagagtaagatgcatttgtttaaggaatatttctttattcacataataattcttacttgttttttacatagatctcccactacattacactttttcctaagacatctatagcaggccacgagtattaccaagagggccaatgccagtccatagactggaataccttctcggctaacggcgtcatcgacctcgcaaggtggtctatctccgccggagtcctccgagaacgagcaaacccttcatggaggaattcgagatccaggcgcgggcggtgatctcgcaggcaagctagcacatgtcctccggcatatcgactcgctcgacgacactcttgttaaggcctcatcgatacgcctgccgatgccatcgagttgggcacaggccccgttgagccacgagatgtacccggcgccgattcctcaggagtgttgcggactactcgaagctccccgcatacccgggccattgaggtacagcaactctttaaatatgacgcaaaccacacctcgcgtcctcggagcgtttccatggcttgctctttcttcacggctagcatggttctcgagagttccgccacttcaaattttgtcttctaatattggatacgacgatcttgggttgcaagggcatcctcgagatctgctaaacataacgaccactaagacaacctggaaaccactaacccaacacgggttaaaaaggctactcacttgaggtggttgtccccatctcgacctccacatcaagagtttggtcctcgacgtcatgtgagacgcgtggttcaaactcaagtaccgggattatcgctagtgactcgggctacccgcgctgctgaacatcctcgtcaccagcatctctacaatcgacaagaaaaacttccgaaatcaacactgaacaaggatggtatcatacgcccgaaagcaaccagagttcaagatttgcaaattataaaaaatacaagaagtcctactcttcaaaaaggggaggacagactcccccaggtcactgacttcttccatcacctccttacgcgtgtcgcttgccgccccctgatccaagatatcacgcagatcgagttcagggcgcgacaaccttacacacgcgaggatgtgacacgccccggtgtagataccgttggacgtctcctccgcgatcctggccgaatgcttggaggggatttcccctatcaccgtcgccagctccgcaagagaagaagtcaacaagaactcgtcggggttcaccgggatcgtggacttgacgccgcactcctcggcgagctggtgaaggccggtgtaggtgacccgcagcgaaccacggatctcagagagattgtctccaagttccgacatgcggtcctcgagccctttgcgttggcgctcgttcccggccaccagctccctcatcttcgtgaggtcctcacaggcctcagccagttcccgcaccaaccgctcggcacgcgcgtttgccaccgccgtctccaccctcgcctctgagatctcgcggccggtgccgcgagcaccagcttcgagaaggcgccccatttcgacttggagctcttcctaggtgaggacggcctctgccagactacgaccctcagcgggatcgctaacagggccgcttggcgtcgcctcccgactcccgaccacgggcacgacatctgtcgacaccgtggcaggggatgcgctggacgttcctctggatttggcccgcgcagccttcgcccgcgcctccctacaaataaccacgaatcaaaactccatttgaatagaagacacgagaatccaaaagtctgtttactaacttctcgccgatcgtcacaatgcgctaacgtcgcggaggtggaggagacgcgtcggaagcctgcaagacaaccaatgtggagtgagaataaaccttccttgctacacaacatagcgacgaggtgaaattaccgagggagtcgctgccttgcggcgatgtccgagcacatacgagaatttcctcgccttggtcggagctttgccatcactggtggtagcagcgtcagacgcctccttgacgaccttctccttcagagatgccgccacctgatgatccgcgagcggtccgacgacatcagtcaaaggaagggcctacgctaaatcatatcataagctgatttgagcagagaaggcgggacgctatcgaatgaactcacattgattgcttcgtcgcgctccgtcgcacttttcacaaaggggtgcggggatgtcgctcgccgtggtcgggccgctgatcatcacctgaccaacacactgctccacggcttcgctgctcagacctgtcaaaaaggaatcaatttttgataagttgaagagtaacgcgagtacaagcatgtctaaatgaatgcgagaaagataccccgaggagaaacncaggtcgcgtcgtctggcccggaatagtcataagccggatgggcccgagcctggagcggctggattcgcctaccgatgaagtctgcaacgacttcatatcccaataagccctgttctcggagatcatcgatgatgtcgataaacggttggagagagggggtcaaggagggtttggcggtccagaccggaatcttgtccggttgttcctcgggaacaacgaggaccggatttgaatccttgatttcaaggtaaaaccacctgttccgccatttgttgcgagaagagggacattggaaggggacataatgcgacttcatgccatcacgaagtcggaacccgacgcaaccggataccctattggattccatccagcgcaactcgtagtaaaagcggaacagatcaagaaagggctctaccccaatgtaggcctcgcaaagatgcacaaagacgctaaggaaagcaatggaattggggttcaaatgcagaagagaaagcccatagaaattcaaaaccagcagaaggaattcggagggtggagggagaaa

SEQ ID NO: 90803 - DNA, 2124 bp, Oryza sativa
cgtcggtgccggactccatcatgtacccgacgatccgcacggggacgaggaaggtggacctggagtccgacgatgtcctggggatacagagcctgtacgggaccaacccaaacttcaagggtgtcacgccgacgtcgccgtcgacgagcagccgggagatggacggcagcgcggccgccgccggcatccggccgtggagtgggttcgttggattagttgtgccggcagttgtcctgctcttagctccgtagactttctagtccatttttcgtgcctcggtgttgccacgtccatctctggttctatttcttgtacgatagattattgttgacttttggacagattcttgtgtacataacattactgaagaattatagatatcaatatcatacatatttttttgatagagaaattgggaagtacttctcttttcttttatttaaagttacttctcggctagttcgtcatgctctggaaaatgagcatcaaaacgtactgtatgtcctgtttagtgaggtaattaaactctaaattttcaagcaccatggaagattccattgacacgttagtcgtctgtccttagcaattagcattcattagtagtatattccggaagaaaattctatgcggcggtgccgcaccagacagcccgggcaacaccgtgtaccctagtgacgcgtgtccaatccctgttgcaacccgagccgatgtccaatctcccagagctctacagtatcgagtcatatctacctgctgcatgtaaaatctaattcatttttttaacagtgctctatttgatgcgagatacataatgccgttacttttagacacatatttaactactcgttttatttaactttttttcatgattattatttatttttagacacatatttaactactcgttttatttaacttttttcatgattattatttattttgtggtgagatgttgtaatcactaaaaatattttatgcatgatttacatcttatgtatgtccacaaaatttttaaataaaataaatgatcagacatgtgttcaaaagttaatgagatcattattaaaaaaacggagggagtaatatacagggggtttttctagggtaatatacattttactaaactttattaatatgcctcaactggtcagaaattattttttcatttgaatagggttgggaaattccattttgatgacgtagaaatcacggtttgaaaagggctttgagattacatttttgttgacatataaatcacggaaagtttataaggctgcgttcgatcaactccaaaagagagaatttttagcgcacgcaaaacgagaaaacgtattagctcattattaattataaatttaaaaaatgaatttatttgaattttttaaacaacttttatatataaattattttaaaaagacgtattatttaacaatttaaaaaacgtgctaacagaaaacgagcaagatgaagtttggagtagaagaaaataactaggcctaagtaataatcttgctttgatagtcatgttctggtaattgtatatgcaaacgctgctacaaagtacgcatggaaaaaacaatttcatttatcaatagttcaagaaattaaaaatcgatagttataaaaagcggactatacgacctagctagcctcaccatttctaattatttgatattaggacatttcctaatatttacgtcttattggtagttataaaaagtatacataatctatcgtaatactttctttagtttatgttttcttaatctatactacatattgtatcatgtcgtacttatgatgagtctcaatttagtatttatttccgctagttttgctaagaaaatggaagtcccttagtctaaaaaacagtacttttcttaatttggtaaatgtcacgccccgaactagccccgaatggaactagcccgtgacgctccaaattaacctgttaatcgataccagtcccaggaaacagtgctggtatcataggaagacaaaatatcacagcaacagaggtctctttattttagagtaggattacagtcatgttgggctgcggacagatctcgagctcacaactgcattacaaaagggaaagcggaagccaagacatggaccaat

SEQ ID NO: 90804 - DNA, 699 bp, Oryza sativa
gtattttgacgaaacaacggcagatgtgcaccttcaagatgaagctttactgacgatccaagtcgttgagggggtctaagatccagaatccataaacactctccagaacacatgcattgcaggtgaggagccggacgggacatttcgccgagcaccccgcgttcattgtactctgaggaaaagcggcaagcgctggatgatgggttttgtttcagaatgcatgatgaatccggatgaacctccacgatgccaagttccggactggtcacctgctgatgaactgcatgatgagttttgttcaactactcacctctcacgggattcacctgctgctcccccaccggcaaggaactccatagctgcagctcacccctgcgatgcagaggggattggtggagacaggcgatgcagaggacggcgcggtggctacctagcgacgggagcacctcgtgcggcggggatcggtggagcagaacggcggcgacgacctggcgacgggaggacctcgtgcagcggggaggcggaggatcgtggagggcgagccggcggcggggatcggtggcagacatgcgatgcagaggacggcgcggcggctgatacggagcggagcactgatggcggaggtgcaggagcggaattccggcggagggcggaggtgcaggtgtggtgggagagcgatagggagggggggggggcggt

SEQ ID NO: 90805 - DNA, 652 bp, Oryza sativa
gttatcctcatatgtccaaaaccttgctaacattatggatataccttttaacttgttgcacaggtaagtgttgatgttcctgatgtacgcggaaggacagagattcttaaggtgcacggtagcaacaagaagttcgatactgatgtctctcttgaagtcatagcaatgagaacacctggctttagtggagcagacttggcaaatcttctaaatgaagcagccatattagcgggccgacgtggtcggacagcaatttcctcaaaggagattgatgattcaattgacagaatagtggctggtatggaaggaactgtgatgacagatgggaagagcaaaagtcttgttgcttaccatgaagttgggcatgcaatttgtgggtaagagataatctgcatatttgctaactgtgcttttgtttattacttgcatatcaaaattccgtgcaactattcatatctggaaatgtattctttgtagaactttgacgcctggccacgaccctgtccaaaaggttactttgatcccgaggggtcaagctcgtggtctcacatggttcattccaatggacgacccaacgctcatctccaggcaacaactgttcgccagaattgttggtggccttggcggtcgtgctgctgaggagatcattttt

SEQ ID NO: 90806 - DNA, 1092 bp, Oryza sativa
gtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacag

SEQ ID NO: 90807 - DNA, 1800 bp, Oryza sativa
tcagctctataccctgtgcacccacaccacgagcaatggccccacggatatctataccagccatctcagcagaaagtaaagcacgctccatttgcccatacctacatagcatgaaacaccactggctgagtactacagcaatagcaacaaaaaaaatctcaccaatgcagttaactgcatgcaacagaatttttcacaagttttttttttaccttgctttaaaagtctcatatggggaataaatagctttcaatgtattcagcagaactaaaagatctgactctgaaaataaatgttggatgttccgagcaaaagtgcccgtcatgttgtgcaggtcgatcagtgctccaagatgcttattctgcaatttggtactttttggcaagtcacctgataaaacatctagtatacctgggtacagaggacataaaatcaatttattgttacgaaagaagtacgcatatgtggcaaacaagtaatatccttttttaattgaacagagaaaaataaaacatgtaattcaatcatgaaattagtatagacatacaaaaatgaaataatacgagaagtttatgcattaccttttgcaacagatctagtttcaggaacagcatctccagttgctaggttgacacgagagacaaaacttgaattcaactcactcatggtttcaccaagtacttttgggactagtgatttgtattcttcagggaaagcagtcaggcaccttcagcattagcattgtagaacatccattaatttttggtggagcaaaaatattgtccgaatgcagctaaaagatgctgccaaaaactggcttctgtttacaagggcaaacattgctgattcagaacaaaagacaacagggtacaatgaacataccacttccattcttgttcaaggtaaagtagtgtctcatcatagaaatttggaagccagctagcaaatgagagactgtttatgctttctccaccatacttctccatctctacccgcttagctctctgttttagatcaaaatcttcccaaagtttctttagaggcttgacatggatcttagtatattgcacctccagtgacttgaatctgccaatacgtatcagtattccacgaagatcttgcacagcatcgaccttccaaccaaaatttgtaggctttagatgaaatagagatgcctgtactactgtttaacaaatataaatgagattagtaagaaaaaccttgcggttagaaagtgcatccaccaaacgaggttgaaccatgtcatctagccgttcttccaatacttcaagctgctttctcacattagcgaactccgcaacctgaaagcaacttttatataagcaaaacaaatagcttctgcatataaactcagtgtactgtgcatgtttgtgtgagagagtacaatacctcaccaactgccgacaagcaatgtctcatggttgccagggtttctgcagcttttggaagatcaccactagaaaatacatcctcaacactttggctcaactgagctagtccagccgcatcctggcattccgaccaacaagctgttaaatctattaaaagataacctaccactgtgagtgaagcatttacttcagtaacatgcaccatagtccacatacaacttacctgtaatgttgcatacgccgcttccattcgttgtttcacagtatcaattcgtgctagtgcagttattgactctgcagatgaaccctcagcctgattgaagaaatcatcatcatcagtaatacagaatttatgaaatgtagatgggactgaatacctagttagttg

SEQ ID NO: 90808 - DNA, 1993 bp, Oryza sativa
ataattagtgaaactctggcacaaagcactccaataacgcatcacagacaagcacaccagttgcatcccttaccccagttcagagagcttgaggtgggcctcggcgtaatccgcaaagaaggcgtcctcatcctacatatcaggcaacaatcatctactttttaagagatcaacgatgatccatttctcttatttcttttattttaaaaaaaacaactctttagaaagaagacgagagaaaataatgcaaggatcaaggggtgtaccgcagcatatttctccaccagtggacggaaggctgggtcagccatgagggctttgtcacttggcagctgaagaaggccttccttctcgccactcacaagctcgctgttgatcgagaggagattttggttttcattctttagcatacaaggaaacaagctgtggctggctgtttatcaacagacaggatgcatctttaaaaagaatcagagatcacgcacgtgaagtaagagttgtcaaagatcaaagggttggacgtccaggctccctcaaagccagatctctccttgtggcatcttccctacagaagatgaagtgaagctgcatgaataacccttccggttacaagatatgagaaacacactagggcaattgcacaagtgtaccaaccagggtgtgaccaccagaaagagcaactatgtccttgtcactcaaacccatctgcgcagaaaagacctgccttaggtggtcagaacctggaccaacagccagaagaccatgacatattagttatctcgcatccacaaattggcacactgttaattaaagaacacacaggtaacatgtatgctccatataagaaagaagaataaacaggaacacaaaacaaactttagtaatgtggtttgcataaacagggttggaaaattttagtcttatgtaggttacacaacttacttaagcatgaaagaattctggtaatggacttgcaatatgaactactccatcagtagcacatacaaatgctggtcatagatctagaaaatttaatcaccaacacattgggaaatgcattgtcataggggtaacttaatacagaggaaatcttaataccttgtgtggcatcaggaagacggccttcaggaggaggctcaggcttgtcctagaaacaaacacatcacatcatcaacattcacaagacagtggagaattcagggaaaggaaacagcggcgtacaagatgacgaaagaaaagaattgacttaagaaaaataccatttgcatctaccagaagaagaaagaagaaggggggagagagagggagagggtttagggatgggaaatgtgattctgacctgcctgcccggatggaaggggacctcaggtccgccggtgacctcgacggccacaacgccagcaagctgccaatagagagggagagactccaattaagaggttgatgagttgagaggaaggaagggaggaagggagggaagtgaaccttacctggtagaagtcggcgtaggagaggatgggaagttggtccttgatggggtcgagaagcctgacggcgatgtcgaggccggcgttggcggcgtgggactgctcgccggggttcttcatggtgccgaagggcccgccggtcctcgacgacacatcgaaggtgccagcagagtgccacctgcagccagccagccactgcaattcaacatctactcctcctactctatcttctggaaattaatcagtagaagaagaagaagaagaaagttacgcgaggcggagcatgagtggggcgcagttcttctcggcgatgaggccgcggagcttgcgcttcgccttgcccacggccgccaggtactcatcgctcaccgtcgggtacgacttgctgcccatgctcccctgcttcttcttcttcccaatccgaatcaatcaatcaatccccaactcaactcacctcacctcaccaaggagggatgagatcttcttactagtatataaaggcgagg

SEQ ID NO: 90809 - DNA, 1723 bp, Oryza sativa
agtttggttccttggtccttagttggaaaatcaaaatgtatttcagcagtgaataactccttatccagatatttagtcatttttagctcattcaaattgaccacatgctaccttgtaataagcaagccaatgaagtcaagccaggatgtgaataagaaagcaaatattgtaagttacagctatgtatacattgcaaatattgtaagtcaagccaaacactgctctaaagttgtaacttacaactatgcaagtttgtttgccagctgttgatcaatggaaacagttaaaatttgaagtgtagcctactatggagcagtgctgcggaagacggatgtcggacagagagggtacggccaaacgtttaatcgttatgtggataattaatcggaatttgatggaaatttaacgttttataaatatgagtacatagttgataatagtttgccattttttgagatgtaaatgcatattgaacatattcttactatgtttaaaatagaaccaccatgaagtggcattaattcaacatatattaaagttcataatgcatagctgtgcatcaaacagtgagctgtgggtgggtagttgtcatgggctggggcgtgtgatcttgcccgattatacggacgattagtcaaaaaatgatggattaatcagtaatgatggtgattacatgttcaggaacgactaatgaagaccgtttcgcggacgggagctcgctgactccattttaacagttgtatcaatcgttttccacgacactgctatggaggcttctttcagcatggatatgctctactcaacatcatatcaccatctcacatggactaggaaaacagcaaatatccagtgttccagtactaacttctgattaatcctcaacacaacattgacatgataaggaaggaccacagtggccaaataggacaaatattgaagcactctaccaattcaggaaaaaatgagcatgtcttgagaagaacaagggcttaccatcttttctcatctctggaagtaagcctgatgcatgcttctcaacaattttcaggtatccatccgcttcatgatcagaaacattaaacagcacaatggacccatattggaacaccaccatatagtggcaatgactttcatctatgatgccagccttaaaaccctgaagaaaacacgcaggcgagaagcattagtgcaatcatacttgcatcgttactacaagcaagcaagtactttctctagcatggtttaataaaacaaaaaaagaagcagtcaactcattaggcaaaagaaaaaccaagttgcaaggacacttgaacataaattccggccgcattcagcccaaaaaatccataaaagcaaaaggaacgcttgtgaagctatgttgtataccactaaagcatgagtatgttatcaggaagagcagagtggagactgtctccattgaactaagcacaaactaataatggcattacaactgaacattgcattaactgaaaatatgtcattacaactgaacattgcattaactgaacaattttctcaattatagcaattccagggatagcattccaccaagttgagcaccggacatggaattgtgcgaaaagaaagagtagatggtgcgattggctaacctctgggtctcccttgacatcgtagtacctgaggacgacgtagttggtagcacgcgaagtgggggggatgcattgaaggaattctgggactg

SEQ ID NO: 90810 - DNA, 5914 bp, Oryza sativa
caagagacttatgcatcattttattgagaaggaaagggtctggtataaatccaaaaaatgaaaaacaaaacaacaaagaaactagaaatgtcaaatgtggtgggtggtggtgaataatgctgcttgctagcgggagatgcctgcccattggctatctctcgcaaaatgatagtgtgaccaagaaaagataaagcactctatgccttgagctgtgggatcatcactccagtccagcagcacttgatcctttttttctcattgcaggcattatattcaatttgctaacgactttaactgagatcactgatttatggtccccattctttgactaaaactcatttctgcattgtgcacttgcttgctgtttcaagtattattcatatttcttgtggatcttccattcgattatactcttgtttattcggcttctttgttaaggacagggagccaagcacactagagtaatattctgaatgcagactggcttttgtgacctttgtcggccccggttttgggtgcttcttcttagttgcaatacctcggggaagttctttccccttggggccaaggtttttttttaatgcacaagatattttatctttgttggtctttgactgagtgttattaatttatttctgtgaagtcatccctgctgaaaatggccagcaagcatggacatatctagaagatatgcaaaacagcattgatcttgttttgacagaggttgttatgcctggtgtatctggaatttctctattgagtaggatcatgaaccacaatatttgcaagaatattccagtgattagtaagtagctttcctcaactctacagtacaattcttgtacaaaatgttgcccttgtcatttatttactttctatgcttttagctgctacactgttgtggtttatgtgcagtgatgtcttcaaatgatgctatgggtacagtttttaagtgtttgtcaaagggcgctgttgacttcttagtcaagcccatacgtaagaatgaacttaagaacctatggcagcatgtgtggagacggtgccacagcgtaagttgttgttggtccagtttttcttatatattagatgttcaggcaaatccatcaagtactgactgctgcttcaccattttatggttacaatatgtgatgactctaaactaaagttgttattttcaaattcagtccagtggcagtggaagtgaaagtggcattcagacacaaaagtgtgccaaatcaaaaagtggggatgaatccaataataacaatggcagcaatgacgatgatgacgacgatggtgtaatcatgggacttaatgcaagagatggcagtgataacggcagtggcactcaagtatgaaacttgatctttttattccaacatagctttactactacctgttaacaaagctgtaattagaatgagaagaaaaaactgaagttaaaaactgaataaacctgtcagtaacaatgatttctgaaggcataaatgacatttttttgcatagctgataaatttattttagaatagtgggaaataggaagagttcaccatgtcactgtaaagtttttgaattaaccaaaccagtaaaataccatggatcatctgcatataacaatcttaatattgtacaaacacaacagatgaaacacatactgaagaaaatatagttatcgcctctcggatagtttacatgtgtgttcatgtggcactatcgttttgcttaactaataccaaggtgccaaataaaccagcggttggttcattgcattttggagcacatatagtatttataaatcttgatagcgtgtgtgtagaatgttccaccagaagttgatagcactgtgctttttgcatgttcaaggaatcaaatggattgtacaatacatgcaaccaaactttgatgtagggaatttctttgttttggcttggatgtccaacttatagtttctcaccagttggattaacttcttttccttgttctcccattgtaaacgtgaattgaacaatccttgccttttaagataaatgtggggtctatgctttatgctgccctttaaatttttgaaatgctaataagtagtttgcatgcatcgtgcttctctaaatgtcatcaagttgactaatatacagttcactatcaatcagctaataccactttattttatgtgtttcctattataaattgaacattttgtttccttaccaactagaaatcatagtacagatacatattgtatagttattttcggtttattcatgaatttgtgttagaattagactatatagacattgctggttaaaaagtactcatcccctaacactgtgggaagagtacaaaactactagtgtgttaacaccattggcctcttgacattcaaaactgctacccaatgaacacattccccatcaatggtccaataatcccgaagtctaaagtccttaatcaactcgtgcataattattcacttggtaaggaaataggaaaaggatggatgcacacaaatgttttgtccatttttgctaagcctccagtatttttacttctgtgttttgagcttcataatggtttccatgtcttttcttcaattaacgcttttgtcctgtattttgatttctatttgcaccatttaatgaatcttccaaatttgggtttttcctcttgatgatttttaacttcacatctcaattgatctttaaaatatgcctaattatttaatactacctccgtcccaaaatatagcaacctaagactggataggacatatcctagtccaatgaatctggacaacccttgtccagattccttggactaggatatgttccatccaatcctaaattgctatattttgggatggagagagtatcatctaattaattacctgcaaatctgcaatgctctgcttaaacatattgtatattttctatactaatttactatacttattatcaaaatgaaacgtatattaaaaattaaatatctgctgcaatatgtgccctcaaaactagtataaacatattgtatattttcttttcaaagttacctttaatttggcgacatgtttggattgataaaatcaagtctaagcttgcaaatttggttctcctgatgctgtatgtttgattccactaaatagattctcttcaatgacctaggcaagctgtcgtagtttatcccaaatgtgttgaaaaggttgttctgggtatcaccgtacagatagattgatcctgaaattcgtatgcagagtaaacaaaatagtcttatcaacatagataatgctaaacatcatatcatcagcgcactagtgcaggactgccttgacatataatggttgcctgaaatggcaatgaaataaaaaatcttttatttaaaaagcaagattcaattgtgaattagcaatagttggagaaatttagagttacaggatatggcacacgaggtgtacttgagaactgtcggtttgtagctagagatggctacgaatgccgccggggggtacctagcttatcggcggtggatgaaaactagtgtaaacttgaaattagtccacgtttcatgtggatgaaatctagtgtaaacttgaaattagtccacgtttattatgaaacgttgactacagaccctaccgagataaactgtatcttatgtgttgctgtcaagttctcttttattacagtgttgtggagtggggtaaaatttttttcctgtcagttagttatgaatcacataagattttgccactgaaatgttcagtgacatggccgatatgtcaatgtaagaaacaacttagaataaattccacattacaatattcagaaataattactgtagatcggatcactttgtgaagtgcatttaaactggttgctcatcatttttttaaggcgcagagctcatggacaaagcgcgctgttgagattgacagtccacaggctatgtctccagatcaattagctgatccacctgatagcacttgtgcacaagtgatccacctgaagtcagatatatgcagcaatagatggttaccatgtacaagcaacaaaaattccaagaaacaaaaagaaactaatggtattgtatgctcaactgattcattgtgcaactcgataaaacaaaagctccataacactgtatattaataaatttcaacatgtttttttttcagatgacttcaaggggaaggacttggaaataggttctcctagaaatttaaacacagcttatcaatcctctccgaatgagagatccatcaaaccaacagatagacggaatgaatatccactgcaaaacaattcaaaggaggcagcgatggaaaatctggaggagtcaagtgttcgagctgctgacttaattggttcgatggccaaaaacatggatgcacaacaggcagcaagagccgcaaatgcccctaattgctcctccaaagtgccagaagggaaagataagaaccgtgataatattatgccatcacttgaattaagtttgaaaaggtcaagatcgactggggatggtgcaaacgcaatccaagaggaacaacggaatgttttgagacgatcagatctctcggcatttacgaggtgcaaaacataatatcagtgtcgctagtgagttaggaaaccattgttaagttgcatactaactgttacttttgttgcaaggtaccatacacctgtggcttccaatcaaggtgggacaggattcatgggaagctgttcgctgcatgataatagctcagaggctatgaaaacggattctgcttacaacatgaagtcaaactcagatgctgcaccaataaaacaaggttctaatggtagtagcaataacaatgacatgggttccactacaaagaacgttgtgacaaagcctagtacaaataaggagagagtaatgtcaccctcagctgttaaggctaatggacacacatcagcatttcatcctgcacagcactggacgtctccagctaatacaacaggaaaagaaaagactgatgaagtggctaacaatgcagcaaagagggctcagcctggtgaagtacagagcaacctcgtacaacaccctcgcccaatacttcattatgttcatttcgatgtgtcacgtgagaatggtggatccggggcccctcaatgtggttcatccaatgtatttgatcctcctgtcgaaggtcatgctgccaactatggtgtcaatggaagcaactcaggcagtaacaatggaagcaatgggcagaatgggagtacgactgctgtaaatgctgaacggccaaatatggagatcgctaatggcaccatcaacaaaagtggacctggaggtggcaatggaagtggaagcggcagtggcaatgacatgtatctgaaacgcttcactcaacgagagcatagagtggctgcagtgatcaagtttagacagaaaaggaaagagcgcaacttcggaaaaaaggtagcctgttttcaattgcatgttttctgttcctttggttttagcattcctgtttaactcgtctaaattagctaaagaacatgttactggaagtagttgtcaaaagcatattactggaagtttctcccaaacgactagctaaatgggatcgggcatgaatataatttgtttatatactagtattatctgatttctaaaaggaatctcacaagataatcttccaaaaagttgcacgtttttggtcccatagccgtgttgctgaaatttcttgccaatgacatttcttggatttttctcataatttaatggtagctacttagagcggcaattcaattttactcttgaaacactgtcctttacttttcggcgcgggtgagtacaatttggataggaggctctttttatatatagagaaacatacatacatacatacatatatatatatatatatatatatatatatatgatgtgcttgatt

SEQ ID NO: 90811 - DNA, 2060 bp, Oryza sativa
ttgaaggagaaggagaagaagctgctacgcaaagagaaaacccgtctgcgcaatcttgttgcaccggtagttgcagagagccacttttctctgtcagaagatgatgtcgaaacagcatgctcgtcacttgatatggaacgactgaagagctctgtgatagcatggagaacaaagatacaacagaaaaggccagattactcagtggtgctctgagcaaagaaggctcgtctggtacttcaaatgaaggaaagaaaattcaagcaaacggcgtggatggttccaaagcaaaatccacctcttcaggtgagaaggtcacgcaaggcaatacactaagcaactatgagaagaaagaagagaaaccatggggaagggaagagatcgagttgcttaggaaagcaatacaaaagtatccaaagggaacctcccggaggtgggaggttgtctctgagtttattggaactggaagatctgttgaagaaattctgaaggctacaaagactgttcttttgcagaaaccggactctaccaaagcttttgactctttccttgagaaacgcaagccagcaccgtccattgcatcacctctttctgtaagaactgaaacagttggtttgcctactgagaaagcagctggaaatgcatcatccaaagcgcctgcacaacatgcaagcagtaaaacatccgacgagaaagctgctgctcctgctcctgctcctgtatcaaatggaacaccttctggaacagcagatccagaggcttggtcagaggcgcaagtgctggctcttgtacaagctttgaaggcatttcctaaggatgcaagccaaagatgggagcgtgtggctgccgctgtcccaggtaaaaccatggtgcagtgcaagaaaaaggttgcagagatgcaaaagaatttccggagcaagaaaagcgctgagtagaacaacatagtaccggcacaagtactttttgtggctagtggctgacaaaagcttctgtttgaacatcagtatcccttatatgttagagaatcatagctgcgtactcctgatgaattttgccagcatatcacggcctccagtggtagcaataattttggtttggagctctgtgagaactcgcattgggccttaaccggtgtcggcattctgcttacacaagttttttggtctaccaagaaagaagctgatctgctgttgttgatagctaatgttttggccttccccaacattaggtggactttctgctgacccttgggttgtttatgttcgagagccccttgaagagtattatttccttgcattggtggagtgatatgatctggtctggcacgacacagggagtgtagagaacagcatcggcatttatttatcaacttataagatagaaatatttgttacaacttgagaacttgctatatcaagaaaccatatttttgcctaatcagattcattattcatgtctccttgttaagttataacttgtaatgccagtggtaaatgcccttttgtgttgctcttgcgagaaaatgatagtagttcgtttcctgaaacagcactccacttgtttgatataatccctccgttttttaatatatgacgccgttgacttttgttacaacctttgactgttcctcttattcaaaaattttgtacaaattttaaaaatattagtcatgcttaaagttcatttagtgataaattaaaccatgacaaaagaaaatatatttatttaaatattttgaataagacgaatggtcaaacatgtgagaaaaaaatcaatgatgtcatctatttaaaaaacggaggtagtatatctaacttgccctctccttctggtaaactttttttgttattattcttatcactcggccccgttcggttgtaacgtgataaagaagctggaaactctctccttttttttaaaacttttttgttactattcttatcactcggccccgttcggttgtaatgtgatgaagattacgtgttagacacataaaaggagaaaacgagaaaactattagcggatgatatcattaattgatttttaattattttatattaaaa

SEQ ID NO: 90812 - DNA, 2111 bp, Oryza sativa
  unsure (1)..(2111): unsure at all n locations
aatcatttacaaacatatttgaacattgcaaactaacatataagaacaaacatgagaaacaaaagataatcaatcagtagggaataggccctcgcagtttgttagcgatatgtaagaggtggtcaatgtttgtgggtggatagctctggagaagctttaggtttgctgtgaaatccccggccaagagccgccttcgaacaagaattagcatagcacaacagattcgaagtaaggtggcctgcaataagataataagagttttatagtgcatttcaaaaaattctcagatggcatggaactaggaatggcagtttctaacctgaggtccctcaggatcacctaacagtgcatcccatatatggatgcagtcgcgaaacttgaattcctgcgtcaatagcaaggtgatccatctgaatgcgtaaaactgtggattaacctggaatatacaaagcattagagtaggagcagaaatacactgtaaaaatgtaacaagaaaaaagttattgaaatgcataccttggtcacaacctctaaatgccgccagagctcttcatcgtgccttttcaggagctgggataacttgctgattgtggagcgtatgcccaccacactgttgtcaagctgtttgcaaaagttatcccgaaatccactaagcagctcaacgaaacagaaaaatgcatccggctctgctgactcctgtttacataagaaattaaaaggtgtatgggcacagagttagccgatgcttgtattctatagataacatcattgtttctctccggtcatcacccatctagcagccatacttgcataataaaaaataaggtacatggtaaagctatctaacaatagtagtgaaatgtttctactttggtaacttcagaagaaaaaagaatgaataatagtcacttaggcagtataccaaagtcagataaagtacatgatacatggttccaacaggcagggaaccacttaccagtgaatgaattcaggaaatctgtatagaagaaatctaccacatatatttaagccttaaagccaaggaacttacatacgaaccaacgttcaacaattttaagcaaatagcgtcatgggaaaaaaaaacacttacagcattattttcttctggatcattcttgaaaacatagtagagtggtgccaaaacttcattcattccttgtacatatcttatacccggatttaattttgcaaatatggtaagtatacgctttagcgactcctgaagacaaacatatatcacatttagcctaactggacattacaaaagacaaaaagaactggcatcatatcagataataaatgcttacttgattagacaaggcatcagaagaatccccattgaaaaattgcatctcaggatgagtacgcttaacatctctatcaatctgctctatagtttcagattcctgaagtatcaaataacagtgtatatttttagtagctcaaacactatactgtacaatatattcattacaaaaattcaacgaagagctgcaaagggaccaagggagatctctcaatatcaaggagttgaaagttctaccatcaaattgaaccaaagcaaaatacagacttaacatgtggcagtacataaatttacgatttagtgaacattacctggaaaaattggttccagacactagttttcccgaggcttagaggatgttcatcatggacaatttctgcccttggaagcactccagttccttcagaattatgtctgttccctttggatatagtcatttcctccattcttcgagtaacttctgactgaccataaccaaaacatattattatgtatctttcttaaaaggagaaaactaccaaatgaaattgttaagatgtaaaacaagttggtaccacaataaaatactttagcatatccnnnnnnnnnnnnnnnnnnnnnnnaattactagttttaaatcagggcacatagtttctgacttgtatgtccatctctcataatgctaacaattgctatcaatacagacaatgtaaccacataccagccaatggttcagaactgaaatcatatatggataaagaacttacaggattaactagaagctcgtctttgaaagccactgta

SEQ ID NO: 90813 - DNA, 728 bp, Oryza sativa
agctccagtgggcattcaaccaggtggagtggccgacgaggaggagactgtcgcagccattgtggatgaaatggagagggaggattctgacacgagcgtgtagaggaaggtgattcgtcagatgaggagacggatattaatccagcagaataggctagtcaggatttttctgggctgatcgtctctgaagaggatagtgtgagatgggagtacaaagaaaatgaggttattcagggagcgatttatagtagaacagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacaatgtcagtcattaccaagcatacatgttttctacctgttgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgtctgcttggtgttatcgaggaaagaaaccctgggagctcttacgaagtgaa

SEQ ID NO: 90814 - DNA, 4446 bp, Oryza sativa
caatgagctttggaagagattagatgagttgacagccaaatgcagtgatcagcgtgcagcggctccatcgactgccgttgatgacccttctcaagctcttggacctctcccaacggatagtccaactttggttgaagaactggattggagattcgaaaattttctcagtggattctgcatgaaccaaaagagaaatgggccaaggtgtatgacaccggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacagcattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacagcatatatcattgctcttgttcaaagccgaagctgctccacaggccatgcacccatgtcattgctgccgcagcggagtgtggcataccagatgcagtatatgtgtcgcagtactttagtaagcaagcaatatatcatacatggagcggcgagatttacgggttcggcatagctggggagtttatagagactaacgatgaagtactcaatattcctgacccatcaaagctccgaggcaaggctggaaggaggaggactcgtcgcatccgcaacaatatggacgagtcggaggctggcagggtgaagcgttgcagcaaatgcgatgaacgtgggcacacctacaagcattgtcctaaagacaaggagaaaccaagtgcggcggaggcaggactatcaggatcagcagcagatggagctcgccctatgggtgaaggcactacctccactcgaccacgtcctaggcgtcgtcgtgccacgtctggctacgtggtgtagttgcacgtcatcgttatgtaccattagtaacgtttgctttatttaaataggctgtactcttgttgtacgtaattattctcatgatttttttactatttcattaatttgcgagtcatcttttgttttacattactactttttgaattgttctaacacgaaacactatatttttcagagatggcacgtcaggatacacctcaactgttggatccggcgatagatctccgacaccggtctcaccttactgcggtgcagggggctcagcttgggacgttccgggcacagacatgaggtgagctactcacggttcacgactccttcgtcgagaggtacgaacagtatattactataaattagttgcgctgtaatcttttttgtaatgacatattaatttcttattgcaggctgcgtgaggccggcctcctaccgatgtgtcggctggtggaggctgccgccggccacgtggacccggccagacgatggactatggacaggtccctcctagcagctttggttgaccgatggaggcctgagacacacacttttcacttgccgtgcggtgaggtagcccctaccctacaggacgtatcgtacttgttggggctaccgctcgcgggagacgctgttgggccagtgaccacggctgcggactggcaggacgatctgatggcacgtttcgcactagtacagcgcgcaccgcacctcccgctccagccgttggcacaccaccgcaacaccggacctacgaagaggtggctgcttcagttcaccgtgagtgtttttgtaccgaaatgacaagcgtactacatatttattccacatgttaaggttcctaacattttaactaacgcttgcaggtcgatcagctacaggcggaggccgacgagtactcctacagccgctgtttggaggcgtacttgctctggctttttggctaggtgatgttctgtggcggtcaggggcacgcggtcgacaagggactcgtgcactacgccaggagcatcgccgacgccgcggtaggcgaggtgcctcagtggagctggggttccgcgttgttggcggctctgtaccgtggactttgtgaggcttgcacgaagacggatcccagcgcgacctttggtgggtgccctctctttctttctatctgggcagctgagaggattgcgatcggccgcccggaggtggaccagcacgcgtacgaggagtcactgtacgaggagcgaccagaggtcgactaccctacgatgggtactctgtggtgccgtcgtcaggtacgttgcatcgatcttctagctttgttaagtacgcaggccgcctacttctcccacgctgcagggtcagcgtctcagccagctgcgtcgacctcgcactcagcgcaattccagcagtacaccggggcttcctcacaggcagccggcacgtcgagtcagggtccaccactggaccatgctgggacctcgtcggaccgcttgctgtcttccaccgtgctcttcgacatcactgacttcgacttcgcttcaggctcggcagaggacgtcatcggcccctcacagctgggaggcgcaccgccggtgcagacgcaggaccaggcgcaggccactcctccgccagacactcgtgctacccgtgctgtgccaccggatcgtttcacctactcccaggaccacgtgcgagcacaggccggaggaccaagcgtggtcgcggcgcggggcagggccagtagagcagtcttctctttgtttatttgcttcactttccagtactgtatgcttgtgtaatgactacgttgttgttatatgtgcacgatatctttcggcgcatgcacgatacctttcggcgcatgcacgactactttctcccacaccgatgcagcctcctttattcgcgtgcgatacgagtatttgcccgccatttgccgcatacgaccaacgtaactttcggcgctgatcaagcatgcaactttcggcgccaatcaggcgtacccaccatgccccaccacgttcacatgtcaaggatatcactcaagtttttgcgcatatataagtcgccttaacgagtgaggcctcacaatctttcagaactcagtcacattcagtactctcttccccacttcttcattacaaatcctaccggctttcgtcaatggctagacgccggggtgttgaggatccaaactggcgcagcgatccttgtgtatacctactaccaccttggtgccagcgtcctctctgcctatgcggtgatcgatgccaactaatggcttcgaggaatcctgatatttgaggaaggcgcttttttaggtgccctaactgtgaccgtgaggtattttattatctgcaaatgcttattcattccgtatgggcaatcgctttattcttcgtaacactactctatttggcagacccgcactacggtttgcgcatacatcgagtgggtcgatacagaaaatcccgttctcgacctaaccacttgtttacaagaaggtcgctggtatttcgcatccgaaagtactgagcaatacttaaagagaaaagcggcttatgaacgacaatgtcgtgaacaacagagcgactggagggtgctaactacggcactccctccatgggaagcccgtccaagatgcaggtgtggtgatcgttgtcaggttcttcgttccataaatcctacaacattgggtcgaaggttctttatttgtccaaatattcttgacgacgatttcatggtaagaatattttgattacatgaatccttattttctcacaacatttactaactttgctcgctttacatctattctttcctcccaggaaccaccaaggagatgtcaatacagagaatgaatagacaccagaagggttctaactccacctagccgtgttgtgcagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatcgaaattgttgtatcatgttcaaattgtactactatttcttcatgttatataattctccttgtttaagtccatataatgtttctacgaccgagactgcgataggcctatattaattatccgagtactaatacgtcgaataaggtacaaaataatacctcacttaacatatgaaattgcgcaacaaccaacttcaatacatttttataacaatattaacaagttttaccaaaaaatacttctttattttttattaacattacatagaaaaatattttggccgtacttttt

SEQ ID NO: 90815 - DNA, 1306 bp, Oryza sativa
ttctgacttgtatgtccatctctcataatgctaacaattgctatcaatacagacaatgtaaccacataccagccaatggttcagaactgaaatcatcatatggataaagaacttacaggattaactagaagctcgtctttgaaagcactgtattgggaccgctttttctccagttcatatgcccacagcgcatgatcagtcggcaagtatcccaatagaagctgctaactatcaaacaagtcaaataaatttgtagtgtagcaaacaaggagaaagattaaagatttgtacattgtaagccagtctaaatttagtcacattcatagctatttaacctaaaattcttgcagtgaattccataatatcatttagcttaatcctactacaacagttctcttcatatataaaattatgtcagttgaaattaagttgtgcaatgacatgtaacacaaaaaatactgaaaggctttcagtgtaataatgctctgctcaaatcactaaatgcttgtatacatatttacaaactacaaatcatattctatttgtcaattacgaatcctgatttctcctaaatttattcaactaacaaaaataatgccatgagcagttgtttgtaatcctaatgcacaattatagagcgtatgaaattctaccactggcttcaaagcagtttgctgaaactagtaagaacttatctttatgaatcatggcctcatggcaatcgtatagtttggtccttaaaaactgaatgtatgggaataaaacatcttaagaacctagagaaatccaaacatttcaatgaaacaaaaacttgattagagacccattcacttcagaatagatataactgaaaccgcattccccgaacacactccatgatatctcaaaagaccaaggtaaaaaaaaatgctcctaatccttgcgtgcagcataaaccatgtatcaagtatcaacaccaaaccatatgattgatccgaatcaaatcacgccaaacccccatccatcctaaattccatcatttatgggttgtctacggctttccaaaaaacaaatgaatccaatgcaaggacagcatccatgagctgtgacgaagcgaaatcctagtattcgtaatacccattttactctagcatggtgacacacagtgaagtatgtgaagtaataagagtagtaaaataagagaaggcaagacgattccaccataccttccagacgacggggcgcacgccggcggcgtcgggcacgcctggcacgcgagcctccgcagctcagccagatccaccaccttcctgcccagctgcaattg

SEQ ID NO: 90816 - DNA, 610 bp, Oryza sativa
tttctgttgtcattgctcacaattaccatagtacaagcaaaaaaaggaatggagaagtgattagagtaacattcaaatgcaatcgacatggaaaagcaaagtcagaatcacaagaagaagaaacagaagagacagtagtagcagagagaaacagtaatgagattaaagccacaagttgtaactgtgcctggtaatttctgagagaaatttgatttggagaattacaagggttaatttagatcacaattataagatgagtccaagagatgaagttagattcttgaagtcacacaaaaatatgacaacagaagagaaaatgctgataaggacactaaaggaatgcaatattcccacaaggcatatgattgtgattttgtcaactttgagaggagggctgacatctttgccttatactaagaaggatgttagtaatgtgagaacttgtataaataaagagacaagtagcaatgatatgatgcaagttcttcaatttttcagaaagaagaaggagaaagatccaaagttcttttatgaatttgatttggatgagaataagaaggtgaccaatttgttttggactgatggaaagccaattgattggtacgagaag

SEQ ID NO: 90817 - DNA, 1304 bp, Oryza sativa
aactgagaagctgcttaccccaatatgaggcggcaatatactatcaggtggttcttgatgaagcatgaatcataaccaaattgccactgcagcataatgatacaaccctgttaatattttaccactttacaaatgaatgctagctcacagcgtcttatcatgccgtacgaatttcccagaaaatgttgctgttaacaaaggttgagacagaagtagttacccagaaccagaagaaagaagccaattcaaatgagttctgcagcaattagcaaaccaaagagtgtataagttcaggcttgcccttaatccttttcaaaagttaactagcaatgcaaatgtacctgaaagagaatgaaatggatcagccacaggagaaattctggtttcttgaaccaaaagagatcatcccgtggctttatccttggtccgtatgcattcatctttgcaccctctgctgttaaagttgctatgacgtatgcagctttgcgccaactagaagaacaagctgcaggacattcagattatggtcaataccacatcatacatgttacggattgtgcacgaagcaagctgcaacttacagtaacaggaagaatggctatccaaaagtacaagttcgatcctacaagaaaataaccatgtataatgctggataatgagacagaaatatgatagtagtgacgatattaaaagagtggttggaactttaccgttgatattgaataacatgaaagcaacaacaaaaccccacagcagcccactgcataaaaggattaaatgagtaagttttctgattatatatctccaatgagaaaaataaaatggaagtaacatccataaataagcagcgcatagacaaaattataagggtgtactattaaaccaacctcactccaacaatcttctcaaactcctcttccattgagcgtaccatgtaatcatggaaatcatatgttggtgcaagattgtgggtctgcaatcattcttaagtcaaacaagagagtacaactaacaaatttcagcacacgccaaaccagcatatggcgacagaattttgagaacaagaatattcaagaacaatgaaaacaatatatatctactctgttcaaaacagaaaaaaaatatgtatatccactcaacatggccatagaaaaacaactgcttaccattatgaaacccttgcggaggataaggtaatctgctcgaacaacagattgaccaaattgtgcgagaaagcaaaactgtatggtaacacaataaaaaaaatgttagctgtgaacacagcaaagccttatgcctcacat

SEQ ID NO: 90818 - DNA, 2003 bp, Oryza sativa
cacatcatgttctagatttgtttttttatgagacgaatgtgttatttctgttgctgatgaacctgccaatgtcccatgataatgtcctatcttgatccataaatcctctggaatctgaatgctcaaaaataggattggcatttgggtactgagtacggtatgactgaatttattgccaccggctgcattcaccagccggtttggcccataaaatccagcacggtggagtgggttctctattaagaaatctgtactacgaagcctgtatacaagagtggctttaccaaacggcaatgtagtacaactgttcatcaaccagtttttcagcagctaactggtcctcgtaagcaatttatctggtaagcgtatcgaccaatgtttgttagtagtgtcaggttcagcactacacctcctacatcatggtctttccccaacagtgatgagcctgtaacaagctgactcatggttgctggaatgctggtaattgcaaaagagaagaaactgtcatggtaatgagcatatatgtacttggaatttcacactaggagttcaatgtggaacacaaggtttttcctcactaatttttttacactgcaaattacaaatctgtacaagcatttacaacatctgaccacagcattggatctagtcagaattcacaagttctcttgacaaagttcaatctgctcctggggttagccacatcctacgacaaggaacatcctctgcatgaatgaataagacatgcgtcactctccgaaaacaattatgagtaggtcattatgagtagctctggttattttacatgagaatcataggcatagaagatgttgtccggagcaacaagaggcagcttctcaatgtacataaacaggcgcctaaggttctctctagtaatcgttgccatgtcaatgacatctcggtcatctgtgagcatccacagatcaccagaatttactcttttgaggctgtcacggcagaaggggcaggactgggatcttgagcgcctgcaacaaggatagcacatggttcaaagaatgcagcaatatcttaagagagttcgtaaccagtgaccacatagttattcatatagcagagaagctatttttaagttcatgtactgaagatataaattgatatgtatgtcctttgaattccttatgttcatgtaactggtaaggtattttatacataaacattagtactgtcatttacgtgcggtactacatgctttggtggcagagtttttgcagagctatgtattgacataagtttgggaaattatgaaactgaactgatgttcttaaggctgtttttccctttgcaagggatcatttgcttagtggggttatgccatagaagggatttcacaggagctaaattatagtgtcaaagaaaaagtgatctctgaaagaccagtaagagttaagcacaaagctgacaaccttgctgcaatgactgaaaaatatgcaatgtcttgctgtaataatcaggtacagatctattaatgaggttgcagcatagcaccatcttatttattgtgcagagccattcatacagagtaaaacagcgtgctgctattaacctctcagaaccaaaatggtccactatatctggacagagttttactcgtgttttgactaaactaactttgaattgaagaactaaacacatctcagactgttaccaaggaccaatacggcatcgattaaccattagtgatgaacatgacaaacaatttttgggatggaaggatttgattctcaccattgacggtaacacttcatgcacatagcatggctgcagttgggcaagacaaccttgttattcatctccatgcaaatcccgcactcttcctctctctcgacatcaatctcagaaacatgcctcttgctctcatcctcatctcttcttctgtatctctcagtacagattgccttctgcctccggtcatcgacatcgctgataccctttgagtgcatgagtgagggaaatataacagc

SEQ ID NO: 90819 - DNA, 849 bp, Oryza sativa
atttgttaacaatttaaataatgatcaaagttgtttttttagagaccatgtccttgtccaaaacgacaaggtattatcaatccggagggagtatgagttacaaatcgcttaggagcgtattattagagacgtaacggaacaactttcagcaagcaaaaagaaagcagacaaacgataggaggtagactgcaatagagaaagaaagaaagcagtagagcagacttcatcaaggaggctgaaaaacaaactcattttcttgaatgtcttccccgatctgctgggccgcttgttgtgcatatggctcttgttgcttgaagaccttagcatttatttgtagccaaacgtgtcaccaggttttgatcagaattcccactcttcgttttgattcagccttattggttccatgagctaaagccatcatccattcagcggtggagtttgaatttatcgcagtttgcatgccctgagctaccgccactaggctccaagtggttctaatgaaatcacactccctaaaaagatggtcagtgtcttcacaggcgcttctacaaaggggatatatccaatcacattcccaatggtggattagcagattttcagctgttagagctcttttgtgcaggatgagccagccgaagaacctttgcttgggtaatgcctgggctctccagttggctttgaaggtctgatcatgttgacaggtaatgaattggaattgatatgcactttgggctgaatatatacctttgctatttctcttctagattatgtagtcttcattttctgacgttagttgtgtttgagtaagaaggctgccgagatgcacaagctcttggattacttcaccat

SEQ ID NO: 90820 - DNA, 730 bp, Oryza sativa
tcctgcagccccgaattgtggtcaatctagcaacaggtgagtaattgtcaaagaaatcttcgccttctttctgagtatagcccttagcaacaagccgagcattgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttctagtagtctgcatcaggagatgcatatgcttctgaaattgacttaggagtgtcatccacgaggtacacagtgaaatcatcactaatggacttagccgtcctttatctcttactccttcaaggagcttcaccgacatcctcctcaggtgtatgttcagtttgttctggtggtgtgattgaactgggaattatttcagagggttggctcgaaccactatgtgtatccttcattgggaaaaaggctctcaaagaaggtagcatcacgagactccataattgtaccaacatgcatgtcaggtacctcgcatttaactattaaaaatctataggcaatgctatgatgagcatatcccagaaagacacagtccacagtcttaggtccaagtttgcgcttcttcgttattggtacattgactttcgccaagcaccccccatgtgcgcaaataagaaagtgatggttttctcccaatccatatctcatat

SEQ ID NO: 90821 - DNA, 734 bp, Oryza sativa
gatatgacttaattagaggaaaaaaagagagagataatttggaccatagattaatcatttaagaactaagtgagaatgaactatataagtatataggatatcataaaacataataaagatatacattgaaacattatgtaattatgttggatgataatttaacatgtttgtatttgaaaagctcttaaattataaaaactgtaaagatatatcatgtttgtatgatgtttaaatgtgatgattgttagtggatgatgatgtaacatcttgttaattagtgaatgatgatgtggcatcttgttagtggatgatgatgtggcatctttgcatgttaagcttaagaagttagtgggggataactttatagtaagataggataaactcttgtgcttatgcttatttgtaacatcccggtctagggcttaataggattaatagaatactcatatcaacaagttgcaacttcttttacagaagccaatctccaaagaactccagggttaagcgtgcttggcctggagcaatttgggatgggtgaccgaccgggaaattcttcccgggtgcacatgagtgaggataaagtgtgcagaaaagatatgtgttggtctgtgaggacagtctatgacctatgaaagctatcagatgtaagcgggccccggcctgggggaggcgggacgttacaaaatggtatcagagccaactctcgcggtttcacgggtgcgacaggcctgggg

SEQ ID NO: 90822 - DNA, 4506 bp, Oryza sativa
  unsure (1)..(4506): unsure at all n locations
agtggtgacgagcggggcggcagacgagaaaggagcagcgcacgtgcgcgggcgccggccgatgggaggagaggagcggtgcgcgtacacgggcggcggccggagaggataggagcggcgcgggcgtgcggggggaggtgtcgctgaccacgctcggggaggggtcgctgactgcggccacgtgtgcgggggaaggcgtcggccatggagcgcgcgagttcggcggcggagatgaagccgttgccgccgccggcctacccacccccttgccagcctcgccggccggccgccccgctccgacacgccagtcgcccgcttcggtcgccggccgcccgtcccactcaaccggccgaagagagaggatagagaggaggggagagtagtgaggccctgataggctgtcaatgtcatcgtccacgtggcatgctatgtaggtaagaccacagtcaaatgaggctttggaccgggatgatacattaaaccaagtttagagatctcgatgctcgttttgcaagtttgtggatttaagtaaaaccttgttacaagtttaagtactactagtgtaatttactcttgatttttcaaggtaaaattctctcctcgttgatcaatcaatccatccatcttcaggagtagattcagatcagattttgagtgagaacccagatcccagattatactacttagtatcattttatttgattgtatgatatgttattgttttaagccaatttcattgacacaagaactaaaacggctggcaatactggggcaaagcaaacctagcaagacagcaataacactggtatgccgtttgcccacccgactagccgaaccgagcaatagctcaggctaaccagcaaataaagcatttctaacatcacgcgtttattattccagttcatctacataaacagctgataaagtaactgaattacacttccacgtaaactagattacaggagtatctgaataatataaaaaatacaatcactatacgctgtccacatgaagtacaatgtagcacaatcgaatggagagtggtatataacaatggaagagccgggctaaattatacacacagggacattgccatttgcagttttgccgcaaatcaaaatgtgtagcgcatacgatcatatacactacaaatcaacaactgtaagcactggatccacctgaaagacaagaacaggagcaatatgtattaacataaatattttcgatacttgtgtgcagtgagctaaacagaagcatctcactactacacctgaattttatttggcgaggattggagcaccacatgcagcctttgcatgtttgtcttcagcgaacacaagattcccacccacaaaggtggacagtatcttccctgaaagctgctttcccaaatatgccgaaatattctgcaaaaatgtgaaataaactttacacatagaatccagacttcacatataaaatgtgatcttcaatttgtagcattttctagctgattgttgaggaagaggtcaaaagttccacatggtccgacattttatatggaaacaagtggaattctaacgggttcgagttagaaagcaaacccgatgcttatggtagacaggatggctgtcatcaagatggaattgagcctcaggtttccataccacaatatcagcacggtatcccggcagaacagcaccctacaaattgagtttaatttctttttagcaatatcagcatgtactgtatcgagtgagacaacagatgatgatataacaaagatgaaaacattaatcataaccattagctggttttaagnnttacacaagtgtcatccagtaagaacagtagtatggcacaatgatgccatgcattttgctaaaaaagatgacattagcccattacctttttctttaaccctgcaagcatagcaggcctttcgctccaccatgatgccagttgattcaaactgataccgtattttttcccatgcgaccatgttacagggagaacaaactgcaaatgttcataccaaactaattactactatgcaagcacaatctggaggccttcacacttcaccattatgattttactcaaaatgtttttcacgggccagcggtggaacgttgaccaatttgtattaagattaggggaaaataaaatcgttacttggcactcttggcacggtacatttattcatatgcactaaaaaacttacctgcaaagatgatatgcctccccatgcccttaagaagttaccttcctccatgagtttgagatcaggagctgatggtgaatggtctgagctcaacatgtctatgtgtccatcctaatgttagccatataatagttggccagttacgctataacagtttagtaaagttcaacaaaccaatcataataagaagaatggcgtcaagcagagcttcccagagattatctctgttggttgaatcgcgtataggaggagcacatttaaagcgagtatctccatcaggaacttcttcagctgaaaacgccaggtaatgaggacaggtttctacactaacccttgcaccattttgttttgcatcctacaaccatataaaaaattggagtaataaatggaccaagaaaaccataagtcatttgaataaatcgtactccactgtgcataagctttttcatcaacaataaataatcagtttagataagcaatgtaaaatgttctcggcgattgtgaatataatattcttttgtttggttgagacagaactttctttcatgacttcacaaaaacagatgaatcattaatacgttctggtctgtccatttgataatgacatcataccttaagaagcccaagagaagtttttgcatctgagagatgaactatgtgaatatgagctccttctgaccgaccccctatctccgtgtctttcatcgcacgttgcagatctttgatcgctgcttcctccctagatataaatggcaatagaattagtgaagtttgaagttgtgatcagctcaaaaggaaaaaaaaaaggtgttaagttgtgagtacttcggttcttttcagtgatggctattggttaagctttttttacacgattgcatactatgtactaaaacagcataatgccatggtattctcattgatttgttgtacatatgctttccagacagccatatagtttaaaatcagaattgtgcattctgattaacacacagactagactatgattcactcaggcaatttttttttcgcgaacgcgcaaaaggattgcacgtcaatatattagaagaatagagtttttgttacacgacgcactcagccagaccggcctatgccaaggactgagtgcaataactcaggcaataactgactcaaattaccatgctggtggtctagatttaagatatgtcgtataggctttaggatctagttcaccatcgatcccatcttcattctgaacatcgggtatgcgttctgcatggataagtaacggccttttgtactttgccaatgtaaccaggccctcctacagtacaaaaacaggaatatgaactcttcagggagttgataagctgaattatggaactcttgtggtcgcaaggtaataaataacagaattgtcaaagcagcgcacctcaatatgagttgaatttgtcatggggaagtcatttatacctgaggggcacataaatgactaaatcaagaaaaaaaagatcaatcagtgtatcattctatcatttgcttatttaaagtaaaatagaataaacagagtgacatgatggcatgataaggacgttacaatgacatgaaaaggacgtgaataaacctgtgggatcctagtactaaccaaacttactttggagctttgcatgcctgaaactaaggcttctttaacaagttgagaagatgaataaacatgtagaacaacagaagttgagtgattactcttgtaagtatgaacaaaccttgagccctaagacgcctgcatttaataggctctctagtgcacttggattgagggcattctctggaacgaggcctccccagaaccctgtttgagaacagcagacaagtcaaaaaaggtcggaccatgaaacaagtttagatgcagaattactgttattatggtggatgagctgtttttacctcccttggttctctacttgctaatgtgcaatgatactgaaacgtgtaactattgcattgcaacttacctacatcaacatgtagtttatccttagctgcatccaactgataatcaagcacgtaatgtcagtgttgactaaagagaaagcaggtagtagcaatttgatgctttatatactgatattggtacgataaagaaacactgaccttcagcttgagagtttcttcagaaacagttgacgggtagctattaagaggcatgtccactaatgttgtaatgccacctgaaatgaacaaaccgtgaaactttgagcaaaaagtctgatctctttctgttattgaaaagaaaaagaaaattgattactccctactaactcggt

SEQ ID NO: 90823 - DNA, 2739 bp, Oryza sativa
cccccttcattcagtggaatatagttaaaatttttaattggtaacttgcagtgctgtttgtgtcaatgctagctgcaatgagtcatgtactcgtgtttacagtggatcgttggtgcattccttgctcagaagtttgtgttgtttctgttggtgccctaggagcattttattcttctgttgataccaatctgtgtgatttagggctaagattcattccgattttgattgcacatgaaaaaattttggcttaaaattgctgatcactttgttttctagcatagcttagcttacttgccataaaaattctcaggcataagtaaatgtacggaaatatgctacaaagatcctgttttggaagatcaccagtggagtgcatatatcgatcggtctccaggacaggatagctactccttggtgagtttgtgatctgtttgtacaattcttataatttccatattccttttactgaaagtactttggtaagtgataacccattcgatggcatatgtttgtactgtatactgctgtcacagcgaaagattaggttgcattttgctgaccgaaattataatcaccctcacatgattacttgatcataaacaggaagttatagttgtcatatcttctataagaaagtgcatatatttaccatctgttgcatgatggaatagaattaactgcactagttgattttgagtaagagttgtttgttcaagattttgtatacctttcacatgattatcacagtaaagatcagtacatcagactgctgttgtatggtccgtagtcatcatactacaagtttattgggttgcagtaacataatactgcattttgctaatgctttggtctgatgtagataactagatactgttccatacactaaccagaatgcatgggtggtttttgttatagatagtttgctgttagtatgaacttgttggttagctgtaggaaattgggaacggtcattgacagtcagtttattgaatagtctactgctaatatgcagagtaatttatggtaagttcgtcggaacattctcattgcaatcctttttactgaaaacacggagtattcagtagtctattaagctccctaggcaaatcatctggcaaaacaaggaattgctcatgatgttttttgtaacatattgacgtttcttgtcttcaggagtgcttcaatgcttgtgtttctggatgtggatatagggtatgtaataaaactctcaagaatggcatataatttgctggtcataattcaatccttgtttccatattcaccactatttctcttttgctgtatgatagtttgacataccagcggagaaagtggagcaaatcaaaccaaacaggccatccaagccaccaccaccaccacctcctgcagtagagcgggccacgaattcagaacctgctgtgaagggtgaagacgtgccttgcacatcagcataatagtaatctatgcagccccaaattttgtgtaacttttggtgcttctttccctcatactgcctccttttttttctcttttctgggctgtttctttgcaccatgtgcttgaaattcgcagtccaccttaggctgggctagatgctaacaagatcttaacgataaatcccaaaatcttatttatattttcatatgcttgttcatccacattgtatgttagtatgctccctccgttcctttgtggatggcgccgttgttaataatacttatagatggtttatcatatcataaacgaaagctttgtgattatatttaggatgcaacacacttggataatatagaatcatttgaagtgtaaatgatctttttattaaaaaaaagacaagctctaaagttttactatgaatagtgcccggtgccatgtgactaataacttactccctctgtcccaaattagatgtcgttttgattttttttttgcaatgtttgacaattcgccttatttaaaaaatagtgcaaatataaaaaaagataagccatacttaaaatacttttgataataaaacaagtcatatacaaaataaataataacttcataatcttttaaataagaaaatggtcaaacgttaaaaaaatgataagtattttggaacggatgtagtattaatttgctgtcatcagaagataattacacaagctaaaatcgccacgaacaggaggtatacagggtagataaaaccagtagtgcagcatttgccatagatgctactatcccctgacgatttgctctccagcagcagcatggcatgtcttctcctgcgacgccgagacctccacttttcgagggcgtcggggaggggcatgaccaagagaggggacatgaggcggaacacgagcaacttccgcagggggcggaggtggaagaggccgagctcgacgcggcgctcgcggtaggctcggaggacggcggcgatggcggcggtggcggcggcgatgtccgggaggtggcgcgcgtaggcgtcccaggtgcggatgccgtcgacggcgtagatggtttggtcgaagatgagcaggtgccaccggagccacacctcccggcccagcggcgtcgtcttcaacctctcgccatcctgcatggacatcgtgccccccggggttcgcaccagcagcctgaatcgcttcctcggaatcttgaaccttaacgccgccattgttcttgctcttgctctgctagctaattcgtcgacgcgcgctctgtatgattttcttttcttttttttttttttta

SEQ ID NO: 90824 - DNA, 2510 bp, Oryza sativa
cagcatgcaagggtaaattatctgggcagcaggaagtattcctggcccatatggttccacatacttacaataactgcagaaaataatagcgcggcaacttttgtgtaagaaaacactgatagatatttagacaaaggtgaacaagtcttgcaagtgaaagaatgcctcgaatatatatgtaaacagtagagataccttgccattcttttcatggtgtattttctggaaacatccatagcaaatggccagtagtcgacagcgtgatgattcaattcatcagaaaaccatatgatctctactttgtcaaggtgcatgccaactgccttccacatcatgatattgtagcggataatagcctgtattttgtttaggttacaggtgaatctagggttccgctgcggaaaccaatctgctatcaatattttaactgtacagccagctctaaccattttgttgacatagattgtcttcataataccctgaaaatgataacagaccatgacctagttatctgtgagcagtgtttgaaatgcaaccagagaattggatttgcataggagcacataaaaattagagatccacgtctgaaccatggcatagaaatcaagcttcttgtactactacaaatatactactggtattatattagtaccaccattatgtttttatgatatttcttggttcatacccctcttgatgagtttcatcctagcctgcccaacttgtccttaatatcaggggctaatggcagaaccaccaccaccactattatcttttatactgtactctctccgtttcataatgtaaaactttttagcattgtccacattcatataaatgttaattaatctatacacacatatatgtctagattcattaacatctatatgaatgtgggtaatgctagaaagttttacattatgaaacggaggaagtagtatagatatatattttctaagaccgacataaccttttttcttattgttgttgctatacctgctctatgcccatcatggaggttggctcaaaccaaacacagcagatgggattaggcttcttcttcagtaatacgcgtagctcatcctcgcatatgcactcctccgcaatgctcctcagaagtgcaaatttctcatcaaatcccatctccatggtatccctataaaacaaagaccaaattcacatgtgatgtcattactacaacttgaggggaaacattacgatttgtaaattttccctgatcggtcgtcaatcaatatcgtggcctgggacagttgaactctagaatataataagtggggaatttgagtatttgcccgcccctaaattcgtcgcatgtttaggtttaaaccccaaaaaggatgaaactgatgatttgccatattttgaagaaaaaaaaaatctttttaccaaaacccttttccaatgcgaaaagaccatgttcctgctgaaaggagaggatagagggcgtaccgacggagagggagacagcgtcgtgaaggggataggaaagcggctccaccgttgtgtagggagaagacggcggcagcagcagcgtacggacagatggcgttggcggcgtaggaagaaattacgaggaagaaatttggttaggtcgacggctggttggaccggcttgctttagacttggagtttttcttttagtgggctccatgccattataatttattagttttttaaaaaatatcattactactcgctccatcctaaaatataagcattttaaaaagttgagactgaatgatgtctgttttatggtttaagatggtaatttacaccgctgctatagtttaggggtgtaattcggattatttcctattttcaacttgtaaagcaaacattcctcggttgtgtgggacatcgataccagtgcatggtgtagttttttttttctttttaactttttactactatattcaatgaaacttcacgctatctaactggcggttcgttaaaaaaataaagctaacataatggcattaaatattgacagattttataaggtcaaaaattgttgcccgtgcaatagcaggctgctatatacgtgccaactttgatggattgatcgaccatcaatcaaccaaactaataatatatattctcaacccaccatatatatttattcatagacatgtataactatacatatgaggccatatgttgatgctgcgtatagtgtatcttgatacgttattcatacaatgtatgagtcggtttttaaatccgtttgattttaaaaatacaaatctatatttgagccaggttttaggttcgcttttggaaatacggaaggagtcgtataagatatatttttaaaaaactcgcatgctaacttgagatgatcaggctcttaattgcagcttatgattttctaaaaagtatatacccaagtgaatttccacattgaatttcatcttaactaaattatataacaataataagattataataacattcacccgttacaatgcataaatatttttttatagtat

SEQ ID NO: 90825 - DNA, 572 bp, Oryza sativa
ccccggcccggcggagtctggcctcctcccgagcggccacctcagcctgggaacccggacggcctctgggcagcctcctcggcttctcggagacggtccgcggcttctcgccggtcagcttcccgcctccgggcctccgcggtcgccgtctcctcggcctcagaccggccggacttggaagggcggggggtgggggggggaggggcgacgggatctcgctgaggcggaagaaaaaccagaagacaaaaagaaacgggtgagtgaaaacttgccttgggagacgggagaatgaatatggccgcgatgggcgcggggacgaacctgcggggaggtcggctaaacgaccacctcgggggcgagatgaggttcccccggcatggcacaatcccccccatcttgcggagccgtttcttcttcgctccccctcgggctgcggcgtcggcacggcaccctccgggcgcctgctgctggcacgcaccgccccgtcccctcggggagatgggggaggggtgccctcctgcttcctcttcccccgggcgtcggcagggcggctgccccccgggcccccgtcg

SEQ ID NO: 90826 - DNA, 1495 bp, Oryza sativa
cgcctcgtctacggcgatggcggtacgccccagggcgcgctccaggctgcgggcgcgctcttgcgtcacccgcccgtcgtccccgatccagagactccagcccgacgttggctggatgacgtggccgacttggtcatgacggcgcagcagcgactaggcgccggcgggcggtcctccgccaccgaggcctctggcgcagccgccgccggctccaagtcgtcgaggcggagggcgcggcgagcggcggccgttacccgccattcgtccgccattccctcgtcaatgcctccaacccaagaagatgtgcgtggggggccggatgcccgcctcgatatcgagcgccagcgcgacgctcgtcacgccgcccgcgcaacggagggcgcttcctcgtccggagcgccgcttcggtctgggcactggtccggccccccgtgtccccggttggcggtgccggctgtcgagcctttgtggcgagccttcggaacgtccgttggcccccaaggttccggcccaccatcaccgaaaaatacgacggaagcgtcaaccccgccaagtttctccagatctacacgaccgggatcgaggccgccgggggtgacgacagggtcatggctaatttcttccccgcgtcggtccactcttgggagaatttgtgccaagcagttcaccacgaacttccagggcacatatccgcgcccaggcgaagaagcggacttgcacgcggtacagcgaagggacgatgagtctcttcgctcgtacattcagcggttctgtcaagtccgcacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcgggccctaccatgaggcg

SEQ ID NO: 90827 - DNA, 1469 bp, Oryza sativa
tgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaatcttgcataaccgagagggtactggacgggtggtgagatgggcaatcgaactctctgaattcgatttgcgctttgaaccacgccacacgatcaagagccaggccctcgccgactttgtggcggagtggaccccagctcccgagcccgtctccgcccccgaggccagctcgggccccccgcagctgcctcacaccgcctactgggtgatgcagttcgacggctccttgtctctttagggcgccggtgcgggggtcacgttgacctcgccgagcggagatgtcctcagatatctggtccgcctcgactttcgggcgaccaacaatatggtggagtacgagggactccttgcgggacttagagtggcagctggactggggatccaccgcctcctggtgttaggcgactcccagttagtcgttaaccaggtctgtaaggagtaccggtgctttgacccgtagatggacgcttacgtgtgccaggtgcggtgtatggagcgccat

SEQ ID NO: 90828 - DNA, 2246 bp, Oryza sativa
ggcttgcccagccgtcggcgcgacccgaccccctaggggagacggacgcgcctgaacggcccctgaggcccgtcggagtccaggcctcgggacccgagggaagcgctcccagctcccctagattgattgcttggatcactgagatccaggcatacctcgtagataagactctacccgaggaccgcgaagggagtgaacgcgtccggtgcatctccaagcgctacgtgctggtggaagggaccctctaccggcgcgcggctaacggagtcctcctgaagtgcattcctcgggaacaaggcgtcgagcttctcgccgatatccatgaaggcgagtgcggagcccactccgcctcacgcccttggttggcaaggcctttcgtcagggtttctattggccgacggctctcaacgatgcggtcgacctggtccggcggtgcagggcgtgccagttccacgccaggcaaacccatcagccggcccaggccctgcagaccatactctttcgtggccatttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcgatttggggtgcctaacggtatcattacggataatggcacccaattcactagtgagctcttcggtgactactgcgaagacatgggcatcaagctctgcttcgcctcccccgcccaccctagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtccccttgggtcaccatgtattgcgaggctgatcaagatcagcttcgccgagacgacctcgactacttggaagaacgaaggcggcgcgcggccctacgagccgcgcgataccagcagtgcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcgcagagctgcctaacccgtggaacatcgaacaccttcgtcgcttctacccctagtgggggtcgggcgtcatgtctcgggctcgggccaaccccgcaccccccgggcgtgcagggttggccgggggctaccacatgcatatccttatcttttttctcttccgtatttcaataaaagcattttcgatttcctgaggactgtgcctgtgccatcgtttccttttgaagaatcttggcttgagttagcacgctcgtgctcgaccctgccctcggtggcccgggccggctaaaatcgccaaacgaggcccagaaccgagccgtgccccggggcgtggtgaactccggggggggaatcggcaaaggcccacaatcgggtcatccataaccctcggtcaccacgctcccggcctggccagtctcgacatgcggatctccccaggcactagcccccacccgcgccgcttgaggttgggacctgggcacgagccctcgttcaagccaagacacagaaggaccgcggcacagaccatcctcgtctcatacacacaacaaacataactgacgcagaaatttcctctttacttgattacagattaaatcagtctatacaagaagggggcccgaaggcctcggaagaagaaggaaaagctattaagattggcgggggcctgggggctcactccggcgcccccgggccgtcggcctcgtcgccactgtcgtccgcaccgtcgtcaccgccctcctcgtcggagtcgagcgcgaacgcgagccgaggggccgtaccctcgaagctgtggacgatgtagtcggcggcgtcccggacccgcgcgcgcgcgccatcctcggttccgggagggaactcttccagcgctgcccacggggagaagtcagggtccctggcctggtagcttgccagtacgagctccaccgcccccggg

SEQ ID NO: 90829 - DNA, 3230 bp, Oryza sativa
acgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctcctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtggcgacaacgactttcagattgtagcatcagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctcttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatcatttcaactgaaaaagtcatcaataacaaagttatataa

SEQ ID NO: 90830 - DNA, 1717 bp, Oryza sativa
ggacaggaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaagcaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattttat

SEQ ID NO: 90831 - DNA, 1157 bp, Oryza sativa
ctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactcttcaaaaagtgggagaatagactctcctagatcactgacttcttccatcacgtccttacgcgcgtcgttagccgtcccctgatccaaaatcctttggagatcgagctcaaggtgcgccaaccttatgcacgcgaggacatggcacgtcccgatgtagatcccgttggacgtctcctctctgatcttggtcgcatgcttggaggggatcgcctccatcaccgtcgccagttccgcgagcgaagtcgtcagcgagaactcgtcgggattcaccggatggtggtcgtgacccgcactccccggcgagctggtgcagaccggtgtaggtaacccacagcgagccacggatctccgacaggttgttctcgagctccgacatacggtgctcaagcccctgccgttaccgttcgttgccggccaccagctccctcat

SEQ ID NO: 90832 - DNA, 657 bp, Oryza sativa
tcctgcagccccttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggccggcagaaagtgcggcggcaggccccggaacgtcaagccttcatccgcgaggaggtggcgcgacttctggaggccggattcatccgtgaggtcatccatccggagtgactggcgaaccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaagaaaaaa

SEQ ID NO: 90833 - DNA, 970 bp, Oryza sativa
ggaagcttcgaataataattgggtaaataaaaccaacaaagcaacacagtttatccatcgcacaagtccgtcttgtacttgctttaactccttcgatactccgactcaactccttcaacgttggaacccttcatacctgtggagcaaaactacgcataaaccactatatcgaactaatgacagatataagggatatttactaaaatcgataacctgaacatataaaataacctatagcagttcccttactattttatacgtaactcacaaaccgtctaacggaatctagcaaataatataacttcggacatctagacaaaattgtctacaaccttcatgttgagtgaaaaatcagattatgcctctgaaaatcccagattaaggaaaacgaatttgctgtcctgatttcaggacccggtcagcagtactatttctgttgtttgtcctaaaccgtttatcggaatcgagcgaaaccagcggcgttagaaagatatcgtcgatgactacaaactttatttaggacaactaacctgaatcgtgaaggtttaatgtcagttttgaaaataccgtttccagcccataaccaataatctcagaaattgcacaaactgccaacgaattaattcctattgaaatcttttacatctagagactaaaagaaagtccaattgcagagaaacactactttgcaacaaatttccctaatctgcgaaatcgctgaaattccccaaagttgttctaccttttccttcccttgttactcctgttcaactgcttcctgtgctgtctggagccttctcgtctctgatcgatgcagcagcgtcaagcagcaagccacgctatagcatgagcagcagcaggaacgttagcatgcacaggcagcggcaccaacaccagaacagatccaattggcggcagcattagggaaaacaggaacagcagggaagaacacagcagcagctcaccaagg

SEQ ID NO: 90834 - DNA, 707 bp, Oryza sativa
cagtacataattcatcaaagcctacacagcatacaccataaaagttcacaacccataaagtttttacaagcaacagtacataattcatcaaagcctacacggcatacaacataaaagttcacaacctattaagaaatagtaaaaatagtatattgtcaacggtgggtacccgtagaccagatatagagggtattggcgtacgctggtacgatgatctacgtaatacaacatcaaggaaacaagagacaaagattatactggttcaggccccttaataggtaatagccctaatccagttgatatgggattatatggagagatccaaaaattacaaagggaataatagaactcgatgataccgatgagatcgtagtcgagttgattcaactagatcacccgacgacttggctcctgtaggctccggctttgtaggctgtggtcgttgtattggctatgagattcgatgtgttaggtcctcccggggggtctcttttatatcgcaggtcaggtggtctccaagtaggactcggagacatcggaccctgcacgatacagtgatgacccagtcctatacgggtaggaacctttccattggtggacttcgtgatgaattttcttagcgtatacagagaacgtccgtacacgcgcagatgtaccatattgtcgtatagtgtacatccaagggtagagggtataccttatccgta

SEQ ID NO: 90835 - DNA, 1440 bp, Oryza sativa
ggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcggagaaaccagtcggcaacagtcaggtcagctagcagtgaagatgtaggcgcccaacaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcttgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcaccagacgagacgaccggcgatgaagatgtagatgcccaacaacagctgcataataggccaatcaacactgg

SEQ ID NO: 90836 - DNA, 1044 bp, Oryza sativa
cggagaaggcaacccggtccgtgaaaagttagacgcccaccacgggcagcataataggccagcggtgcagccgaaaacaccagtcgccggcgttcaaggtggccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcagcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcagcataataggccagccgtgcaggcggaaacaccagtcggcggcggtcgaggtggccggtcggtgacgacgtagacgcccaacaacggcggcataataggccagacgtgcaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaattgcggcataaaggccagccgtgcaggcggaaacaccagtcggcagcggcgaaggcaagccggtcggtgaagacgtatacgcccaacaacggcggcataaaggccagccgtgcaggcggaaacaccattcggcggcggcgaaggcaagccggtcggtgaagacgtagacgcccaacaacggcggcataataggccatccgtgcaggcggaagcaccagtttgcggcggacgaggcggccggtcggtgaaaacttagaagcccaacaacggcggcattaaggccaaccgt

SEQ ID NO: 90837 - DNA, 866 bp, Oryza sativa
gaagtcgtggacgcccaacagcggcggcataataggccagccgtgtaggcggaggcaccactcagcggcgacggaggcaagccggcggtgaagtcgtagacgcccaacagcggcggcataataggccagccatgcagacgggaacaccagtcggcggcgacggaggcaggccggtggtgaagtcgttgttgcaatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagtaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaatatcaggaaatcaaacaatgattaaaaattaatctaatagagattaaattgcaacggtagacccgattgaagatttgagccatcgaaattgatgagattgatctcggggtttcttctgaagttgattccatcgcacttttcgacaggtaattcga

SEQ ID NO: 90838 - DNA, 1598 bp, Oryza sativa
atggataatgtgcactggaatatggattatggggaaaacagatcatgggtccagtacaattagaggacgttaggtgcaaattatgcatggggttcctgttccttccgtacctttcttgggatcatgaacccacagaagagattccacagcgtgtagaatggagcagcaataataggcgcaacagtgtggttgggagtgatcgccgttgtcatcatgccatagaaagtgaagtacagcaaggtgaagtacatgaagaacaggtaccacaagaacttcactgctgtccactcgaacgagcccaagctgtagaaaatcgtgccgtagataagtgactgcacaagaatgtaagggaactccactgtaacctgcatgccgaagaacagttcgattgttagccttattatggtactactacgagcatcaaaacatgatgagatgacaggagtttttgacagggaaaattaccagggagaatgcaaaaggcagtgccgagtacatcccagctgccctctctctgtacgagacaaatctttcgatggaaatcacaggttgaacagaggtggcgttagtgattcctatgaagagtactgctgcgtacatggcacccatggcattgaatatgtcatgttgggtctccctgtcaaacaaagccacatgttcgctataaggccagccaagtacaggaagaaaagtggagacagaatcatcagtggacataccttcgagacccaaatttccagcagattgtcccgaacatcaaggaaatgatgacggtgtagaagaatcggaccgcagtgtattgaggatttctccagtacgacaggttctgcttccataagcaagcagcatattgagcaaagaatggttgggaatacttggtggcaaaagtaagttcttttgattctcttcttggtctgctcaggatatcaaccatttcttgggtctgcctggaatgccataacataaacatgtttaaggaaaaagagaccaagatttatagaggtgaaaagggtcgttgtgtttactgaaataattttgactgccggtagtattcagcaaaatccactccaagaatttgctccatttgagtacttgtgacttccaacatccatgcagcaggattatagccatccctgattttaggaactcctggaattgcctgtttacaaacttgaaagtgtaaggacagttttttcgcgaacgcaaagtgtaaggacagagaaacttgtataagctatcatcactgaggaaacacattgtgcagattgtacctcaaaaaactcgaccagattgcgtgatttcgagcccaagggaccagcatatataagttgccccccacgcttcatgaacaaaagctgaccagcatatgaatgagttaggaaagggtgctggttaaatgttagtacatacttgtataagaaaatttcgcggtttccctaagtagcacaatgaaagttcaacagatcaagtgtaaaagggactagtttctgttcacatccatcattgataagaaaactgattaacatcaaattatgaacgattattaaaatctgtactgttgcttcgaaaaaatatcaaaatctgtgctcaacttgtta

SEQ ID NO: 90839 - DNA, 1167 bp, Oryza sativa
tcctgcagcccgaccactacagcacccaggatgaattccctccagcagctaccaagcgcgagcaaagaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccgtataaaagttcggcatctttgccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaact

SEQ ID NO: 90840 - DNA, 886 bp, Oryza sativa
taaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgttgttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatat

SEQ ID NO: 90841 - DNA, 670 bp, Oryza sativa
ccttgcccattcccctgtctccagagcacctagctgggcacaggcagtgaccacactgaccatggtgaactcatctgctctcaccttgcaaatctgcatgtaacggaatgtctccaatgcgtccctgaacctgccaacctgtacatagccatcgatcatcgcggtccatgcgatggtgtctctttcaggcatatgatcaaacaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgcc

SEQ ID NO: 90842 - DNA, 678 bp, Oryza sativa
agcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaa

SEQ ID NO: 90843 - DNA, 572 bp, Oryza sativa
tgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatg

SEQ ID NO: 90844 - DNA, 1052 bp, Oryza sativa
acatgtaggtagaatgcttaatttgtttaaacaccaacgcaacaactaggtgcattatattcagttattcacttggcagaagttaagcacaaatcagtgtagtaattaactaactagcaagcaagcttgcttgacagaattgtcaaacaagaagactgctaattatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgggggagcaggaacatgtcctgggcgagcccgatgtactcctccagcgtcaccgc

SEQ ID NO: 90845 - DNA, 2924 bp, Oryza sativa
caagtcggactgacgagccgaggaaggtggtaccctctctcgtcatagacggtagcagagacgagacatgttggaggatgcaattggaacccttgcgtcgccaccctcttctcatctcctacctcgtcaccatcactgcacctttctaggtttggctcgccaccatagtcgcttggatgattccttcgatgtgggaggagagcctcttgttgatcaactacaccgccttggggctattatggccgtcgtacacgccgacaaggccaccacctgcgcctggtcctcgagtgcctcgttgacctgggccatggcgacaaagtagtctcccaatgcaggaagagaagagggtggggacaaagcagtctcccactgtagggagagaaggaggggaataaaggagagccctgacacgtgggctctacctgttgatgctgccaacataccacgtcagtagaaaccgtttctaaaaccaacaaagaagtcaatttgaaccggttttcgaagatggtagatgtattatacctggttttacggttgagggaagcaattcaatcaggagcgagagtgaggaagtcatgataaacttattccttttctgagacggctgttaaatacggcctggcccataatggtccatcactagtatagctaaaactgtattcatgggcctgcagttgattgcaggctaaaaccgctgtaatactgcgtaatcatcaaagttcatttttaaaagtgtaataatcaaagttcttgcaaataaaagagtcaaccgagttgatatgtttgtctccaaaaatattctcctatagtcaaaatatggtgaaaagggtgttatttatgcgaagaattaataaagaactaaattgactttgaccagtagacttttataaaacatcaagaatctgaatagccatcgcaaaaattcctgaaaatcgatgcggctgttgcttttcaaagtgtcaggattgcttctacagcggtaaagctgcaatatattccctggacgataatactatatgacgtttcggacaaacaaaataacttgcgcttaatggattttagctgtcggaaatatcaagtaatctttgccggatggagtacttaggctgcgttcagaaccctatgttcccagcacaagctgtgcacacgaaaaacggaacggtccattagcgcatgattaattaagtatttactattttttttaaaaaaatgattaatatgattttttaagcaatttcgtatagaaattttttgaaaaaatacacctattaacagtttagaaaaacgtgggcgcgaaaaacgagaagagaagttggaacaaaggttctgaacacagccttggtaccaccaagcatatcattatcccattggaaaatttaatgtcatatgctatatttgtgcataccaaaacataacaactactattaattagaaccattcacatataatcacattaattgcagaagcaaaccctgcattatgcattattggtggctcttcacaattctcaacttaacaacaacaacaaacataatctcccaaacaattacatctagctcatatttaatctctccaccatcacataattttgatatttactactagtactaccggattattaaatcaggaacagctgagagtcccaaaaaaggaagaaaaacaagagggagaaaaaaaaaccagcaaaagcaaaagcaaagtaaagccctcacattatccatcgatccatagttccatacatatgcatcacatcaacgagtgagacaagctcaagctcctgctccttctctggtcggctcggctcggctcggctcccgttctccgcgcgcgcgcgccaacaaaaaatcacttttccctttttccaggtgacgctaattaatctcccggattagcgcgattaattaagctactagctagtattattactaatgagtaattaattacgacgcgtggtgatttgattggttggtttggttgattaattagtagttaatcgctcccgcgctcgtggtggtggtggtgttgatctcgtcgttgtcgtcgtcgccgtcgacggcgtgggcgttgttggtcgccgccatctcgtcgtcgtcgtcgtcgtcctcccgctcctcgccctcgccttcctcctcgatgctctcggacatgtcccttccggctccggaggcggcggcgccgccgccgccgccgctgccacggcggtcggagtccggggacccgagcctcgccgacgccgacgacttggcgctgtagggaggggccagctgctgctgaggcggcagcggcgggggcgggggctacggcgcggtggtgcaccagggcggcggcggcggggtggtgctgcaggtggtggtggtggtggtggtagtactcctgcgccgccaccgccgccgtgtagtgcggctgcgtcgccgggtgcgcgccgtagatggccggccccgccgcctgcgtcgcgtactccggcggcacccagatgcctcccagcaccaccagctgcggcgtcgctgccgtcggcggcgccggcgacggcatcggccgtcttgtgtgcaacctgtacttctgcccaaacaaaaaaaaattcagatcaaaatgctcattatggcattcatgtctagcaatcagttaatcatactgtcttgtagtcaatgatcaatttaaacagtatttaattaagaacgtacgtgagatggatgaattgcatgatgagatgataattaccctacctggagatggcttttcacctcatcattggtcaatccatcaaccttcatcagctcgcgaatctgcttcggggtcgccactttaatttgcaaagaacaaaacaaaaacgcaagctcaagattaatttgtttgttgtcttttcatctttggtacggcatgtaatcatggtgttcgatcttgatcgagttacatgtgtaggtgta

SEQ ID NO: 90846 - DNA, 534 bp, Oryza sativa
caccagcatcggcggcggtgccgcccacttcccgccgctgacgttccagcggacggtgcacccgatggagctgtggagccggttcggcgtcaccggcggcgagccgctgagcttggcgtacagctacaccaagaccaagcaggccggcgagttcctccggcgaagcgagccgttcgacttcggcaccgtcatcgccaagtcgctgctgagctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgac

SEQ ID NO: 90847 - DNA, 1176 bp, Oryza sativa
catatcattcttctgaagatcacaacactgctgatgaaatcgcttcagacgagcaccaaatgcaaagcagaattgatgatgagagctgcaggaatgagatcaccgaatgctccgatgagatcgtcgaggtcggtggcgatggtgctactgagcagcaggacaggtgcaggaacagctttgagatcaaggagaggggagaggagaagaagatctggttcccaaggtctgacagctccaggggtttcaggtctctgccttcctcaccttccaagatccttggaatgagaaggggtgtggagtgcatgagcaggaagcccaaggtggtcggcgacgacaatggcagatacggctatgaagattcagtgtccacaagcagcagcaagttcctcaccaggtgcaagcaagccatcaagaaagcagtgaacaaataaacaattctttgcaccatgatgcagcacatttcaacctgtttattcttcaaatctgtgtgtttaaattcgtgtcaaattgctagttttgttttctgtagctgaataagttagtactcaagtgaggcatacatagctttgcagagttccttctgcaactagtgagacagacatttactgttcatggtcactattatgtgatcatactggcgttgtacaactatttgttgatttatttatgaagagaaactaaattcttaagtccatttcgtcctcgaccaaaccagaaatcttatatgcttccctctctttttagaacatcacagatttatttatgcactcaagtgagcagatttatctgaatggtttcaccacaaacaatagttcagacagaaaggtaactgactgtaattaaaggtagtaaaacagattaacgacccacttagccatcagctttggcttcagaatttcagatcctctcatgacatcgacttgcgccatttcggcgtcggcgtcgcggcggcggcgccggcggcgccgcccctgcccttcttcccgctcgccggcgtccgccgctcgatgccgctctcggagtcctccacccgcgcgacgtcggcgctcatgccgccgaaccataacgtgctccacttgaagaacccgccgccgccaccgctgccgcctccgccgtgccgcctcctgtccgtgctcagcctgtccacctgagcctgcagcgcgctgcactggacct

SEQ ID NO: 90848 - DNA, 1076 bp, Oryza sativa
ggggtttttttttcactttctagaagtccggcaaccatcttacacgtttgcttcatggcctgcctatcatccctccttttaatcattattaagattctatttggtgttttactaatagtttttatatgtcgtatcaaccgccaccactctactcttttataggcttgttacttaatttatctcatcgtatgttttatatggtcttttttttcaatagtctttatttttatcaccaattttagttatttataaattgtattcctaattgaaatattttttatttttcttattttagaatttattttttaaaaaaattatttaataccatatagcattcttttaatatttttattttttatttttgaattttagttgtttcaaaattgtattcttacttgaactctcttttagtttttctaattttggatattattttatttctttattctgaattttaattaatctcgtattgggttattatatggatccttcttttaatattgcttatttttaattccgaatttcagttaattttaaattgtattcctacttgaactcttattttctttttgctaatttcggattttatttttatttttattccgaatattaactaatctcgtattgggttcttatatgtactcttctctcaatgttccttatttttaattccgaatttcagttaattttaaattgtattcctacttgaacttttattttattttctaatttcggattttattttatttttatttcgaattttgattaattttgtattgggttcttatatggacacatctttcaatatcgcttatttttaattccgaatttcagctatttttgaattgtatttctacttggactctccttttctttttctccgattaatgtgagaatttctagcttccacagcgaacgtggtgcctcctttcaagactgttttaataatataatagatagattatttttcttttttcactaatgcgcaaaatgattacatatcaatataatagaagaagaagaaaagtaaaatagaagaagaagaaaagtaaagtttaattacacaacacaagcag

SEQ ID NO: 90849 - DNA, 2644 bp, Oryza sativa
acaacatcctgatgcaaaatgctagaatctggtctggctttattgaaaggaagaaactgtataccccttggtatacgaacaggtaccttttgagcatttcctgatatgccagcaaggtttttaaggatggaatgatgtttgataggaacagaggttgcaggttcaccactgtatactgttgaagttttctgacgacttgtttgctcttggcaatttgctttttcaggtactgatgacgcattagatttctttgcatctggtgtggacggaccttctgcagttggtatctgacaacgagtgcaaagcttgcttaattcacagcatttgctaatattaaaatttaaccaggctataacaccaataattaaataagagtgaatgatttgttaaattacgtaccacatgagaaaatttgcatttatcacctctgatgcacattccattttccataaaattgtggcaagggtactttgacaactcatgatcataagggcaatcatctcctttcaaacaagaaccacgtgcataatgcgtgcagggctgtcaaggcaaaaaaaaaatcaggataaaattcgcaaaacctcaaaaggacagatacaacaggaagtttagtaccaatacttggatcaagatttgggtacacttcagtttatgatttagcactatactgatacgtattcataacatgtgcagtgcgaacctgttctgtgcatgctttaaagttcaaattcaatattgatgtcacattttcatctaaaaaataggtggtatgcataggtgcgtacaaaatgagctcatgcttgcgtgtgggcagaccacatagaatatatccacacatattaaacagcatacatgcatcttattataatacattatgattactgcaagcatgtgataaacttctatgaaatggataccttagattttgtcaaaggtgtcgtatcatgggagaacttgcacaaattgccctgcaataaaaaaataagaaatattaggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaagtaaatcctgtgaaaagcatttttacagtctttgtaacatatttatatagaaaacataacacatatacaaagaataaagtggacatgttacatgatgaaaacaatatgattatataaacagtgttcatcatggtctaagctctcaggcagcacaccagcgcctaatcagcaaatagacagacctaggcagggctaatcgttaccaggtgctatctagtggacactgaatcaaaatatgcatcctatgctactgatatggctaatcactaaattacacaaatataatcagtgtgtccagaaaatcgctacaatatgtttcaaggccagggcatgtgctgtgcagtttacaacagcaaagaatataattttttgtcgatccaaaagtgaagcagatgatgactaccatctgtctgatctgagagacagactcacctgctggcacttcccatgcaagtagaagtggcaaaccttcaccactttaggctttataactggttgaagtttcagtcttttcaccccttcggcttcccgttgcaatgctctcttaattcgattagttctctgcatattaatagcattgaaagcaaatcttaatactttctataggtaacaaactatactgaatgcacacgttcaaaacaagtgtatactatagcaaccaaatggtcactgagatcagaacataccgtcttcttagctattctctcctctgtcaaggtgacgcttcttgtgtttccatgtttgagagcctgcaatattaatatagaacagactgaaaatccatacttacgtagctaagaagaaaatcttaacacagacgaatcaattgtattgtatattgttcttaaaaatcttgcattgtaaattgactgtgattaacttgaagttacaaagaaagtcatgaagtgtgaacactcgaactgcattcattgtactcaagcaaggtatgtatgcgatgattaaaaaaagctactgaattcagttaatatgaaacatcaaacaagaattaatcaaaattgtgcataaacaatgaagcaacaaaacagcgtatgggtaccaaaaaaagagagaatatggcaagcttgtacgcatttgtggttgacaaagaagctataccttatcatcaggcaaaggtgtctcattccaatcgagaacttcatcataactgactgcttgcgccctggcaacatgcatttgagaatcacccttgctattacatagcatgttccgtgcagtgtcgccatttcctttttgaggtatcaaatgcaaattgctctttaagtcatggccacatgacccatcctcctctatccttctgctatcaaaatcctcttccaattccacatcatcttgaagctctgaattgccagaatcatctgcatctaaattctgcgtgtcgccctcaatctctccttcctcaaaaccaccaccaccatccagtgacccatgatctaaactgcacacagatctgtcattgccaatcc

SEQ ID NO: 90850 - DNA, 2408 bp, Oryza sativa
atagctggctttctgggccttttcttgaccttaaagcaatgctttcggaacgtctctccacttggatcgagtgttattattattaacaataatattaaaggccttgatgccagcattcacttgttcaatgaaccaaattaaccacttcattttgaagtgttatatcatctacataaacatgatcatgttaaattttagttccttcagttttttattccctccttttcatattataagacgttttgagtttgtcctaagtcaatttcttcaagtttgaccaagtttatagaaaagcataacatctacaacaccaaactagtttcattaaatccaccatcgaatatacttttaagtatatttgttttgtgctgaaaatgttgctgcatttttctataagcttgattaaacttgaagaagttttacttagaacaaacccaaaatgactaataatatggaacagagtgagcattatgtttacgggtggtaatgggcttggcccatgggtcctttcacagcccaattttctaggctaaaatgttgggccctttaccacccttaattctgttaggtgtcatacatcaggaattcaggattacttgcaaagtggcaagttctaccttgtattaaaatgcagctgtcatgtgtgtgagcactgagcagcaaccatgaaactatagcagcagctttgttggttgtcatctaatctcctatttgcaaatcttatttagcaacctggagggatatgatattatctggttgagaatgtctatctccaattgttaatttgttaagacaagctctaaatacacggacctttcttatgtaataaaagatggagcaaatctaagtcccaaccccctttgtccgtcccattatctagtctctactctattcccttctttagcgaaaccagctccacctgctttgtatgtatcctggtgtttacttcatcatgatctaaggatccttacagtggaacagtaaggagtcaagggtatactaacaaagtggaaagttctacctgtcaatagtagcttccaagttttaaatgtgaacagctctggaactgttcttagaatcagagagcaattatagtgttttgaacactaaggaagtaaggatttctgatcagatactcagacctcaaacaaaagggcttcaaattgaggttatgtacgttactgagtttctggaatgttatccaagcaaacagtactacgaaaagaaacggtcatcgggttgaagaattaagcaccttatttcttgtttgcagagcaaattgataatttggggattctctgaatcgctgggattaaggaagctgaagttggagcacaaccattcaaacattagcattaatggcacactaaataatcaaaataaaaaaaatgatcttcaaatagaattcaaatgaatgcatactcattaaactcggttttattaaggaaaccatggccatctgcatccgaagcattgaaatgctcctctttccaccatgggaaccccagcgaattaacctctcctgcaaatcattaattaaaacacttactccaaattgtctcatggattcgcttccagccttattgaactcgttttgaactcctggacagataaaaaaaccaaaacaaaaattgccacattaccactcgattcgttgtgctgagcccggaagtccccgtaggagacaaccccgtcgccattcttgtcgtagagctccatctcccgagcggagcggtggagctggtcggctctggactgctcgaggttccacctggtgagctcgtcgagggaggcgaagccgtcgcgcggggcgaggtcgatcttggggaagagcgcgcggatgcggtcgccgaggttgaaccgctcgtcgtcgttgatgaagtcctcgtcctccctgaggaactcctcccattccctcatgtgctcgtccgcctcccctccgccgccgtcgccgtgcaggatgcggtagtgctcgcgctcccactccttgtcctccagccgccgctccagctccgcgatctccgggtcgaagggcgccgcgtggtggtggttctgctgcttctgcggagccccgtttcctccggtgggtgcccccgcgccggccccggagagggaggggttcctggggtggagcttgaggcggcggtggaggctgcggccccggtgcgggatgctgggtgagtaggaggtgaggaggagcaggatgacgagcgcgaaggtgacgtagaggaggagggcggagaatggggacctccgccccgccgtggccgacggcggcggcggcatcgccggcgagatgggggtggagatcggaagtggggtcgggggctgagagatgtggggttgcgggttgtgtgggtcggcgattttggactagtgcgactgtgcgagggcaaggagtgacgtgg

SEQ ID NO: 90851 - DNA, 3303 bp, Oryza sativa
  unsure (1)..(3303): unsure at all n locations
aggtggtgttcgccggcgtcggtacgccggtgagaggtggcggcgaggtctcccggctaggcggcggcagatctggcgtcgccgtcgccggatctggcaagccctccgattttcggcggtggaggaggctgctgcgacgtgtgggcggcgacggctcgcgcagcggcgcgtgggcggagtcggtgctggcggcggccgctggctccggtggtcgaaggccagcgctgacggtggccgccgtctccggtggtcggcaaggtcggggctggccggggtctccatcccgccactactctcttcctcctccctctccacaaccaccctcttcttcccccccctcccctcattcccttattctctcttgtgatgtccctctcctctctgtgccgtcggcacaagcgaagcagaagtggaggtttccttcctcccttcctctcgccatcgctgctaccagttgatctctgctgccagttgtccaattgctctgctgctcgccccagcgctcctctctctctgcgctggtggtatcttggaggtggttgccgtagtcgtgaggttttgtcccgcgaaaccaggagttcctcgccggagacatggttgacaccgaggtcctgggttcccctgactccaactctcagctcctcttcaggccggccaggtctcctcccctccgtgatgcttctcccttctgttggccgtcttccagacctggccgtggagtctttcggtggttgaggagaagtgttcgtccttgaaggtggtccagtccgtctgaagtcagggctcttatgcctcgccagtgcttcatgtgccctgtgactatgtggacctatcttagtgccgagtttggagcggtgtgtttttcctcttcggtgctgagcttttgtgttaaggcggagtcgaagctgctgcatcgggtcagccgatgagctaggcaacgacaactcttaacacttttgctttggcttcttggaggtcctacaccttttgagggagtcctaggcgaaagccctgtctggtcttccaggatcggcgacatcgacgcctgcgggtgccgtttcctccttggaggtgttgtcttgtggactctttctccctttgggtgaaaacccagtccagttatgggcgggcgtgggcagcggcttctgtcgttgttcacctccttggaggcttcgtcttgaaggtcttgctcctctctcggttacttctgtggttcatagttttgtcacgggttttttttgtgtcttctgtgtaaggttttgccggttttcccttagcaaaccgtgcagttgtatggttttctggcccggtttcccttataaacagggtcaactctcttcttctaatatatccggtagatctcctaccgtctactgtttcaaaaagatagtttgattgacttgaggaagggtgtgacgctcgatgatctaaaaacatatattcggtatagagaaaatggggaatgaaaagaatagaaagagagcgaaatagtgtggtgatagtaaaggcatgtggtttggagatgagatctctaaaccctgcgaagtgagagtagcaagcgggggaagaaggatcgatggagcagcggtcaccgtcgatggcgttcctcgttggcgtcgcttttgtggctaaattcgtacacttgccctttacttggggctgcaaaccaagattgtctgcttgcagaagaattagtgaataaatccatatacacaaactatgtagaatacaccttcagatttcaagtgcattttgagaagaatcacacaattaatccatgtatatatgtgtaatcttattaaaagaggcaagaagcaggctgcttggactgccaatgattgtagtctgagcataggcagtaagaaaacatcaatttaatgggactgtaggtagcaagtaatacaccacaaattacatattaactgaaacctcggttatgttatggccaaactgaaaacataatacagcggctagaagtaagagtagaattgagtggaaaatttacccatatcatgaaatccaagggatgtacgcaaattgtctctctctgaattgatactaacaaaaaggtgtcaaaacagggaagaagcccatgagtaccagagcacttagtaagcccaattacaccaacatcgcaatgatctccaactgtccaaggctgaaaaagaaaagatatcacattatatgttaaaaaccaccaccatcaccaccacaaacaagtgagaactgtgtgccttgaaaaggaaaattacaacattacttgattaccaatagtcaggaaaaaaatatgtatttcaagggagagaaacactaacaacgtccatgaccaacaaaagcctcncanttaccatnnntctgtgggtaaccttggatnnaagcctcaagcaatggagcaaagtcaccatccatgctgaacatactgcattttatcaacaagaagatcatctgagttggttacgctagccattgataccaaaataagtgatttttgaatgaagaaatttacttggaaatataacttgtctatgtgcgaaaaaaagaatattttccattgattaatgggacctgctagtgtaatcacaaacatagtttataactaaatcaattagtgcttaacattatgacatgtatgttacgactgggaagtgaaaaaaatacccatggatttttttttaagtcttacacttactggaggatgcgaagcaagcagagtttaatctcaatgacctccgattgtccaaggctgaaaaagataagagattacattatatggtataaaaacccctaagagcacaattcacattttcaggttaatcaagctaagccattaaatgaagcaaaaccaagcatcagcgcgcacctataacataaacacagatatacctcaaggatgcccgttgggataaaaatttggacgggtaaaacatcacaaaggagatcaaatggcagctacaattaggattgccaataaattaatactcacatgggaaatgagcaatgaaactacacccgcagtgatccagttgagcaccgtgaaattatttaggttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaaccttt

SEQ ID NO: 90852 - DNA, 950 bp, Oryza sativa
acaacagcaacaagaggaagcgcagcctcccgggcaacccaggtgcgttcttgtatagctagctcctcgatcgatccgggctccgttaattttctcggcaattaagcgaaagcaattgatcgaacctatatatagacccggaagcggaggtggtggcgctgtcgccggcgacgctgatggcgacgaacaggttcgtgtgcgagatctgcgggaaggggttccagagggaccagaacctgcagctgcaccggcgggggcacaacctgccgtggaagctgaagcagcgggggagcaaggaggcggtgaggaagaaggtgtacatctgcccggaggccagctgcgtccaccacgacccctcccgcgccctcggcgacctcaccggcatcaagaagcacttcttccgcaagcacggcgagaagaagtggaagtgcgacaagtgctccaagaagtacgccgtccactccgactggaaggcccactccaagatctgcggcacccgcgagtacaagtgcgattgcggcaccatcttctccaggtccttcttcttcctccctcctcctccatcttgcttgcttccatccatccatggcgatcgattgcagcacttgcactcctactgccttctgctcagatatacctgccttggctggcttgccgtgctcctttctcattgccactttgccagtaatccagtgttctcgctgccgcctgcgctttcagttggcacagtgacgagtaggaatcgaagcagcctataagatgagcgtttgttagtgttaacacacctgtaatcatccaataattagggcagcgatagatataccggttgttgattaaccagcaacaaccatgtgcccatccctgccgcgagcatctagccgaaaagatttgtgaacagtggcaactagtacgtagcttagctagctgctcgctgcagcagcgaaacaaaa

SEQ ID NO: 90853 - DNA, 3860 bp, Oryza sativa
tgcccagcctgacgcagaccacgacgacatgactgtcatcgacacgctgtccacgcactccgctgctccgccgccggattccccatcgacggccgcacctccttccttgccgtcggctgcgtgttggtgtagtccggctgtccagaccaccgcgcctccttcctgcctccgccacaactcccatcgcgagcggaacctcgccacgccggcagacgacgcagacgtcgcggcgcacggccaagccgttggcgccagcctcaccgaggaagtcctcccgatgctggaggaggtgtgatttatggcgggggtgctccgccagctgctccggccgccgccactctacctgccgcccgcccgctccgccactccatcctatttcaggcgtgcacgggagggagagaatagagaaaagaggggaaaaagtcgagggttcactgacatgtgggacccacgtgggtcccacgctaactcagctgctacatcggacaaaaccagtgtcaaaaccaccgagagacctaaagtgaacggttctataaattgagggatgtcatatatctggtttttcggttgagggatgattttgtaactcgattacaagttgagggaccttcggtgtactttttccttctcaaaaacaaaatttaaaatgtgaatatcatttaggaataagttcacttcgtgaccctcaaaagtgatcgaaatctaatccgtgaccctaaattacaaaaccggatatctcgaccccctaactctcgaaaccggtgcaatttgactcccttgttttggaggacggtttcgctgacgtggcgcctacgtggcggtattgactcggtcttctttccacgtggcgcttaggtgatgttagaaataaaaaatatatgtgggactcatttgtcattcaccaaaagtatgggtgggacccactgacatgtggggcccacgtaaatcattctctcctcatcctccccctctctctttctcttccgttggcgagcggcggccgtgggatgggggccagcggcggagatgttccggcgaaacagaaacgacgaggaggagcggtgtggcgacgaggagcagccgcggagcatgattccggcggcggcaggcgggtgcctttctctgagccgtggcatagagactggagaaattctatatcagttcttgattcatctcaccggtgattgtcatgcaggcatcaccgctgtatatctcggagatagccaagatccgctgtacatctggctgattatcaaatataatcaagcttagttactaactaatggcagatttagtttaattgtatagtaagagctgtacctggatgctggattggagttatggcaggctgtggtggcgcgagtcagaaaagcagtagccgatatcggcgtggacgaacacccaaagcagctcgtcgtgataattgatgccggtcgcttcctcctcgcccccacatgcgttccacctcttcctccacccggtccaccgcgtcctccacgcctgcctcaccccgtgggccgccacgacgcgctacctcgaggccgatcggcctccactgcgccatcgccatctccgccgcaggaatcatgctccgcggctgctcctcgtcgccacaccgcttgaagaaggaaggagagcaagagagaaggggtcgtcgtcgccgctgctccagcgcccgccctcccgcctgccgccgggtgcgctggcaacgtctccgcggggaggggtgggggaggccgacgacaacccgcgggagaggggtgttggtgatgccgtctgtggcggcggccaaggcggtggccggcggcaagtcggcgcagactccatcgtccgtggagaggagagaagggaggaggaagatggggaggagaggattatgtgggctccacatgacaggggctcccacatttttttccgtgtgtatgacaaatgggtcctacacatatttttttatttctaataccacgtaagcgccacgtcaacgtcacgtggaaagaagaccgagttaaaaccgtcacgtaggcgccacgtcagcgaaaccgccatccaaaaccacccagggagtcaaattgcaccggtttcgagagttaggggttgagatatccggttctgtggtttggggtcacggattaaatttcgatcattttgagggtcacaaagtgaacttattcctatcatttacagccagaccggcccaacctagctaggagagcaggctttgcatggcccagttctggcccatgtttagattcttgaaataatctattggcagcggttggctggagaatttgcatagacagatcttcctcctttcgtgcaagacatcgattgttaattagcccgatggaattgacaaagatttgggcaagaaaagttgcgatccttgcaaggtgttggattcgacttgtataacttgaactgcacttctttcatattccttcgttaacagttggttactagtcctaattaattcagtagcaattgcccaaactaaactttacgacaaatctccagctagacacaaaatgttcttttgaatgaagcggtccataattactgctagatagcattgctcaaagctagacggcagtgatttcttttgaatgaagttttgcaaaatgaaagagtggacaattgggcatccttgggaatgttggtaggactaggaatgcagctggtaaatcttgatagaaaacaagcacatgttttgtcaaagaaagaaagaaagaaagcatgctctgacgaaaaacaatcaagcagagaaaaccatatataacaagatatagagctagcctcatcgccgaaatgcagcggcactagcctaaattacatctctgctcaactacaacgatcaccttctcccgaattaactcagcaatatggcagtattgctccatccctctccaagaagtgtctgcttggcctttgcaattgcagtgtgtcttttgctcccatgctgctttggtagtgagtgcctcaataattctagttcttcttggttttctgcatgataatcttcatgctgctagctagctagttggtgccattgcataactacattaggatacagcatgcatgtcagcaacaaactctgaagttagccacagctttctctaacattaacacgatcgttattaatttcatcgtcgcatatgcaggcaaagctgccgtggaaatgttcgagaaggcttgccattgcttcgacgatcacaacgtaagcacatatatatagctataaacagaatcaagttaattaattaactgttaactgtttataatcaagtgtgtttcttcatgcatgcatgtcgcaattgatcattgaaccgaattaataattttgaatttgcaggtgtacagcgagtgcaaggaggagcttcggctgggggtggagggggcgttccatgtggggaaggagagcgtggacgagtactgcggtgggccgtgcctgatggagacgaagatggcgctgcagtgcgtggaggaggtcgcccacgacggcttcaggttctacagcggcgcctcgctgcccgcggtcaaggccgcgctcgacaccggctgcagctacactcctgacagaggtaaattatagtatattaatttagtccaacaaattatatattctcctttcctgaaaatatttttttttaaaaaaaactctcaagatcacgtgcaaaaaaaaaaagtttggacaacaaaaactataataggatatctctctgtgtaaacatgagtgtttaaattgtttaaattctattgacgcgcacaaattaagaaaatatatagaccgcagcatgaaatttctcaaatgtatatggaaaaaaacgattttataaattattctagtataaaattacacattt

SEQ ID NO: 90854 - DNA, 2196 bp, Oryza sativa
tattatgttgtatatgaggtgatcggaacatgagatgaaccgatggtcacccatcccaaattgctccaggctagtatcagagccgccttgtatagtttatgatctagatcagtgcatatagttgatgtgcgggtgtagtagatgagatttattatgttgtatatgaggtgatcggaacatgagatgaaccgatagccgcatagctttcataggtcatagactgccctcacagaccaacacatatcttttctgcacactttgtcctcactcgtgtgcacccgggaagaatttcccgatcggtcacccatcccaaattgctccaggccaagcacgcttaaccctggagttctttggagattggcttccggaaaagaagttgcaacttgttgatataagtattctattaatcctattaagccctaggccgggatgttacaccctcccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagattcggctctgataccattttgtaacgtcccgccttcccccaggccgggcccgcttacatctgatagctttcataggtcatagactgccctcacagactaacacatatcttttctgcacactttgtcctcactcgtgtgcacccgggaagaatttcccggtcggtcacccatcctaaattgctccaggccaagcatgcttaaccctggagttctttggagattggcttccggaaaagaagttgcaacttgttgatataagtattctattaatcctattaagccctaggccgggatgttataaatgtctagtactcaccaaggccaagcgcgattgtgttcatcggatagtccgatgtccactggaactgcacgccaatgagaaaaaacgagccaatgagattgactcggcttcggcataatttgattacgccgttaaggttttcacatagcgaatcgtagatgagatctatgtaccccgggactgccgtgtgcgttgccccttagatttcgcttggggtttttatatctatcttacctttattgctgttatatatttgatatgacatggtaggatagattccctcagaaaaattaagtgaaatttatgctctttcaataattgcacctatttcggttgtgatcataagtgatgggtttgacatagcaaagtgtcactttttatcatgataaaataggatagatgtcggacatctatatgcggagattattggtttacttgacaagggtatcaaaacaattttggaccttggggcataggttgggttggacatggagatgtcaccccaacaggacatggagatgccctcggccggcaccacctcgcgccgccctcgactgctgcgcgccacactgcgctggctcttggtctgagagtgagatagatagagagagagagagagtgaaagagagaagactctaagaggagaggaagggaaggactagaagataaaaggataggtgtgaaaaattttaaactggtggagagagaaggaagagggaccatttttacatgcggaccacttaagcgtccgcatgcaaaaatcatgtgttttttaaactttaaattgatttttatgacattaaattaactcatatcaaaaagttgtcaaaaacaaatttgtagaatacattgagatctaccaattttattttggttatttctccatccgagtttgattggactatacaaaatttgagttttaaaatataacaaattaaaataatttttcgggtagtaaatgattttaaatggaaaagtcatcaatagcaaagttgtatagctcatcaagatctacaacttttgttttggtcatttttatatttgactttgtttacacagtttgaatttgaatttcaaaatatgacaacttcaaacaatatttttaaatactaaacgacttcaactgaaaaagtcataaataacaaggttgtataactcatcaagacctataacttctattttggtcattttttcatccgacaaagtgatttgcaagattgtttacaaaatgtacctctcttatatagttttataagaatatataagagatgta

SEQ ID NO: 90855 - DNA, 1743 bp, Oryza sativa
ccgcggaacttgatcgccgctagatcgtacgtcctgcgattgggaaaggagcagaaaaacaaaggtaaaaggagcagaagcgagaaatgcccaaaacaagacgaatccaataccaaacccgtccatgctgctcttcttttgctccccttgcctctctctcctccttcctccttcgttgagctctcgaaaatggaaagaacgagcaggagacgaggaggcttaccatatgtgcgattcccatcgcccggtgcggcggtagaacttgacgccgcagtactgcgagctgcgcgaccgcggcccgcgtcggattgggcgtcgcgtcgcccgcctgcgcccagcccgccgccaccacgtcgccacaccatcccgccgccttttcctgcctcgccccaccggcacgaagggggcggggaggacggcgagctcgcgcctaaccacacctcctcctcctccgcctcaacactcccagctccctccctcccacctcaccaccatgccccaccgcggcggcgcggcgtgggcgagcgctgcgcagtacggccggcgtcgggaaagggcgccgacgacaaccatgcccgctgctagggggccaccacctccgccagccgccgcgcgcgtgcccgcctgccgccaccgccgctccgcgtctctgcttcgccggccggcctgcgagagaagagtgagagagagagatgggagaaaggaagaaaagagggggagaggggggttgacgtggcacgctgacatgtggggcccacgcgccacgtaggtcaaaactgggtcaaaaccaactaaggatctcgggtaaccggttttgtataggtaagggaccatgtatatctggttttggggtttaaggacgtttttgtatcgcgctgacaagttgagggaccttcggtatactttttcccatgcaaaaatgagctcatttttgcatgtggccctcttaagaggcccgtatgggaaaaatcgatttttccatacgggccacttaagcggccgtatgggaaaatgaccctcgatttttgcagacgccactagttatgatccgtttgcaaaaatcatggggcctcgtgaagaaaaataacttttatagtagtgtatctatgtttttttttttttttgctttatctgcctcatgatgcactcgtatggacgaagaattagcgcgaaatcgaacggaaacatgatgaggatcggaaagttaccgattttttaagtagttaagatattgtccgtagtaggtaccaaagtttctataatttctgtaccctaattcagtttttttttttttttttgctattccgatacattttgcgagaaaacaacgtatgcagcagtactttattttctaatttttgcgacgaacattgaattgacattgacgtagtaggggttttaatctctatagagaatcaagggggcagcataccccaaataaatggaaaattaatcagctcgtatctgatacgggtgtaaacgatggtaataaggtcgtgatatccggcctgctatctggtgccatgcatatttctcagcatttacagctgacgatcgagcacaaaatcacagggatgcaacgatataatatcttaccatgtgtaggcaaataatcagtacgccttcccacagccacgcccgcctataaataacgggccggcattccaccgtagcaaatcatccattctcacaagcatatagccactatcataacaaaagcttcaagaattcgtagctcatggc

SEQ ID NO: 90856 - DNA, 2067 bp, Oryza sativa
gcttgatgaagcatggtgagcacataggagtttgagcacttaaagtcagtgcatatagtggtcagaatatacagtggatgcatcatgcatgcaggggaatgatggtaaaccggtgcagattttgtgcctttctctttgtgtagctttactcggacacttccaggattcagggagttgagaaaatacttgtcggcaacgaaagatctgctctctgcttttagatgtcgtaacggtttcggattgcttgtttggacggttctgttatctgaggcttttgattggtctctcgttgttgttttgcgcaccttgaatctatcagtacctccaatcaaagtggggctgggagcttcacatgtgttgagcggaattgttgggaacttatgagatcgtgcacattgagaatggaaggaaagcatgcagcgtgctatttgctgttgcatgaattcgttgatgtatgataaaagcattagcatacatgaacatgtgaaaaaagccaacagactttgtgatgtccatgggtgtagtatagtgtgggtaatacttccaagcctggatttctgatgttattggtacacatttgctgaacctaaattgcctggaacatcagctgacgtacatgctttgaattcaaaaaatgttttagctgcattcatggatgctggcatatgtgtggcccgttatgctctgaagaatgccagcaggtcatcctatgtacgtggccaacagcattggtgcattgataatgcacttacttcgtactttttactgttgaatttgcatctttgtcaatagaagtttgatgagtagcatattttctgaaatgcttatgtctggactaaattgttttctactataccaagattcttcagaagctaaggtttattacatcagttctttgttctatcattactaggtagtgtaataattggaagcttacaacagattgctcagagggaaggttttcggggaatgtatcgtggtttatctccaactattctggcactcttgcctaactgggcggttagtctttacccttacattatagctccacttactccattgatgagatgtttttaaattctatgtaaaaagcaacgatgctaatgataatgctataagttgatctgcatgcaaacccatgtatggcaccgagtagagtagtacactacactatagatgaatcaagtgtctatgatctattgtggagctaatagtatccttgtggatttccaggtctattttactgtgtatgagcagcttaaaagcttgctttcttccaatggttagtgttttaccctgcatatgacttacttgacagcatatcatttgtcagttcttatgtggtatcgtacattcattttgcagatagaagtcatcacctgtccttaggggcaaatgttattgctgcatcatgtgctggaggtgcaactactattgcaacaaatccactttgggttgtgaagacaagatttcaggtatccttggaccacaacttgtctggaccagtagtcgatccaagacgcctgatagcataattgcaatttcaaaatgctgcataccaaatattttgtctggcctatattaggcaagtgtttaaaacctgtaagcaattcccatttctttcctaatgttgactgatggtctttacacaggctgaatgcccatttggaatggagctatcattaattataatcacttataaatatgctgaatttcttttagatcttttacctgtccatactaagcagtcaacatctacatgctatactcagacaaattgattcaaagattttattttgagtcatatcatcatctgtatccttttcccttttgtagacccaagggatacgagctggggtgatcccgtacaaaggtacacttgctgctttgaagagaatagcacatgaagaaggcattcgtggactgtacaggtagctttccatggaagtccacagatgcaagattttacaccgtttgatgataatatgttttgtgcgctggctgatatttttctttttcttttttataaagtggacttgtccctgccttggctggtatcagtcatgt

SEQ ID NO: 90857 - DNA, 662 bp, Oryza sativa
tcactagccccatttcctcccacattcttgctagtagcctgtccaagtttagctgcaaagaaatagtttatgttaaattcaagataaagaaccacaaaatggaaaagagaaccaattggggacagaaaactcaatacttctgcgtgcactgcggttttcaagatgctcacatcacacaaggcccaagggaagtaccagaaataacttgagaaggatataaaggtccccatcgtttggcatatgcttatgcttatcagccaaaatttgaattttcaatgttaaatttggagctgattttggggttttttcatcgaagtttatttttcagcctttgcttttggatcgataagaacacatatataaaagttttattcacaaactgctactcgtttgcaaatatgccatttggcatattctgaaaatatgccaaacgatggcagccaaaatttaactgagagagtaaacagaagatatataacatgcctgcaaattgcagctgatcacaagcgaatttggttgccgagcaagcttatccacatcatcaataccaacaacatcaatcttgttatatacataaacacattttatgtacttccgatttccttcaataacatcgatgaagtcatccacggtagcatcctcgcggaataacacctaaagaa

SEQ ID NO: 90858 - DNA, 3293 bp, Oryza sativa
ttattaatccaagtgataatatttcagcaatgtgtactaatttatatgtacacgtatgatactggattattggtggtaattaacaaagaagaaagagagagagagagagagagagagagagagagagagagagagagagataatgtggcatttactggacctttcgaagaggacggcgagcggcgcgacggcggcagcgccgacgaggttgcggtagacgaggaggacgagcggccgcgcggcgccggcgccgagcgcgagctccgacaggagcagcgtcaccgcggtgaacacctgcaccatcaccatccccaccggcagcagcaccgccgccgcgcccaccgccgccgcctgctcctcctcctcccgctgctgctctactaccgccgcctcctgctcggccacgccgaccaccacgacggcggcctctcccgtcctcgccggcgacgccatgtatattttgctttgctagctatagctagagctaggggcacgatcgatcgatcgatcgacgcgatacgaaatggaaattaagaagaaaagtgagacgcgacgagtcgatcgaggatgggagtgtgcgagaggcgagcgattgattgagcttgcggtggtataaatagcggggggagagatcgagagagagagagatgatatatggggcgcagaaacggacgaaggtagggatagatgggttggtggctggaattgacgtggcggtatatcagtatcagtgtgtgcatgcggcatgcattctcccatcggccggtcaacttcaactccacctgtccatcagtggaactggaagtgcgtgtggaatgcaaccggctaccacttacataccattgtcagcattgttaccatgtgtctagtgtgtaacgtaaacttcattcgcagattgcagaagtcaacatttgtcccgaaagcaaccatcaggcccttgttcggttacacagggattcattccgggccggttatgataaatataacaagaaatttataatagatacaacaagagaccaggaatatttattccgggtcaggaactaatttacttatattaggtataacaaaacatccggattagttccacacctcttgactagtggattgattccggtctattattgtccctatcatgagtaaattggttcccggcccggaataaatctcggtaaatcgttgtatatatcctaaatttcttactatacttgtcattctcggcccggattgaatccttgtgtaaccgaacaaggcctaagagtaaattttatagaatccaaactattatatggtccaagtttcttaaagccgtataaactttggccgatgacacataacctcaagtattatggttataacgttttacaaaaccacattactaataattttgagtttggtataccatgtacacttttcagttctacaatcacatctcaaatttatgagcattttattcattatataaatgttacattcatttttttatttcaatacaatagtatgtcaaaatagttaacggtgtggtttgtgaaactttaggagtatataatacctatagtttgtgccacatgtcaagatacctgtggttttgtgcaacttggactataataggtgtgtttaatgaaatttattgtatctttaatttatacatagtattcttctaccatgcttggtccataaatcaagaagtttaattttatccttcaatactttacctacttaaccaccaatactatatattttcctattaataagagactctttggttattttccttcctcgccgaagttctcttaggattctaatattcaacttacttacttcattcaaaacataagcactttgaggttttgcgcatggattatgaaagtaggaagatttgaatgaggaatagtatgattggttggtatgaaaaaatagacaaataaattaaatagatgatggttgtgattggtttccagttaaaaattcgcattgacaaatatttgattatacagtagccaaattgatacgaaattaaaataagagtataatgcattggcagcccttaattaaacttatcacgtcatgttatctaggttcttaaactttgaaaatgcacatctaaatcccaagactatatcatataggttcaaaactatcacatacccccttcgagtgctcgtgtggctaacacttcactcatttaatgacactcaatatgtgaacgtcgacgtcatgcggatactcaaaggggcatatcccagccactaatactggagaggactatggatcggacgtccaatgttttgcataacgtcggacagtgttgcatgacatttgtttcaaagtgtttcacatgtttcatcttttgatgggaaaatatttcaacacaatatggagaaaaaatgattcatcatatgaaaaaaatgtttcaactgttgaaaaaacatgtttcaacataaaaaaagatatatgtttcaacaattttaaattatgatacacaatccaatcaatactgaaacattttcttacaacaaatgaaacaccaattttgacctactgaaacatgcagatgattaaaaaaacaaccactgcaacattttagtctaaactaatgaaacatccaatatgttaagctgaaacatataaaaagaaaaaagcagcctagatatatttattcttcttctccagtggtaggtaggccaccatgttgatgccgggatcgatgccaccccccactttgcttacctatactccatgaagactctctattgccttctcctattgttgacgaagatgaggccgagctcaccacgccattgtcaagcaagctaacgctgagctgctcccttcatggccggtgtccactcccctggatccggtgccccttagatcaacgtaatagctaattcgacggggagacgacgctagtgagatgccagtgggtggtggatgtcaatacgccgccctaccgtgtcccggctatgcggcggacaacaagatgagttgtcgcccttgctggccatcggcgtaggtctctctatagctagttgctccggtgaatatggggacagaagagaggaaaatgaatggttggaaatgaggataaggttgactgccagggaaaaaagatggagagagtggttaggtgggaccaactaggcacgcgtcatcgaactcaaagggcgcatccttggctagtagattggtcagaggtctgacgattgtagaatagtcctcgatgaaccttctataaaagctggcatgtcccaagaagctgcggattcctttgatgttcacgggaggaggaa

SEQ ID NO: 90859 - DNA, 1883 bp, Oryza sativa
ccgacaacgatcctccagcgattatgtccagatagaatgcagactccttatccaaacccgtatggaaatgttgaagaagcacatacccgggtaaggacagggttggtccagactgcactaaattagtgaatctggaccaggctgcaccaattgattcattttcgatctgcttaaaactgagaatttctactcgtagggcagtaatacgagtaactgggaagaaggtaagacagaatttgtctcacaacttttcccaactaccgtttacacatccaacggtagaggtgtaccattgctttgctctctcttaaagagagaacgggaacaatttccaccgcacagtttcttgtctcatgccacgaatcttaaggcacgagcagacttgttcaaagtctcgcagatgatggtagggattttctagatcaaacccagaaaaaggatttttccctaaccatactgattagttcgggatgaatttcatagccagttgtataaatgggctctgatgaaggaggtggctcatagaattcaccccgaggagcagacagctcaaaaagcggttgctccatggtcgagaagagtttgacaggaatacttctttaggatagcaggggtagatgtagaattaaaaaaacaaaaaggatacgaggatgaataaggtacggaaatgatcagcaaccatttccccggaaacggcgccagaaatgcttgttggtatttcttatggtcacagataaaatttgcaagcgcacagatataccgatgtagcacttcccctacggagtattccaagggtatcgaatccaatggaacgtgtgtgatcagatcttcctccggttcatccaaggacaccaagcaaatgataggccaggatagagaggatttactagtgagaaacagtgtctagggaaagcttaactttaatcctaacgcaatacttcaggcactggcaacccgctgttcccagatgtcgctctactacgtacccggacagggaggacttaagtgatctcgagggctgtcaccacctctacacccacctcaaacgtactgtgggatacgcagtaattactggataacaattacttaaacatcacgtctaagcaattactgtctactttagtgtttataactcaccaaagcaatcactatatttagttgattatagtgaacaataattccgtatgctatttaggaactaaccaagagataattctcacaaaataaatctaaattactcaagaagaatattatattgaattcagagtaaaaaatagaataaaagaaataggagaagattaccgacaactccggaattcttccgactcctactctactctcttccgattgtaatatacaatatagtacaatagagcctcttataatttagctcaagcttggaagtgtgtgtgtgaagtgagagagtgaagcctttatatagaggtaggtatgacggttgtgagaagctgaaatgtccgaactgccccgcaaccgccattaggagatgatcaagaccgtccacgccaaaccccagcctggatggctgagattaggagatgatcaagaccgtccacgccaaaccccagcctggatggctgagattgtggtccggccgaacctgggctgggcccatctggcttggctcttggcccatgttctcccctgatcctcctctattcattcttcggtattttggctgattcactgatgttttgatgaagttcacaacccatccttgcagggatacacatttctcctcactttagtctgattttcctcccaacatcggggtttatcgtctgcatacaaatatataccaacacttgtggaatatgtgagattaagcacatatcactatgttggatgttttattatccgaactt

SEQ ID NO: 90860 - DNA, 529 bp, Oryza sativa
agaacgtacgtgagatggatgaattgcatgatgagatgataattaccctacctggagatggcttttcacctcatcattggaaattccatcaaccttcatcagctcgcgaatctgcttcggggtcgccactttaatttgcaaagaacaaaacaaaaacgcagctcaagattaatttgtttgttgtcttttcatctttggtacggcatgtaatcatggtgttcgatcttgatcgagttacatgtgtaggtgtactgtaccttgggcgccgccgaggatctgaagagcattgacgaagcggcggtgcagctccggcgaccagcaacggcgcgccttccggtggggctgtggcggcggcgggacggcctgcccgtccgatggcgtcgacggcggcttcccgccgttctgggcttctctcgatctcgccacgacgccgttgtcgtgggcgtacggcttcttgtcgacctcgccggcggcgatggtgatcgcgtccgccgccttctccagcgggcgcgagcgcgagctccggcag

SEQ ID NO: 90861 - DNA, 694 bp, Oryza sativa
ccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaacttcagcagcacatgcccttgataggaaggttgctttaggactttaagaatattctttgttaaaactaaaataagacgaaagcaaaatatttcaatggaaggttaaaatatcagtgtaaattacttttatagtagctaattgggctgtgtgttataaattatgaagtacgagcagtatgtatccagggaacaactctggaatttaagaacgagtcttactgattaaagtgaatattcaataataattgcaata

SEQ ID NO: 90862 - DNA, 2965 bp, Oryza sativa
atgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgactcaaacattgtcctaaacgacttcctttacgagtacggagggaatatatgttagtgaccatgtcagagaaatcctttctatagaaaagaggggtaaaaaggtaagaatattatgctcgaattggatcaaacatctatatatatatatatatatatatatgcttggtttgtactcataatatactgtggacaaatattgtgaaatggggtagatttatttgacagggagaagtagttctttttcttggtttgtgctaacaaagtataaataagctgcggaaaatattgtgaaatggaggaagtaattaataagatagatattatgagttatatatgtgtgtgttttgtcataaaaaataatcaatatattggatataaacattaatttaaattttcattacaatactatttgatttttggcaactcattctccatctaattaatagtacaaaacttgtgtcgatatacattattgaacctaactaatatccctcgcatcctccatgctctaccccttcctttccccacttgcttcatcccttgcttcatctactccacttattacatcccctcgaaaatttggctccatcgagatattttattcttttatttatagtgaggttg

SEQ ID NO: 90863 - DNA, 1934 bp, Oryza sativa
tgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaag

SEQ ID NO: 90864 - DNA, 2399 bp, Oryza sativa
ctggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacagaactttttatcggttttgagtagcggaaatgcctatccgtataattatcaggag

SEQ ID NO: 90865 - DNA, 1541 bp, Oryza sativa
gctatcaaacatggtgtaaacatggaatcctacccacatgtttggaagtttaatactattgtggatttcaactcagccaatattcactgattggatgcacaaattctttaacttctattccttcaattctatgcaattttaaccactggtcactttcaatatgaatcgagaccctgtctggaataatggaattactcacgatatagttcaatcctatggaatctgaaaatgtttggcgttcctaacagggcccaaggtcgggagtaccatatacttactatacctgctaagttttctgatacataatgtgatcagcagatctcattttgatcctattctcattttttgatacttacagcctgaatagtacttttggacacacttttgaatactcctaatttttatgttccatattgatagggacaagaaggaatacaccctcgtatgtttaagacagttattgctgcaaagcatcccgaattttccagtatgaggcaacaggtactttggacctggaatcacacatttttggttgaggagctacttatttgaattttcctttgcatcattaactgcaattttgggtacaattttttccaaatagtcattttaactcatctctttgtccaggatgcgcttgatttcttccttcatcttattgaccaagttgatcaggcaaacaccggaaaccatgagctgaatccttttacagggttcaaattcttcattgaggagcgtcttcaatgcccttctggaaaagtctcctataacaaacgttctgactacattctttctttgaacataccgttacatgaagctactaacaaaggtgactttaaaacctttttccctgttgtattataaagttagtgcatatatccttgacacctgtgagatatgcagagcagctagaagcatttcatgagaagaaagctgcaatggatttggatggaaaggaagtgtaagttgttcatagctcatgcactgtctaatgagcacgacttatgtttcactttgcttccataaaacaggtctaatgaggaaattgtgaggcctagagtcccactggaggcatgcttagcaagtttttcaggcgcggaggaagtgcctgaattttacagcactgcattgaattcaaagacaacagcaattaagtatgcatatcttcattgccatttggttctattatatacatggaaatgtggtacagccttattgattgaataagaaatatttcaaaatgcaagcaaactcatatctgtggcatgttcagtttgtaaaagactgaatctctcaaacttgccttatatgtaacttggctagctgtaattcaactcaatatagcagatgaaatgtaatgcctgagcaattcaacattaacacattactgtgactgggtgtactgctataatttagtcgtactatcttaagaccattaccgagacacttaatagggaacttccagtccttgtttttttaatttctcagtgtgaggtgtcatgaccttggtttttatttttgaacatgattcctctgcttat

SEQ ID NO: 90866 - DNA, 1117 bp, Oryza sativa
tccatgatagttgatcttttacattttcttgtacagttcgcaatgttgaatacctctcagaaagttgatatttgcttattttcatataatgacctttcaaaactgtcttagggtgttcctttcccgttgtctgcaaccaacctttttgatcggaggcttatgttttgtacttctaatgtgatagggtggaaatatcgagagagcaacagactggatttttagccaccctgaggcttttagctcagtacctactgattcttcaacaagcaatatggaagatgatgatgcacacataccagatggaagtggcagtaagtttttctaccccttctgttttactgtttctagtgccaagcttccaatctcatgagctaatttcattaacattctgaactgttaatgttgaatttgtagtttgcaacatttgaaagatgactttgtacatgccctgagcatttctgaataacgatggcacattatcgtcaagaaatggatgtggatttacaattatatgacccatgtcccatctaagtttccaagaaaacttacttttttaatttttttttcttttaagatatatgtaaagaaatccatggtagtgaatgattagccaaaccatataaaagtaagctccaaacttgtctcagactgtaggtgtttccaaaccattgggttcaatacttctagatggttgattatctatcttcagtatgtgtgtgtgttttgcagttcttggtttattaacattgctctatgctctgcaggatacaaattgatggcgtttgtgagccatatgggcacctctacccattgtgggcactacgttgcccatgtcctcaaagacgggaggtgggtaatattcaatgatagtaaggttgctgcctctgtcgacttgcccaaggatatgggatacctgtatttctttcaaaggatataaagcattagcagctgaaagacttcacaggcaagaaatacattcgctcgctgacttgagtcttagttatgggcacctatgatcaaaagcacggcggatagtcggtgaacttgcatgcagatggacttagagcgagtgttggtcacatcctgtcgtgctgacttatagggggatccactagtt

SEQ ID NO: 90867 - DNA, 907 bp, Oryza sativa
tagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatct

SEQ ID NO: 90868 - DNA, 1584 bp, Oryza sativa
tgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggatgagtcacacattgctctctgggcctcgagtctcgccatgagagtgctcgttgcagcttggttcatcctaagctgctccttgtacacaacagacctgcacattttgcaccacaatcaacaattagcacaaacaatcgacattgaaatcaactgcatgagagttcttggctcttgctgcatagattcatccttactggtgcatggcgtctctgatcatcttctccagcacagccttgtaattcgactgagcctccgccaagcggcggcacttctcgacgcgccgccgcctcttgatgaggagggcctccatgtc

SEQ ID NO: 90869 - DNA, 3864 bp, Oryza sativa
  unsure (1)..(3864): unsure at all n locations
gcatctgggagagaggaagccgggtggcgaagcggcggcggcaatggcgccggggacgaaggcggaggcggcggcggcggggaggagggggtgcatcaggtcgacgcgggggccgtggacggtgcggcggagggggcgtggcggcggggtgacgacgtcgctgcggcacccgacggcgcgggagcgggagaacaaccggcagcgggagcggcggcggcggcaggtggcgacgaggatctacgccggcctgcgcgccggcgccgggtacgcgctgcccaagcacgccgaccagaacgacgtcctccgggcgctctgcgccgaggccggctacctcgtcgacgacgacggcaacgtctcgcgccgccacgacgaggtcagagcgtgtgtgttaatttgagttcatcgatctcttgtcttctcttttgcattcattttggacacaagaacatatattttgtgtttagttcttgaatttggcacaccaatttggtttatttcctcatcattttcttttatctcttgacctaaggcccccatcgtttgacgttatatttgcaaataaaaaataatttgtgaataaaacttttatatacgtgttcttagtgaaaagtaaataataaaaaataaatttcgatgaaaaaaaaactccaaaatcataaagttgaaaatttaaattttggttgataagtgtaagtataagcaaaaagatgggcttttagtaactctgttgttaattgccaagaaaagaaaaactctgttttctgctatggtccttttcagtgctatgcatgacagtgtgctggtctgtactgcatgctatctgtatcgaactgaacaacagcaacagcaaaaggaataataataaaatgtcaagatcacattgttctagtactagttatgatagtaaaaagtgtttttgtcttttaaaaaagcaacataactggtcactgtaattttcttcatttgtttctcttcttgaaattgttttcagcgtttagccggcgccggcgccggcggaggcggcagctccgatcagctgcaggtgtcctcctacagtggagcaacagaggcagcagtggctatccagcatcaggagcaggagcaagagatatcactcgagctgacactctcattcacctacatgtaggtagaatgcttaatttgtttaaacaccaaccaacaactaggtgcattatattcagttattcacttggcagaagttaagcacaaatcagtgtagtaattaactaactagcaagcaagcttgcttgacagaattgtcaaacaagaagactgctaattaatcatcttagcatcgttgacaatctataataatcaaataatatcattgtctagttacctattggaaacttggaatgtgttcaccaagagcacgcaatatcggaaagtaatttgtcagcacgaacactttgtgtcacataagctgaacacacacacaagaagtgcagaaatgtgaacaaagagctataagaaactaaaactttattgaacttgtagtagagtacatttggatatcataagaagaatctgaagatctaattaagaagaaataaagaagaagaagaagaagaagaagaagaagaagaagaagaagaagaacatcataaaaacctaagaaagcaacaagagaagactactgagtaattaagagaggcgattgatcgatgaggtgtagcagtgtagctagctagctcaagctggcgtcgcggcggaggccatggccgacgccctcgttgacgccggcgacgagctcggcctcgaagttggccgacgacatggacggcagtcgctcgtacacccgcgacccgaggtgctgcagcttcttctgctgcgtcttcaccgtcttgctgatgatcttgtagttccaccgctgctgcacgtacaccgccgcggcgagcgcgacggcggcgagcgggatggcgacgtcgccggacctggagtagaagtcgaggctggtgttcacgaactcgtactcctccgcgaagtaggggttgatcgccggcgccctcacgtagtcgtacacgtgcggcagcagcctcaccgccgtcaagccggcgtagtaccccgtcttcagcggccggcagttgatccgccacaccacgttcccgatcacctgcggcagcaggaacatgtcctgggcgagcccgatgtactcctccagcgtcaccgcccactcccggagcgcgtgcgcctcgccgcgcgcgtccatgtacgacgcctccgacctcaccggccgcgccagcacgctcacgtagtgcgccgcgaggaccaccgcgaagccgacgaggtgcgcgccggaggtgtagacgaggaccttcttgtcgctgggcacgcgccctggctccagcggcgagcgggtgaggaggcggatgcgggagcgccacaccttctgcaccagccggagcgtgaggaggaacgcggcgaggatgaggatcttgacgacgcagtcgatggtccagtagagctggctcttgtccacctcgtacgacggcggcggcgtcgcgccgccgtcgccgctcgacgcggcgatgcgcgcgaacagcgcctccgcgccggtgatgagcggcacgctgtagccgactgcctggacgcccagcatcaccaccgacacgtacggcatcacgtcggtgtgggactgatgtacatgagctggctgaactcggcggcgatcgccgccgccagcgtcacgacgcggaggatcccctccacgctccgccgcgacaggatgtcctgccgctgttcccggtacaggatcggcagcgtctggagcgccgtcgcgttgaaccgcagcgggtcgtcgccgccgccgcgcgtgctcgcgatgtgcaccttcgccgtcgggttgatcagccaccgcgccgtcgtcggcgggtactccaccctcacctcgatcgagcagtccatgccttcctcgacgccgcccatcgccgagaaggctcgccacggcgcctggattctctcggcagccgtatganggtacatccgcgccatcccaccgggttgtactancgctcttnccaaggacntagcgtcnngnacactgttcacntgtacgctgtcntgcccggagtantcgtnncagctcctcgccgcacatcgttgaggaantacgccgtcgcccatctcagcnnttcgttcggtcagtcgacganncngantgantgantgcccantgcttatgccccctaccagncagcnntggcggtcccccgggataacgttcgcccggcgaggcnnccggcccgacgagcnngatctcgagcgagagcccaccctcaagctgaaggaanntggccgctcgaatcgtccgcgtgggaacggatccggcacggcggcgacgtggagcgtgagctcctcggcgaggttggagaggctcgtcgtctcgtcggcggcgtcgccggatttcctcgggtagctcagcagcgacttggcgatgacggtgccgaagtcgaacggctcgcttcgccggaggaactcgccggcctgcttggtcttggtgtagctgtacgccaagctcagcggctcgccgccggtgacgccgaaccggctccacagctccatcgggtgcaccgtccgctggaacgtcagcggcgggaagtgggcggcaccgccgccgatgctggtgatctggcccaccgtgatgctgcggcgagtggcggagaaggtggtctgcaggtagaggcacacgcgggagtggcacgccttggcgccgacgccgaggcacgccaccatgcagagctggccggaggacgcgcgccacacgccctcggcggacatcgtcgcgccgccgagcccgctgcgcttcgccgccgtgtacgcgtgctcccacggcgggacggcgcg

SEQ ID NO: 90870 - DNA, 2941 bp, Oryza sativa
aacgatccatgaagatatctctcttataaaccagcttagagatgaggaacttggtgagggacataaggaaaatatcgatgatggggtaaaacctgtgctaggaaagaggagtatggataaatctctccttggcccaggatatgatggaccttcgtttgatgttctagttggaggtgatagtaagaggagtaagagtttgtctctatagacagcaaagtcgatccacctgacgggcattccaaaggaagcccgtcaggagcaatgaatattttaagctagaactgccgaggatcagggaggcctcggacagttcaagatcttgtttgcctagtgcaaacacacaagcccaagctggtttttttgtctgaaacacatcaaaatatagaaagagtgtgtggcttaaaatagagattggggctgcggaattgtgtagcagtgcctggagaaggaacggggaggggggggatggactagccctcttttgggatgacacagtacaagtggatcttctatcctacaacttcagatatattgatgtgctcattaaggacgaaagctgccctgtgcaatggcgatgcacctttgtgtatggtgagcccaaagctagcgaaaggcataacatgtggactcttcttcgtcgcatcaaatcaaattctactgctccatggtgcttagtgggcgactttaatgaagctatgtggcagtttgagcatttttctgaccacaagagaagggagaagcagattatggatttccgggaagtcttgtcgcactgcgatgtgtttgatttaggtttcacgggtgccccctggacttttgataacaagcaaaaaggaaggaataatgtgcgagttcgactggatcgtgcagtagcaagccagagttggtcttctctctttcctgctgcagaagtgattcaccttactgtgtccagttctgatcacagtcctattcttctccaagcctcccgagtggatcgcatcaagaaaggggatcggtgtctgcggtatgaaattatgtgggagagggatgagcatctgacagatgagattaaatctgcttggcaactacagggacatatatcagacttaggctcagtggcaagccgcttaaagtctgtgatgggagcactgcagacttggagccgtgataaatttggttaagttagcaaagatattaaagaaacaaggaatcgattggcagagcttcagatggcaggcaggtgtgctagtgatcaagactatctcgatatatccaggaagctggatactcttgtatagggaggaaatgcaatggctgcagagatcaagaatctcttggttgaaggaaggtgaccgaaacacatccttttttcataggaaagcggcttggcgccacaagaaaaacaagattaataggctgcagagaagtgatggaacctggtgtgataagagggaggagatggaagatatgacatcaaatttcttcaaagagctttacactaatgacccttctgtcgagccagaaccattacttgatttggtacagcccagagtcacgtcggagatgaataagctgctttgtaaagaattctctgatgacgaaatttcaaatgctttgttccagatgggtccgttaaaagcgccggggccagatggttttccggcaaggttctttcagaagaattgggatgtattgaaacgggacattattgcggctgttaagctgttctttgaacagagaagaatgccacaaggtgtaaatgacactgccattgtgttaattccgaaaaagaaagagccaaaggatttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacatcagatcccttttgcaagttcaacacacttcctttgaagataaatatcttggtctgcctacaccgatgggtagactgaaggcaggaagacaccaatctttgaaggagagatttgagaaaagattaacggattggaatgagaaatacctctctatgggagggaaggaagttttaattaaatcagtcctacaggccattccgacctatgtgatgagtgtgtttaagcttccagcagggctctgtgaggaatatatgcagctgatccggaaattttggtggggagaagaccgttagaaaaggaaagtccattggatctcgtggcagcaactgattaaacccaaaggacaagggggaattggtttcagggacttaaagctttttaaccaggctctgctagcttggcaagcatggcggctgatccagtttcccaacagtttgtgtgctcaaattt

SEQ ID NO: 90871 - DNA, 1811 bp, Oryza sativa
cagatgtcctattttcatcctgcagcgttccagaatggattggatgtcacaatgtcccaaaaaaaaagaaaaaagaagcagatttcttttgccattatttgcacataataattaatttactgtattaacccatgcaattctggtaactttccaaagcagttcaacgtacataacagagcatgttccaaagtaaatcactgcagcatggtaactatggcagttatgcctggacatttttaacagtgaattgttattttgtacagtaaactgcaaatgtcagtatgtcatgaacatggaatgaaggatgtaaaaaatttactactcataaagtacaaacaatgtgatgccttttaattaatacagtaagaagataaataaactgaccttgaggaacatctccagcggtacatcaaaaatgtcatctacctcatcgacattaagaacaggcttaaatgcttctatatctgagaggatgccaacaataggaacaaccaccagaagatgctgcaagaatgtttaaagatttgtatttgtaacaccagaaaaaaaataaaaaaagatttccctattttttattgatgcattgcaacacagttttctctgatctaagaaaaaatttcagtttcgatgtaaaagaagaccgaaaggcattgcacctttgacaagaaatgctctaaagaggcaacaacagtgaccaaagaaggatcaagcccaatctcctcctttgcctctctcagtgctgttgctgcatcatcagcatcaccttcctcagccttccctcctggcaatgcaacctcgcctgacaatctcaaatttaggcaagaaacttagttaagaaaaagcatagaagcagcattgggcatctatgagcatccatcaacactttggggtgtagttgaagcaagtttagataaaatgagccagggcagactacatttggatcagctcacctgaatatgctgactcaaaccaagtcagctctctagtagagccagaagctcaatttataactcttgtgtaagccaaacctatcttgagaccatttgtgagctcaagtccccaaactcaaaatctataacaagaaaatatatgagcaggcttggtttcaaaagtatttcagaaagtcagcttgtttcatttcacttcagaaccaaatctcaagttgctcaaacaattcctgaggtgaggccaagtcgcttaaaatttgtaaattctgatgcaccctacttgtttttctcaagtagacaccgaagtaagaaatgctatgatgttcctagtataagtccaatcatctgtacaaattgtttgttcaaaacattccacaaaagccagttggctaataatgttgaagtggacaagacaagagagaaacaactatatcatttgtaaactaacttcatgaatgaatcacccacatggtagaaactagaaagtgactccctatcatatttgtgaactatatattaacaccccccccccctcacccccaaaaagaaaaaatgtttcaatctgacataatactatgataaaattatcacaaaactacagatttaactcggtgtatcacaaaactacacatttatgatgaagtgtcacaaaactacatgtttattaactaaattaccacaagactacaagtttagaaccaatttagtcagaaagcaataatgtttatagctccaatataacaatggtgctagggatctaaactccaagttgtagttttgtgattacttcaatattaaatatgcatttttgtgatacttaaccttaaaactgtagttttgtgataaatttgatgctaaatctgt

SEQ ID NO: 90872 - DNA, 3414 bp, Oryza sativa
aacgggtggcttgcttttactcgaacttagtagatgcagccttttgatcgatcttaatccgcgctaattaaccgaacagagaggtcgttttcttgtttctcctcggtacggcttggagaactgtttggtgggtcctgtatttatagcatgaatcatcaactctgatccgagacggagtcgatcgatttgctgtctgcatagcgctgtttaattaatctgttaaaatcgagtcagagacgaatcatctaaagttaatccgattcggaatccaagtagtattagtaaggatacgtttccttcatctgcgcatggtaagctagctatcgatatcagcacatcccgggaatcatgcgagctcgccttcttggcaaagttatcagtatcatgatatcgtatggcctgtctgagagcttaagaaataattaattggtagccagcttctgagaatctgaaaaaattaggtttcctagcttctgactagactattttgtggattttacaactacattttctcagaatctggatcaaaagttgaactgtttagaggagcttctgattatagaaaaactgtagcagctatataagcttccccaaacatgtccctagtatcttcctgtactaagattctaccaatcccacctaggcaactgtagcagctatataagcttccccaaacaggtccctagtatattcctgtactaagattctaccaatcccacctaggctgtgttactgtttggaggtgagagttggaaacccatctcccatgcacggaaaacggagcagtctattagcgcgtgattaattaaatattagctattatttttcaaaactggatcaatatgatttttctaagcaactttcgtatagaaactttttgcaaaaaacgtaccgtttagcagtttgaaaagcgtgcgcgcgaaaaaccagaggggagagttgggaaaagagagtaccgaacacagccctagtatcctacttttaaagcatctcaatcatactattcattttcacacgatctaacgaaatcttaggtactactacctccgtcccaaaatatagttatttttagcacagtaccttattctaaaatgaagctatttctccacctacctttttctcttaaccaattacaatactacgattctaccaatcccacttagtatcctaattttcatatataatatctcaatactattcattttcacacaatgcaacgaaatcttaggtattactgcctccgtctcaaaatgtagctatttctagctcaatacattgtcccaaaatgaagctatttctccccccacttcctcctctcaaccaatcacaaccattctccttcacctactttttcttttcaaccaatcacacactttctccaaacattctcacatatcttttaatactcgtgtcaactttaaaaatgtctacattttgggacggcggaagtatctcaatattacgatcctaccaaatattatttaaaatcaggtagatttaaaatattgtgaataaaaatgctcaagtttacataaaaaaccaattaaatttatctaaatcaatattatatgctttaatttatacaccatattatatatatatatatatataagtattttctaacatctgatagtatcccgatactatggtagtattatgatactacatataaaaaaagatcctacctagtatctcgatactgattatttggtcggtggctcggtggtttcagcccatcgtcgcatgctcactaggaggtttgacggtctcacacccccctcccccccccgaatctatctattatctatccttttttcctatatagttggtacccactatagcattaactcctataaagtttgctccaggttaatccacgtcctcggcgcatgaaaagccatccgatcaaatccacatccagcatcaactgttgtttgctctcttctctcatcaagctaactctcgctcccccacccataagacgcccatcaaggcctgtgttttttagcctttaatcttcccctcccatccattgaccttccagaatatagcaattttctctccggcagcgaaactgtcgtcgtcaaaaggcatccgagtggtcatatttataattcatttattctcctttcacctaatgtatattttcataattcaccccactaatccttgcgatcctcatatatatcatcgttgatctagctgctgataatctgacatcctctacttccaactacccacacactagctacctccctccgctctccatggtggctagcgcgagtgggttgggttgaatcgtccaagagcaacggaggagcaaggaggaggaggagccatggcggctgggaagaagaagatggccgacaccatgctaggccgcgttgggctcacctcctggcccacagagtagcacggtcgctatgtcccgggggcgacgtgggcagcgaacaagccgcgccgcctccgcccttctcctccacaccccagcctagtcgccgcccaagccgccgccgatgaagccaggcggctgcaaggacggcggcggcggggctccctctccctcgctcgtggtcaaaccggatgggacgccggcaagacaggagctcaggcttggtgctggcgacgaggagaagcgcccggcggcggccagatccggcgccgtggaggccggatccggtcctccatggcgggatctgctcggcggcggggttggaaggtgggtcgggggcggcggcagggtttggcgacgggtcaggggcggtggcgacctggcgtagctggcgacgggtcgctgccggcgctggctcccctagctgcgcacgaacgctggcggggtggcgactggcggcagggagggcaacggcaacagcggcggggagggcgacgacgaaggcaggggcgcgcggcgcctaggcggcggtggttgtctccaccgtgtcggcgccagttcggcgagctgcccctctgtgcttctgatttctgtttgtgctccgcagccgctgtcctcactctccgaagccgctgtactcgctggtccctcaacaccctcctcaccctcatctcccttcgttgccgcttccttaacggtgcgggcgagaaggtctgggagcagccgcacctggctccggtgacctgctcggcaggctagccggctaccttggcagatgcaagcctgcagtttggatttggggagagagggtgaaagccgtgcacacccccggttgtgtgatcgacggcgacgccttttggtgccatatacctccctggaggcattgattctagtctccccaaccaaacctacaaccatctgctcggtgctctattcgtcgatggaggcatccgtggatgtcactttccttgctgaaggcatcgacgcaagcgtgccccctcctgcttcgcccttttgctctc

SEQ ID NO: 90873 - DNA, 1475 bp, Oryza sativa
tgagaatggtaagctcattttacctctttttcgctgcccgagtggatcgcaagttgtattgcgtgggttgcgtcccctgaggcgcgtcgggaagctgtgacatgtctatctcctcggcgtctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcattgcaaaaaaaaaaagaagtttgttaggcatatctcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatggaagtaactttgacaaatgcaagaaaacttacgactctgtctctaagtggggcgtgctccatttgatatccaactgtagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgtccttccggctgttctccattcatcaatgtatctattatgctctagcccccagtctttcaccttctttgttctcaccctgtcatacctagacaagtagaaggtgatgaaacagtagtgagcatcgacaagggttaaatggtacaaaattgaacattgacaatgaaagcaaacaaagataagaaatatttacttgtgtaattcaactccagttgagatgtcctcaaccggccaatcttgtttcttcccgaactgtcgcatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctgcaaaagttgaagagatgtcgttggttagtatctcaattaaagaagtaaatgtctaactagaagtgatattggaagtacttacatgttgaggctgcaagcagtccatctcattgacataatacttgtatgccacatcccggtgagcatgtgcagtggcagtactctcaaaaaggtaggccactgtcttctccatgtctggctcattgtagggccaaggagtg

SEQ ID NO: 90874 - DNA, 5282 bp, Oryza sativa
ttcttctcccatactttcttatgcttgttgtaaatgaacattgctgcacgagcatcctcaatctataagagtatcaaaatggccacgaaaattagtatttagtacaagcataaatgatattgacaagaaagtttagtcaaatgattacaagttttcgctgtacaagtgattaaccatgtgaaagattactagcagtaattcaagagtaatcagaagtacattttaaaatgaataaacaaatctacattgcataaagagaaaaatattatgtataacttactgggcaatgctctttctgttgtattttagcaccaagtacttgagcagtaagatctttcagtgatctcctcttcccttccctaatataacaggagcacatgtcaatacaatgttgagcaatcttaacaagagcacataatatagaaaatatatatgtcaagatcatctaaccttcgaaaaacctcatattctgaggtatcccttatgtccttctttgggtggcctagtagcaaaacctggaaaatgtttaccgtgttacacaagaacacaaagtgcataaataattaaattatggtcattgacaaccttaagatcatggtgcaaggcatgcccaacaagaattcttcctttgatcagctcagctacatctttctgaacaacccagaaatctttggctgcagtgttgtacaacattgttgcataacccatataggttgccatcctctaaagaaataaaatcatgcagtgccagtttagtgatgtttacctttattcatgtgcttcggtctaatcccactaatatgggtacggtagtcaacaatccgctctaccggtcttgtatattcatcatatacaacgttaccccaagagttaacctagtaaaaagcacaataagattaatgggtgatattcaaaagaagggtatttattataactaaacttcttcataaagaggctagaattctcttcagctttctaaatcaaccttaagtccacagcaatttacagattccatgaaatcctttgatgcttcaaccagtgaaatcaatccaacactcaacatactaagaaataacatatatgtacattcaaattacgaaagcaaagcaggaagtaactatacattggtttttgttccttctcaagaactacatcatgcccattgctccccatcagtaaaagaaaataagagtatgggacttccttagttgcttccttccttcctagagagtagagtgcataataaaatgatacaaacataacctctcctcgacgcattgttagcattaccacatagctggtattacagtttaatagtgggtctcatagtttaactccagcttctttgttctttgataaagataacgaaaatgggtacacaaatcagcagaatacttatatggtacaattaatcatgccatgcccatttgactgtaatattacaaatcatgaatttcaagcataacccttaaaatctcagccaatgcatgggaaccatttccatagcacagcacaaagactaggtgacaatattgccaaacaaactagtcactacttagtgaaaataaaaattgaactggctactggtgagaaattcatgtttcttactatatattccttgcaaccaaataaggccataaattcaatcaagtaaatgatccatctgagttccaaagttaataccaatacatactagctaagcccaacattttgtcattacccatcctcctattgtgaatagtccaactagaatataatccaaatcaaactctgtactcaaaacagttgcaatctcattgccagcaaaacacaaatcacgatactaccttctttcaagattaaacagcttatgtcgcctcctcaccattttcatcaaatcgtaacaacaaactccgaaactaatgctcgcgcatatccttgactcccgaactatactgagctgattaatatatactatgatatttagctcattcatcattgctgtgcgcacagaatacaaaaggatgtatggaattgagatttgggaggacggtgcttattaccaaggtgactctgccgagggcgctcttgctgccgcctgcgccgaccccgaccatctcgcaatccacagcgaccgccttcgtcaagctgccaaaaccattccccatccatccggccatccccacagcaatcaaaatcaaaacccaaagcatctcaaaagcggcagcacaatacaaagacaagaagatgcctcctcgcgcggcgtttgctctgatggctcacctggtgtcgtcggaggtgggcacgagcttgacctccgccgcctcctcctccgcggcgggctcggtgggcgcgggggccggagaagggtggtcggggcggtgcttgcgcttgccgagggtggtggcggcgacggggcgggggagcttggactggagctgcgcccagttagggtttagggtggaggcgccggctgccttcggcttgggcttgggtttccgcttcgggctcgcggcggcggcggccgccggtggcggcggagaagccatggatgatttttgcggcgcgggggaaccgcgggatttggggttttctgctctcaacgagggttcatttgatttttgtcttgattttatactgtaatcctgaaggaaatattttgcttccaccttatgcacttatataaagctatactccctccgtttcacaatgcaagactctagcattgcccacatacatatagatgttagtgaatataaacacatacatatgtatagatttattaacatctaaatgaatgtggacaatgttagaaagtcttatattataaaacggagaaagtaatattctcttatcaaacatttttacctttaccaagattcattgaaggctcggatggcctaatcaacaaaaaagaaacaaattttaaattttcaaacttaattttgagatattttcaatctaattttttttcagcattagcttttaagttacctagaacacatatataaaagttttacctacaaatttatttttattccctaataagccgttttagcttattagggaaaaagccaaatgatggggccgcaattgtttaaattttaattaaaataataaaaaccaacatcttatagccaacgttaagtatgtcttgtgacatataatcacacattttatagtctaaatatttcttaaaaccccactcttaacaaatatcaactaatttcagaatatctaaaacaatactttttaaagcagtggagagttaaaccaacaatataataaagaaattggcaattgcaagtttcatatatactctatatttcaaaaattgaagcaagtgacatttactaaatgtgtatttaaaatgtataatggtggggttttatgaaactttataaccatagtttatgtaatgtacatggtactttgtgcattttcgaccactaatcctcgctttttctatctgttggttccctctcaatcaatttcaatatctctaaatatatcgttggatacgatccggctctggtaattttagggttcgcctctccttacttcttagctcctcttcttgaccaacaatgcccaaatgtgttctactttaaaataacactgcacatgacctgtttggttgatatactcaacttgcctaagatcgtcataacttttataacttgtcaaaaacttcagctattataacttttgtttggcattaaaatggtgaagaaaaaatcctgtcataagtgtatcactgaagcaaatggatgcctaacagcccgtgatgattcatttaggcaaaaaatcaagatttgatctaaaagtaatcctgtttaggacacttgaaaagttgcacctgatccagattgtccaagagagcttaaaaggttagacaggttgggattgacttggacagagagaacacttaaaccttcttgaacagaagcaagaggcatcctcaaaatctattgatacaagtagaataggagaacaagtcatggtatcgcggttcaacattttacccattatttcatttagaaataaaaccactatacacaaacttaaaaaatccaaatagaaacatgagctaccacagttttgcaacttgggaactacgtaccccaccagcatatacaaatttggggaggcccaacccagcatcaagatagaaagaaagcctgtcaactgtcgctctcactccatgtatgcaatgttagacggtatcatatcttacaaaaagaaataactcttatgcaaaatatttgtacaagggaacatctcagatgagaaaagggatcactcataagcattttctaattcaggtcgaactgtctgttgcttctaattttctacttccaaaacctccagaactggtgtcattttcaggtcaaaatagatcctgatctctgactactgtaggcattcctctcaaatactccatccgtcccaaaaaaaaaaaagacaaacccagggtttccgtgtccaacgtttgaccgtccgtcttatttaaaaaaaatatgaaaaaaattaaaaagataagtcacacataaagtattaatcatattttattatctaacaacaatgaaaatactaattataaaaagattttatataagacgaacagtcaaacgttaaacacggaaacccagggtttgtctttttttggacggatggagtatagtagcagtggtgtataatcaactgattagacacttgagatcaagaaaacatctcaaactcgttgggctgggaaacactctcaatgccatggatcaatttcctccgtggacctacagcatcaagacccatatcttttagctggttcattgtaagggaaactatctgatgcatccccagcttttcactgtccaatatgtcaacaaaccaccacaattgaaaagccaattcttcagcccaccaaatccagcaatccgtctctcgagaagtcgtgctcgtattatcctattcgtaacttgggacgaaataactggcagctcttcctttataaatgtttccaaaagaatttcctgctttctcatattctcatgaaactgtccttgaatggaagcatggtttgctttcacaacaggggcaacaggacggcgtgaagatgtagcattttcctgagctttcttgatgttggtagcaactttgatgccctctggaagtggctcgtgagctttgttggtagtcatctgctttggatgcttctttctcgcagcatcacagttttccatgctctttttggctaagcaagctcttgttcaaaacttatttttgcatatcatcctgaagacttg

SEQ ID NO: 90875 - DNA, 1416 bp, Oryza sativa
gatgacatgacgtacatccaaaacaacttttcatgacctgatggaacactatataattaatgttatgtttgtaacatgcaataagaacagttagtggctgtgtcgtacatctttgttatgagaaaagaagttgtagtcagtacaatgcatgaacactggaaaatccaaagtcccagctggctcataggcattaagctccaattatactaacctccacaatagaagtcagggttggctcaaaactccaaagctaaaacatcaggtaaggccagattcagggaaccactatttacatagccttgtgtatgaagaaacaattaatgcattatttctttctatttaattgttcctatcagcattatgcatggactttcgaggaaaaatgatgcctagagaacagaaaacaggaactaaaccaaaagttacgtgctcaaaacctaaaagcatattaattgaaccaaaagctattcaatactcacaatgttcaggctcacaacatgcaaaggggcatcatagaatgcaacagcagtcaattcagcaccagtccacttgtttaatgtgatcttaggaccagaagctatcagcagatgaccttgaagagacgcaacagctgatacagcacctttactctcttttgagtagacttcagtgacctgcaattagtgtttacatgttatcaaatcaatcgatacgtaacggaagtaataacctttttcccaattgcaataatgctccctcacagtaccagattttgagaattttcacttttcgtgaaagagaacagaagcacacgtcctctagcagctacatcctccccaagaacataagcagtcccaatggccaacagggtctcattttccttggtggttgtattctgaagtaaaaatgcataactgttcagtgaataatataattaaacctacagacatgtgtacctttgatcattaaattttcaaacaagataaatctcaagcatagaaatgacatggcaaccatgcatttggaagaaaagaagatagaaaaaggaagtaatgatgactttattatagctgacagtttatgctaacagctccataattgaattataaagggtcaaatatagagtatagagggcatttagtttgcaaaaatgtgcttgtgggttgctaaaatatggtgtcttcaaccagacaggttcacttggtttgtcacagaagttcatatagtttggtttcaagtgggaatgagaaaagacgcatacatgtaatgtaacaatgcgcacgttagagcattttcaaacaattgcattggaattgtggacttcgtctcccaatgtccaccaggtttctccagctccaaaatgcggacctcaaattcatcaacagtatatgtcttatgaagggcatcagtgcttgtaacatcgttatccatgtgatg

SEQ ID NO: 90876 - DNA, 2208 bp, Oryza sativa
tttcagctagtacatggaaaagcttgtacctccaggatgggataaaaccgggacaacatccattttgattcttctcctatccgctcctttctgataccatgccttttctaaaatttgtagagttaagtacaattaaaattactatggttgaaaaggtacatgacaacaaaactaaaagcctaatgaaataacacaagataccttacgtagatcaaatttcagagtaaagccacctgccgaagactttttagaatcatgcccacaaaggcaacgcatattactcactgcaatcatgtcatcagcagataatcctgcgagctgcaaagaaaatgggttcttgctgaatcttgtggtattagtcagtatatagtgtagcaactgaacctataagcttttgcaataactatttctaatttatctactgtggaaaaaatgaatgaaacatagacctttggggaaaaaaacataaatcaagccccccatcagaacataggaaaaatgcaagtttagaatcctaatttttttccctttgaacccctttggatcgaaggaatggtcccatgaaatcctatgaaattcttaagttcaatcaacgggaatttttgaagacttctagcatgatgtttggacttcaaggaaaatttccttacttttggtgctgcatgcgctgaatggaagagaaaaaagtgtggcaggtgtgtatagccattttggcttcaaatgaaattcatgtcaattgatagcatacttatacctcaacttatttagtactacctccgtttcaaaataattgtaattttagattgtttagcatatattaaggtttgagaagaaagactatggtgccccttattaaattgtgtataggtaagagtgggagggtagttgaggtacaataggaaaaattttgaatgagaagtgattgatgggacaattaatactgtatcgtgacaaatatttttggacaaatttaaattctagaaatataattatcatgggacggaggtagtaggaaatactgatgtactccctccatactcgtaaaggaagtcgtttaggacagcgacacggtctccaaaacacaattttgacttgttgtttctataaaaatatttattgaaaagtgatatatgtatacttttatgaaagtattttcaagacaaatctatacatataatttttgcattttcaaactcaacaacttgagagttattcatgatttatattttcaaggtttgacttaaacattgtcctaaacgacttcctttatgagtacggagggagtattaccaatcaatagcacataattacatcaaatttatatcggtacagcagtttacactgaaagacatacatccatgtgattaataaatatatgcctatcctatatacttatgtgactacttcaacctgggcttcaactgaagatttgatattttgcagaatggaccaactgaaaacatgtaatcaaaataaataataaaagaactagctgctacaggtagttcatcttttcaatttttaattgtttctacagcttacattgtactttggttttttgaagtccccaatgtgtagatctccagattgaattttttttttttatgcttatgaaagcacaggcagagcttcctatgaatatggtgtcaaattgccgggcttcaacttcctatttttcatgcttaaattatgttctgttagggacaaggtcaatgttgctctacacagagagtccaccattacatgagacctaatttttgttcactgtacatacacagaccaagtaccataaatattacgttgccttttaatcaaccccatttgtcatgttgagataacactgatgttttcctaaatttcttacgcatgatagtattttctgcagcaacgcataagcatcatctagcaatcaggcatgcatgaatcttgaggtgcttgttcagtgacaaggcaccattcaagttggtaaagttttattttaaaaataactgagcagatttcatgatagaaaagtaaagttacctgcatcaactttgcacccttatcacttcgagttttatctggattgatggcagcataaaccataagcaaacgcagcttattttcacgactgatatcctgcattagatccatgaaaatattaatattatatacatacaggtaaaatattccaataatttgtccaaatagccattaccaaatgtgtcc

SEQ ID NO: 90877 - DNA, 4941 bp, Oryza sativa
caggcattggtagatcacatattggcagtgatcattgcatattgacaggcggacaaggcagggaatgtaactactaacctcaacatgaagcgcaagcttgtcaatttgatcactgtactgcggaagagcttgaaccattttttgcaactctttggttgataaatctccaccatttctgacaaatataacacaagcatttacattacaaaaagaaaaggatcctatcaacagaaataattaattcaacataaaacaaatctttgaataccattaactattcagtatggcaagtataccaagaaactagatgcatcagatatttaggctgtcattgtacgttgcagaaagtattaaattctcactaattgaaaaaccaaaataaatggaacaatcaagcaaacaccgtgtctcaatgacaaatagtaggaacttaaaataatcttattgacacaaatggactaaccctttgggaatcagtgcagtagtccatggttcaatctgaatctgagctatatcaaatttacccgctattcaccttagtaatcatctgttgaccactataaatgtttctaaataaccaccagaatattcatggctcatcatttcaatgaatagataataatacatcaagtcatcaacaaaagctaacacactctggcaaacagcctaggcaggagcgaagctacattaacttacccaggtgcacgggacacccagtgttaatcagtttccagtagtatcgttgcatgccctaagagagggacaccccatgggccaagcataggaacacccgtccaagccaaccagctgagagcgcagcctaggaatgtctccgttcagcagatatcgctgttcagcaagataggcctgggcaaggatcaactcactgagaggctgagactgcgtagctatgctgtcgtctggagtgtcttaagcctaccaggtgctatcgtttttgcattcctggtttctttgaattatcccatgttcaattatctgtcctacacaaccaatatttatttatgataaacacttctataactaaatatctgtctgcatattattagaaataagattaaaatgagctatgtttgctctcaaagcctataaatgatcacgttaatcgaaaaaagcaaaactatactgtcaggtcctgttcatttttagctttttgtctggattattgtcgcagattatttgctccacccttctaaaaataaagcttctcaaaaaagaaaaaaaaaggactaaccctttgggtataatccatgtaaataatccacacaaaaatctgtttccaacagggccatatgactactacaaaaaattgcctaagcaatattgatgtataagttatagggaacacattgttttagggacttaggaaacatgccgcataccagacacaagccataagcgaaaaatagcgcacaattagtgatacatatggggcacccggttatttttgttctgggtttgctcctgagcctaggttttgcaatcatttgcacaaaaaagtaagcataataataaatgcaataatgcatttaatataaattccaacatatgttgttgtaatagttgcagaccacggtcagttagtattccattcatccccctaatttgtgacaattacatttattgaacaaaccttgcttgatgtagttgagcagctttgttttttgatacaaaattggtcatcttctcatgcaatctttcactagcctgcaatattgactccatgatgcattaatgaagcatatagataatgtttggagacaatggtgacagtctcacattggctatatgtacatgccgaagctaagccatattggatcatgatcctccaacaaaacctccttgttctcagtgcctgaaccagacttgcttgggacctgttgtttcatggtcagcattcaagagcacaacagaactgaaaattggtaaacaagctactacaaatgaagattttgacatgctcacctgttgtacatacttgttgccatccatgcagagtagatcatgacacatggcatcataggtccattcgtgaataattggtgcgatctgaaaacattaaggaaacatgagaacaaatcattgcttcattcaatgtggtagtcagtcaaactaaaacactaaaaaagggaaaattgcaaaaatcaccccagaaatgacttgaagtttgacattccacctcatacctgatctattgatcggtctacgataagtaattcacatgtttcagtctgagggaattcaggtatcatagccttaaatcttgcaaggcaattccacacaccagcagcaagctttgtgggtgccaaatctcgtagtgttgtcaaagtagaagcatcaatcgtcctggcaacacgatagtgcacacgaggaaattcctaaaataattgaaagcaaacaacttaagtaaaatgtatggcacaaagaagtttttttaagccaaaagtttcttaagaaaatagacacccaaacaaatattagcaaaacacaacaaaataaaatttgaatgactcgataagtcgtcaaatagttcttttacttttttagtaatatttttaatggaaaattgtaagtatcgggtttcaaattcttttgctaaaatagcactcactcagcacgccatatacccaagcagaatgccgactagccctgtcgacacgtggcgtgctgaaaaggtggacatgtgtccggagtggccgtcaccgagacaggtcctcttggcaaaaacacatgctgacaggtcatatccgcaaaccatttgccgatagggctacctggttaccagcaggccgttggcctcctcccatgccaacagatagcgaggcagctgctagcctttcaacacagtgaatgaatgtgtacccatgcagtgctattttggtaaatttgtttgaaaccctatactattttagcaattctccttttaacaaataatagtaaaatatatttaaaaactctcaaattggatcctgttttgaggaataattcttccatatgtgtatcagtggataattggatggaacaacctatttgtttgatatttctttaagtttgtttcctccattggcagaaaaacaacaacccaccacatctgcagtgtgcatgcttaattttttatagttccaggcttgcagaagacatgcgttacaattaccatatgtttttcctttctcattctttaacagtatattaatttcttacttatcaccaactgttcttttcatgtttaaaccataagaacaggaaaataaacatttaggtatatagacatgtcaagtagcataaaatgggaaaacagtaccctcattgatgcgaatactgtagcaatacgagtggccatcatgttaaggcaagagttatacttgagtgaaccttctgcattttcactaaatagctcttctagggccttgtcatggtcagttgtaaagccctgtatataacaacaatagattcactgaagccaaatacaaaattttatgatgaactaaatcaataaggagaaaggattgatttctttatggtttaaattaagtcattaattttttttaatctaaagccagcagtatcaaaaggctatgctaatatacctggctatcgatagcaaaatattccagattcatctgcaagcataaagcacaaatgaattaagaggaacaagtgtaattgcaatgttgaaaaatgagaacatgcaaggaacagataatagttaaactgacctcactgagtgcacctatgcgtgctctaacatttgaatctttttttatttgggccaccaactctctttgtacgggtgaactgaaaaacacataggctctgaaacacgtaagtatcgtgtccaaaataaaccatggttggtaaggtgtctccagtgttaccaggaatcagacaaaccggtttaaccggttgtttaccggtttgattgcacagcggtcttttaatcgaaccagaccagtaagagcattggttccggtttattctggtcggaccggcagtccagtccggttctaataactatggcgacaatcctaccacgatccaattgattctctcgtgtactctccccttcctgtatttgcggatctattgcttcctgtactaattgtcttcccctatgttccttcccaacgcttacatcccctgctgttgtactcttctatgctcttcctccccaggcaccatctgttccttcccacacttacatccagttgtgtactagtgtctaagccgtcgcctcgccttatgccttgccgctaaggcagtctagggtcgccttaggttgccttactgccttaacaaccatgaactaaacttggaagtgatacaacatgcataaacaagtaaatgcacaggacacatacttcttatacagtggtattttccctgacatgtcggacatgaatatgcgaatgctgcatcaacaccataataaattggttagagagtttgatggacaatacaactttcaatatcagcagcaaaccattgacatatatgactggcagttatcaatatcagcaggaaaccattgtctatctatatttccacatatgtttttcagtggaattaaatgaaagctccagcacaaattaaaggataaaaacaaatttaacacatcatatataattattcactaacaaatggaaaaattcggttttgtgcctactatcaatcagtaaattatttctgtgatcaatcagtaacaatggtaataggatgtggtaactagtcacacttacttttccttagttggttgaatgaaataaattgcatccatcaatggtaatggttgcctccgcatgtataagtcctcaaccactgcaaaaaaaaaaaaagaagcaaattctcaaatgtatatagatagacaatatttctgcgaggaaaatttcaaaaaactaaagataaattatcataacgatacagggg

SEQ ID NO: 90878 - DNA, 836 bp, Oryza sativa
cgtcctcgcgcgcgaactcccccttcgtcttcagtgacagggtccccctgtacaccgacccgtacttcccggcgccgacgaggttggcgtcggcgaagtcgtcggtggctttcgcgagctcggcgtacgtgaccctcgggtagtagttgccgttgagcacgctgcgagcggcggcgtttccggttctcgaactcctgatcttgcggcgccaccggagcaaggcgaacatcacggcgaagcaaagggccgccgcgacgacaggcagagcgatcttgaggaagagatgagctcgtcgtgtggagttgcccggcgccggacatggcggcaaccgtagccgcgccgcgccgccgcagagcgcggtgttcccggcaatcctcagcccggtcgtgttcgcgaacacgccgtggactggaacctggccggcgagacggttgtaggacacgtcgagctccatcagcgagctcatggtctcgaggctcgccggtatgccgccggacaggtcgttccgcgagaggtacagctcttgcagtcccggcatcccgccgagctccggcggaatgctcccggacaacctgttgcccgtcaggttcagcctcctgagccctttcagcccactcagagatggcgggatgcttccgacgaacacgttgcgggccaaatcaaggaactccaagctctggcagctctccagctcggtcggcacctcgccagagaagcgggttcccccgacaacgccatgaacgcgagcttcgtgagctggccgacgtcgggagggatcgggccgtccagctggttgtccgacaagtccatcagcagcgacagcgacgagagggtga

SEQ ID NO: 90879 - DNA, 593 bp, Oryza sativa
gggaatggccatgattcagagattgatgagtttgtgaagatagcttttgcgtgtatcatggttcacccgagggagaggttctcaatgtaccgggtttaccactctctgaagagcattggacagggtcgtgatgtctcagagcaatttgatgagttcccgctggcctataacaaggatgaatcagataccatgtaactaatggtggtggtcttgcttgggattgtgaaccgccctcggtcaggctcaatggatgcttctttgtgtagtcctgctacttgaattgatgaagagcatgctgaggcaaccatattggcatgataattattgctggatgatcaattcgatgcttgcctcatctcctgtcgagataatcgtgtaagctgtaagattttagtctgtattgtctttttacattattgctagcgcttgtagtatctcgctttatgcctaaattctgatatgaccttccttcttggaacaacttgcctccttccccaatctcctaagaacaatattggcagtgaacaaaattaatcttgaccaatttatctaaagtttacaggaatgtttcgctctgtcatgtactcatgttc

SEQ ID NO: 90880 - DNA, 1577 bp, Oryza sativa
tctatctttgcgggttcattgtttagtattcatactaagtgctctagtactaggactccggataaagaaggaagttcctacgcaagtattagagtagtaattaataacttagacgtggtgtataggttagagattacctttgtttgttgtgtatcccacggatttgtcagaggtaggtggcaggtggtgacagccctgaatcccgtcctagtaatcctccacattcaggcatatcatagagctatagccggaaccacgctggcagaccagcaggggtcggtgcccgaagcaacagatagggaatgacctttacttagcttagataattaaaacacatagaaagtcctctctagcctagcctgcttaccatcagttgttatccttggatagtcttagccttaggtagattacatatgttccctgagttcaatatccttttggggtcatctgaaggtgaagtgctacagcggtattccgtgcgcttgcggatttatttgtggtcgtaagaaataccaacacacatagaaaggattagagtatcataaagatgtaagtactaattccgagaatacaatccgccataacaagctttacctattcgtcagagatcgaacccgatgcagcccaactcgaaagcaaaaactcgttgaaacaatgaaattaaaaaagggtggcgatacaccgaagtattattgaactgtcgtcctttgatcacaaggtgtcgggtcctatttatacccaaagtacataatatatccttgttggacacggctcttatgtctaatacaatttaaaacacgaacaagtcccctaggcggactattaccaaaaatatctctaagaaaactaaaaatatcataattaatagatacaattactcattttcaagactccaatccttgtgtggtaatggctatgaagtgctttgatagatcccgatgatagatgtgggaccgtctttttcaagactgattgcatcggcttgactccgttggatttggcgccaacctatatatggcagccgatgccgctcgtggccgatatgcaccctactcttcttaaacagaattcctccaaatcgactttgattctagctttgaatctggcccatggcattaccaaatttggtcgttaacagatctacgatccgatcacaccattgtatttgtcgtaattaaatctttacaacaaagatattgcatggttatattgtaatgaaaaaaaagatgtgtgttcaaccattataattcaatatttcctatgtcatatagatatgtttcccattgtgttccaaaaattcacacaactacctccctcttctctttctcctgcttctctccattctatccatcaatgcatggatttagtgagctttacaatgatttttcttctaaactatttatcaaatctatgatccaatatcgtaccatttgtatttgttgtaattaaatctttagaacaagatatcgcatgattatattccgacaaaagaaaaatgtacatttcaggacattaaagctcattgttttatatgtgacagcaacatgttgcaacacacgttctcattgtttcacaaa

SEQ ID NO: 90881 - DNA, 1163 bp, Oryza sativa
tgctttttgaactttttgattcctgtcgaaaacatcacacccacgtgtgacattattggcattaattgacaaaagttcgtcgcgtgaatcacgaagtgattttttgccacgaacgcacccaatacactccaatatgttcaaaaatcatgttttggtgctttttgaacttttgcattccagtcaaaaacaccgcagccacgtgtgccagtattggcattaattgacaaaagttcgccgcgcgaatcacaaagtgattttttgccacgaacgcacccaatacactccaatatgttcaaaaatcatgttttggtgctttttgaacttttgcattccagtcaaaaacaccgcagccacgtgtgccagtattggcattaattgacaaaagtttgccgcgcgaatcacgaagtgattttttttgccacgaacacacccaatacactccaatttgcccaaaaatcttgttttggtgctttttgaacttttttattccggtgaaaaacttcgcacacaagtgtgccaatattggcattaattgacaatagttcgacgcgcgaaacacgtagtgattttttgcaacgaacgcacccaatacactccaatatgtcaaaaaatcatgtttcggtgctttttgaacttttgcaatccggtgaaaaacatcgcatccacgtgtgccaatatatgccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatctttaaaatcatcatcgtgcgcatgttgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtttttcaaagattcatgatcagagtgtataacaaattctttgggccataaataatgctgccatgtttcca

SEQ ID NO: 90882 - DNA, 1380 bp, Oryza sativa
tgatgggccatcgagcgatcgccggccctatggccccaaggcttgatgggctggaaaggcttcttcggtcctcgcgggggcgaacttgccatggcaaagtcgtcttccttcggcaggtactcttcgccttacacccttcgtccgagacgcctctggcttgacaaggtactcgcacgacccctcgcctctcgctgttctcgctccatagtcttcgccatgggtttcggcagatttggtcgaagggcctcatgccatccttcgaccgtgcaaaccatgtggtatggtatgcggcgccccctttcgaccgatgctcctgccgaaacctacaatgttcttacgaataaagtttgttatttgcgcggcctgtactattttgccgctcttcgcctcctgcagtctgtggcatacatatatatattttttacttttccccggccgaaaagaacagtattgggctttcccttcgtgggcttttttactgtgctgcccggtcagtgggaatttaccgtttctcctacccttgcgacacgtggcgctttattactggtgggtaggcgaaccgtcgctcgggtgagctatatattcccacccctctttcctttccaccgccacacttgacatttttaccgcgtgcgctctcttcgtccgttcctttcttccatagcatttcttgaaccctcaggtgtttcgcccattctcttccttcgccaccgcatacacgccattcgccatggcccctcgcaagccaaaccttgcttcggcgaaagggccggatcccggccgggtcgatgacgacagcaccgccttcttgggggtttctctcgtggatgacgtcgagctggcgaagttggtcagctctggtgcgttggttgaggggcaggctttcgccccagggaaagccgtggtgccgaagcctgtcgacaatcggacggtggtgttcgccgtcctttttgaggcggggctacggcttccgtgcaacgtgttgttgccggagatccttcgcctattccaggtggagcttccacagttgagcccgtcggcgctagtccggatctccatcttcgactgggcgtgccggacctccgggtttgagcctagcgtcgagctcttcggcaccatatttttcgccaccgtgaactcaaagacggtgattaccccagcttgaacaaagaagacagtgttcgggagcgtgaactttaacgttcgccccgagcggtccgatctttggccggtgaatgctgccatgtcgaggtggttctatcacaccatccccttcgaggctggttccgactcgacgaaagccctccggtgccggcgtagggcgattgcgccgaaccgaaaaccctagatcgccgtggggggcgctatggaggcgcggtt

SEQ ID NO: 90883 - DNA, 1712 bp, Oryza sativa
cctccccgggcaaacccccacaaagccgacgacaatgcaggaccttcgcgaaagcgaatgcgcggacaagtgaagcttgcccctaggaagcgaatggttcctgcttcgtcgtactccgacgccgacgacgaagacgatgccgaagagcatgacgcgaggaggaaagagaggaggaagaggaggtggaggccgtggccgaaaaggccgcgaacgaggcgatcaaagaccgcgtcgacacccctggctatactcctactcccagtccaggtcacaaggagaccggggtggagtcaaacagctccccccttcgacgaaaggatttggaaggggcgaaggccctagttgcattttcgtcgggcaaggcggtgaaaggaggtcgggtcaagaagatctctaaaaagaaaggactcgttgacatcgctcgcgttttcagcgacgacgagtcttctgacgagacttcgactttgcccgctggccacagtctggacctttcgactgctccccttcttccactcggcgttgctggggcaggcggtagcgccgccgccggagcttcagcctccgccaaacggatcgtgacggctgcagcgagggtctttgggagccctctgcgtgaaccagctgtttcgccgttggtcaagacgaaggggaagggtgtggccgccgaagcatctgcctcggaatattcccttgcggcgccccacttcgcccctggtgatttcgagacccgggcggaccttattccctttgtggagggagtaagcaatcttgtcctacccgccggtacctcgagcctgttcaccgaactgaatgagttcgatgaggggtgttctgctattaaaagcttggctgttcaggtacgctttttctcccttcttcgttttcctctccccccttttttttacatcacacaattaacattttgttctcttcgcccgctcttatcttgcctccagatccttgcggctcactgttcgacagagcgaaccgtgcgggcccgtcttgacggatttaagaaccgtcttcgggccaaggacgacgaaataagccgcaagaacttggaggtggaggccctcgcgaacactctcaaagaggtgaaagttgaagtcaagcgccttcaatccgagttggagaaagggaaagaggccagggccgaggtcgatcgcctcaaggccgaactggagaaggggagagaagccatagcggaggttgatcgtctgcagaccgaattgaaggaggagaaggcccattccgccgtgctgactgattactataacctcactgagccgaagatggaggctcttcgcctgaaggttagcaaggccgaagcgagtgctgtggaggagtcgcagtggttttcgcgggagatggtgaaaactaccgaatccgcgagaacggcctgccaaacgctccgcctcgcccttactgacatgggcgcgaaggtgtgaggggtccctgctggctggtgattctgtttcggactgcgccaccgcgtacggcgattgctgcgtgcgtgtatcggcggccttcaccttgggccttttgcaacagttcggctgcgagcacgtcgccgagttccctaactatgcgaagggggactaggagattagtgcgcgtggcgaaaacagttctggcagaaggacggccggtccgctgccaaggcgcgcctttgggagcaactagcaaaggcgaaggtggcagaccagtgcaaa

SEQ ID NO: 90884 - DNA, 2437 bp, Oryza sativa
gaaacaggttattttgaatggactatatgaagaacaccatatggaaaaaccgaggacggttttccgtgaagaaggggaggatgatgtgaccatggctactacgaatacatccgttgctcacatcatggatgaacaacaagatatcaagttcgagtcctccaagtgccaaaatccaattcggccacctgctacactgctgacttcaaacggccgccgaagctccatacgacctccgttttcagcccgtgagtacttgatggaaagctctcggagtcctctttccaatgcatcaagcctcattgccaaattccatctcagtcggcagcaactgaagaaacaaggtgctgtgacacctgtaatgggcctatgggcttgtaacctcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgtttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcactgaaagatcgggccaacaacagccttgagtgtcgagaggaactcagggttcatcagccttccaccaacttggagtcggttcggattagcaagcgccggaaccccagtgctttcgcctttcttagacccaggagaatatcttcgtattccgctgcgttgttggttgtgttgaactgcagccttgcagcgtaccgaatcggcacaccattcggtgaaatgagcactgacgcaatgccttgtgcgaccacgaaccgtcggagcacatcacccagaattattcgatgagctcgggctcaggggcaaataccggtgtccattcagctacgaagtcagctagcacttgagacttgatagcagtgcgtgcaacaaaatgcaagtctaacagggatagctctgccgcccacttgctgagccggccggtgacttccttgcctcggagtatttcgcccaaagggtactatgatggcactatgactttgtgggcctggaagtagtgcttaagcttgcgcgaagccatcaccagggcgtaagtgagcttttccatttcaatgtatcttgtcctcgctccttgcaatgcttcggagacgaaatagaccggtttttggccgaactctgtttcctggacaagggtagcgctgacttccaccggcgaagcttctaagtatagtagcagttcgcttcctggtgttgggcttatcagagctggcgggctttgcaggtattactttagctcgtcgaacgctgcttggcagtctggtgtccaattaaactttcccgtgccccggagggtcttgaagaagggcaaacctctttcggctgcttttgagaggaattgactgagtgccgcaattcggcccgcgagcttttgtacttcatgtatgctcgatggatgattcatttgctgaatggcatcgattttctcgggattcgcctcgatgcctctttcagaaacaaggaagcctaacagattacctgcgtgaacgccgaaaacgcacttgtcaggattgagttttatgcccgctgcacacatggtcgaaagccttgcggctttttacgacgatgtcatcgacataggcttccacgtttcgccccaactgcttgcaaaggaccttatacactagcctggcgaaggttgctcctgcattcctcaggccggaaggcatcctgaggtgacaaaatgtgccgaacggagtgatgaaggatgttttggggatgtcgagtgggttcatgtggatctggtggtagccggaatattcatccaggaaactcatgagttcgcagccagctattgaatccacgagctggtcgatccacggcaaagggaaatcgtctttcggacatgccttgttcaggtccgtgaagtcgacaaacatgcgcaattcccgtttgacttccgcaccagcactagattcgccagccactccagatggtcaatctcttgaatgaccccggctctgagaagtttctggacttcgacttttgctgcttcttggcgatcggcggacatcttgcgcaacttctgtttttttggcttggtattcggtttaactgccaggtgatgcatgatgagatatgtcgaaacacctcccacctcatcggggctccaggcgaagatatcaa

SEQ ID NO: 90885 - DNA, 629 bp, Oryza sativa
cgtaccaaccacaagccagcgtgggcaacggctttatcttttgtatagcatggttcattacggggtgccagactgagaagcggcgagaagtccgtgggggtcgctggggagtccatgcctttggtttttgagggggtgattataatccaggaatggtgcactatggtgagttgtgttgtgcgaagggtattgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggctggttgagcaatatttttcgtgattagtctcacacctctcacaaatagttattgatgcaataactggtaataatttgtttagctcctggtttggagtttgtgcagcattggggtgctgttcagtgttgattaaaattgatgattaattactctactgttttacttctcttaaatgtttgctaaatgctgcttttgcaaatgagcctatattatgccatcctttggtatccttgtgcacttgcatatttgctgtgtggcttgttgagtatgtcatatgctcattcttgcaataatcaatca

SEQ ID NO: 90886 - DNA, 1330 bp, Oryza sativa
tagagctcgccgccgcccaccattcgtcgtcgtccatcgcgtttgctagtaccggtgagttcgcgtcatcgtcctctacgtgtagatgactttagatagccctgccgacctctctatcgccggcaaggtcgttgcccgtgaaattgcgcgatgatgacgtcagcatgacgtcatattttctttttccagttttttttctagatgcaaatagattaaaacttcagaaattcataactaattcatcgtaactccgatttgagtggttcaagttgctaaatttttctaaaatcgagatctacatgttaaaaatatccacatgtattgtttatgcttgtttttgtactgttttgttgattttgttctttcgctttagtttccgacgttctgaaggagagcgttttcgttgaggaaggttcagaagcgcttgatgaagctcaaggcaagtcacacagatcccaaacgaccctttgagcatgttgaacccatttaaagctaatgttttatttcaacttatgcattattttcgaatgtcatcgggtggtgagcctttcccaattaattattggccgaagatgactttattttcctatgggttagaattcgattagctagaaccttatatattggtttggttcagctaaatgctatatagatataattgcttagccatgcttagaaacattagctcattaatggggtgaatcatattacattattacttatggttagatttaaatgtagcttacgatggttaatcgtgttatgataattaattgataattaaaacttgtcaatggtgggttgtgagcacatggttttgaagttcgtgctcatgacaattaaggatcggttcgcgagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgaggggatgattatgatccagggacggtgcgctgtggtggattgtgttgtgcaaggggtactgtcacagttcctatccgagatatcgtggtggtattgaggcgcatggtaacatgtcgtggagctgtgtcttgtgagtacagtggtacatctctagctagagtaaaactattcgaatagccgtgcccgcggttatgggcaagttgagcaatgtttttcgtgattatctcataataattatggatgctataactagtaataatttatttagctcctggtttggagtttgatctgtatagccgggtatggttgttcagaatggt

SEQ ID NO: 90887 - DNA, 614 bp, Oryza sativa
atttaatcatgccacagttctagagtgtctcatagcaaatgcccacaaaactagtcacacgaccaactttgccttgtgagatcttacctcttcaagaactatggcagacatcaaagcaatcaatctgttacggtttaactcacgaccacttgaatcaacagcagcagacctgcaaacggcacaattttagggttgtgcattacgaacctgtataatttcaatggctatatattttatacctgtcaacatcagtatcaaatatgatgcccaagtctgccttgttatcggccacagcttgtgtaatggctttcattgcagttttgtcctcaggatttggaatgtgatttggaaacatgcctgaatatgtaatttgtaaaatgacaggcaagacgagactaccggcatgaagaaaaggtgcagatattaccatcaggctctaggaattggctcccagtagtaatagcgcctaacggcttgagtaccttatcctgatccaagaacaacatgaacttcaaacaaaaaatggtgcattgctgaaaaacaattaatggaaatatggaagtaaagggattaccacaaaaaagccacctgctccattccctgcatccacgact

SEQ ID NO: 90888 - DNA, 2021 bp, Oryza sativa
tgagcatctgtttttcttcttttgccccgtctgctcttcctccagatggtctacaccaggaatggtagccgtacaacaggcgagggcagcaacggcgaagagcgcactgatggtgtgcatcccaacagcgatttcggcaatggtccgccaccactccccgagaatccgacccttgcccaagtaatggctcatcagacacagatgatgacagctatgacgcagcaggtgcagcagcagcaccagcagatgtaccagaggatgcagcagcaagccgagcagcagtagcagcagtttggtccccctccccctccgtccaaactgccggagtttcgacgcattagaccacccaccttctccagcaccaccaaccctatggaggcgaatgactggctccatgccatagagaagaagctaaatctcctacagtgcaatgatcaggagaaggtcgccttcgccacacaccagctccaaggtcccgcatcagcttggtgggacaatcacatggccacacgcccaccaggcactgaagtcacttgggcagagttctgtcgcagcttcaggcaagtgccagatgggttgtggcacaaaagaagagggaattccgggcactccaccagggcaacaggacagtgacggagtatttccatgagttcaatcgcctcgcgcgatatgcaccggaggatgtccgtaccgacgccgagaagcaggagaaattcctagcaggtctggatgatgagctaaccaatcagttgatatctggagattacgccgactttgagaggctggttgacaaggcaatccgccaggaggatcaacgcaacaaaatggacaggaagagcaaggcggcgcagttccggtcaaaccaagggagccaccagcgaccgcgcttcactcccggacagcagagtggacctaccaccctgatcgtccaccagcaccgccctttcaatgccagcaacttccatcagggtgccagtggcagccagaaccaccatggtggtcagcccaaccgcagtgcagctccgcgcccacaaatggcactagcacagtcagctacgtccgcgcaagccaagaaggagactgggacaaagccagggtcctgcttcaactgtggcgagcttggccacttcgctaagaaatgcccgaagcctaggcgtgccgagccaaggtttgtccaggcccgtgtcaaccacgcatctacagaggaggcacaagcagcaccagaggtggtactaggtaggtttcctgttaactcaatcccagcaacaatactttttgattctggtgcaacgcattcgttcatttcaaagaagtttgttgggatgcatgggttaataagagaggaacttagcacaccaatgcgggttcataccccagggaatagctccacttcggttcaattcagcccttctataacaatagaaattcaaagatcaccatttctggccaacctcatccttctcggatccaaagacctagatgtcattcttgggatggattggctgaccaagttcaagggagtcattgattgtgcgaatcgcacagtcaccttgaccaacgagaagggagaaacagtagtgtacaaatcaccagtctcaccaaagcaaggggtctctttgaatcagattgaggtggaaatcccagtggtcaccgaggagaagaattcgaggaaattggaagagattcccatagtctgcgagtacccaaaagtgtttcccgaagacctcactaccatgccacccaagagagagattgaattccggattgatttggcaccgggaaccgctccaatttacaagagaccgtacaggatggcagccaacgagctagcagaggtcaagaagtaggttgatgagcagctgcagaaagggtacattcgaccaagtacctcaccttggggtgctccggtcatttttgtggagaagaaggacaagcaaagagcatgtgcgtcgattatcgcgcactcaatgaggtcacaatcaagaacaaatatcctttgccgcggattgggctgcaggaat

SEQ ID NO: 90889 - DNA, 568 bp, Oryza sativa
catgttggcgcacggaaacgtgtcgtggggctgtgtcttgtgggtacagttgtacacctctgatcagagtaaaactattcgaatagccgtgcccgcggttatgggcggtcaaccagattcactgtgattagtctcatcctagtttagtctaatgaaattggatagtataggtggatggttgggcctgtcgcaacggggtatagcgttggacagtggatgaataatattgattaattatcacgactgtttaattcttttaacttctgtttataaatgctcgctttatgcaaatgaaccactctagctctcctttgataattccctgcatcatacccctattccggtatgacttgctgagtacagtgggtagttctcagtcttgctctattttccccaaccccagagtacgagtatgtgtcagatggtggtttctccgaggagtaggcttcgtccgtgccgtcgaggatgcctgtggagtggtgttcccgctgcagatcaagtcaaggcttagctccagttatctttcatttttccgctgcatttatgtaagacttttatgatgtttgta

SEQ ID NO: 90890 - DNA, 1088 bp, Oryza sativa
accctcggaaagtaaacgtcgcaatgctcgaccaatatccacaagaaacagaggacaatctcgtccatctcctgaaggcgcagcattacaagacgttcatattgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactctatgtagggcttggtatcggttccgtcatttggtccgcggcaaatggagagaaagacttaggcggaagttcaaatttcctgtgaatacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcggggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtata

SEQ ID NO: 90891 - DNA, 676 bp, Oryza sativa
aattcctgcagcccacaaaatactcaaataatttgtagccagttttttttttttacattttgtatctctttctagttaactggcctattttcttgttacattttttaggtggttttgcgaccaatatcattggaatgacttctacggtggccagatcacttgctgatgatccagatccaagagatattatggaccatgtaccaatcggaaaatggatagtatacctattccttgttggtatgacgggagtgttaataaatgtgccatttaaccaggtttcttctttcactgattgatcatttttttttaattttagaagtttctacttaacatttctaagattgttttgcattattctcatccttaaacataattcataagttgatttccttatactgcaggtcatgattattgactacaaattactatttccaacaggaacagttatagctcagcttattaatagctttcatacccctgaaggagcttacgtagcaaagtaatgaagtcttgttttcttagtaaaaaattgacagattgaatttcatttaactatattcatgattttgtgcactaatatttgcatgtaatccagaatgcaggttgcgaccattttcaaagtattttttggcagtttttcttggtctatgttccagtggttctatactgcaggcga

SEQ ID NO: 90892 - DNA, 588 bp, Oryza sativa
tgtcaacagcgcagccttcctgtcttttcccaggctagcgcttccacatgttttatggttgcaaagcctcattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatctttgaacatattgaatcccagtttataaaattattttgatttaaattaatgcattatcgctttatttaaattcccgtgttatcactgttttatttagccatgcctatttacctttgttaagaccttattattgctattgttattattaccttggttccaaaaccccccccccttttaaggggggggggaaaaaaaaaaaacccccaaaaaaaaaaaaaaaccccccccccaa

SEQ ID NO: 90893 - DNA, 621 bp, Oryza sativa
aggtcagccatgcttaaaggattcaatgtgcctcaaggcaaatattatctcgttgatggtggatatgctaacacgccatccttccttgcaccgtaccgtggtgttcgataccatctgaaggaatttgggcgtggacagcaacgaccaagaaagtatacggagttgttcaatcataggcatgccatattgcggaatcacatagagagagcaattagtgttcttaagaaacggttccctattttaaaagttggaacgcatcattctattgaaaaccaagtgaagattccagttgccatagtggtgttccacaatcttatacggatgcttaatggggatgagggttggttgaatcaccaaggaagcaacatatctccagaacagtttattgatgtccctgaaggtgacgatgaatatagtaatgatgtgatgtcccttaacagtcaagtagatgatggaaacgcggttagagatatgatagccctaaatatgtggaatgactacagtcaaaacttgtcttaataaatgtgagtcttaactggtctcatgaaatattttgcttttgtatttgcatcatgatgtttttgcatgcttaaatttgataacggttttttttttaattcg

SEQ ID NO: 90894 - DNA, 1834 bp, Oryza sativa
cggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctattcgtgtcgatgccatgggacacgatggaacaactgccacgtattacgatgccatcgaggacatatgggaacttgactatggtcctctcaaggttcctctgttccggtgccaatgggttaggttgactggtggaggcgtaatgattgatgatagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcatgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatttttgtactttaaataatattaatgcattaacttctattttataaacacatatgtaagcgaaaatcatatgcagtgctataatctttagtcccggttcttaaccctaaccgggtttaaaaagaatttcgaaatagc

SEQ ID NO: 90895 - DNA, 1735 bp, Oryza sativa
acgtagctgaatcatgtgcctcgggagcatctggagtcgtggccgacgctgaatggctggcagtaggagacaccggagccttaggaatcacaggcaacgatgacggcgacgtgacagcagctcccgatcccgagggcgacgacagagcgggagaatctccgcccgtatcatcatgatcttctgtgaactccggatcttgtgtggctgtgttgaaatccagctctatatgatctgtattctctgcattttcttcagcaaaagtattagtatgttcaggattatcaagcatatggtcatctcctattgttgtacccctaccagtactatcatccgggttcagaagtgtaggtggcagcaataaaatctcagaccgtagtcttgcaccggcattagagtggagggatgcaaaaggaaaaacattctcatcaaagacaacatcccttgaaatatacactctaccagctgctacatctagacacttgaaccccttgtgtaaattactataacccaagaacacacactgtttggaacggaattgaagctttcttgcattatatggacgaagattgggccaacatgcacaaccgaagacccgaagggatgtatagctgggtttttgatgaaataaatgctctagaggcgtttcatattgaatgactttacttggtgtgcgatttataagataggtggcagcaatgaaagcttcatcccaaaatttcaaaggcatggatgcatgagcaaggagagataacccaacctctacaatgtgtctatgcttgcgttctgcagaaccattttgttgatgtgtatgaggacatgaaacatgatgactaatgccaatcttagtaaagaaatcatgtaacttttcatattctcctccccagtctgtttgcatggcaatgattttgcgataaaaaattctctcaacaagctgttgaaactcatggaatttatggaatacttcagatttttgcttaagaagatatatccaagtaaatttgctaaaatcatcgatgaaactgacatagtattttctgcccccaacagagtcaggagcaggaccccatacatcagaaaacacaagctctaaaggaaaatttgacgcacttgtagatttgagaaagggaagttgatgactttttcccttttgacatgcatcacacacacctaactcttttgactctcctagacatgggagattattatgactcacgaccttttgaacaatttgccatgagggatgccctagacgactatgccatattgagacagtgggcttgatagctcctaagacttgcttggatgaagacgtggaggctggtagaggatagagtccattacaacagggtcctctaagaagagtgttcttcgtgatttgatccttgatagcaaaaaaccgagggtgaacttcaacaaaggcatgattatcaacggcaagacgatgtgcagatataagattctttttggttctaggaacatgaagaatatttctcaaatatagattgcgtgtaggggtacgaatagtagattgacctatatgcttaatatccatacctgaaccactcgccgtgtggatttgttccttgccgttgtatctgtcacgggttgtaagcttctcaagctcattagtgatatgatctgtggcaccggtatccacgtaccagttcgaatctacaccatacgaggcagccgctgcaacccttgcgtccggcacaaaggagtcatcgtagcaatg

SEQ ID NO: 90896 - DNA, 2922 bp, Oryza sativa
acagaaggccgacgatcatcttccatgcatgagccgctgtgtcgacgtttgcgacttggatgagaatctccttggagatgcttgatagaaggaaaccgaggacctgttggtccgcagcaatccatgcctcatatgccggattggaaactttcttggttatttcacccttttctccttccttgacttctatttccgccgatggaacttgtgttgcaccggtcagataaccttccatacgtgcgccgcaaatcactgggagaatatgcgtcttccatagcgagaaattgttcttcgtcagcttttctgaaatagcttggccgaagagaggattcacggcagcgccggaggaggatgccatcgctagtttgatctagtcgtggcgagaaggctctgataccatgtaaaagtgcgtaaccattctcacctcgtctcgaagcagcgtatgtatatttatatgttgttgagaagaaccctcaacgtggcttacaagattgaatcagtttggatccgattacaagagataaaacattgtttcatgtgagaaacaaactctagacttatctctaagcctatgcaaatctaaaccatattatatctctaataaacacctcgtccgagaactcgtcaggtggctcaatcttctcctccgcctccgacgacatgcccgccatcatcgccccccgagacgcttgatctctctgctaacttgaatgcaaaaaatcgtgcgctggatcaagaactgaagatctggcagatcgatgagaaaccccaactccttgcctgtcacgcccagaaattcccgaatagaattccaagcagaatgtgcattaaaatccccgtccaggaccggccggggtacacaaacgacaatgttaacattcagatccatgtcttacaaacatcataaaagtcttacataaatacagcggaaaaatgaaagataattggagctaagccttgacttgatctgcagcgggaacacaactccacaggcatcctcgacggcacggacgaagcctactcctcggagaaaccaccatctgacacatactcgtactctggggttggggaaaatagagcaagactgagtactacccactgtactcagcaagtcataccggaataggggtatgatgcagggaattatcaaaggagagctagagtggttcatttgcataaaggttcatttgcattaaagcgagcatttataaacagaagttaaaagaattaaacagtcctgataattaatcaatattattcatccactatccaacgctataccacgttgcgacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccaacatgccaccacgacataccggaaagaggccgtgacaggacccttcgcataaccccctctaaccaagcacaccacacctcaagtttcacccccactccttgcaaggcagtgggcagtcccctctcatgcttaggtgaatccggaagagacagaggccgtcgtagggcccgccccgctccatcacgcccacccttgcctggatgcgtcagctagaggaaagctacactataagcccagccgttgcccacgctagtttgtggtaagtacgataagttcttccagggcatcccgcgaaccggtccttaactgccatgggtgcgaccagcaaaaccatgcacccacagcccaccatgtgattcattttaattaaccaacaccaaagcagtggcactaatccaacaataccattagaactaacagtctaaacattaataggatttttcccattgtgtactagttgaactaagcatggctaagcaacccctagtccaatctctagtcatgttataacccaagctaacaaaggaacatggtacaacaatagcatggctataacaataggtaaacaccccatagtaacattataaaacgatgcagtatttgaagaaaaataatagagcatttgcaatataggatcaacatgttcaagtgacaagtatgacttgccttgctctgttgttggaggaacctcggcgactatttcgaagtacaccggagcgtcagaagaaccggaatctaagcgacatacaaagcaaacaatacaaacaggctataagactactgaaacagagaacaaaaccatttttaatggatgctacacatttttcttgatttactgagacttgaatgggcttaaacggagcacggatgaattagttatgaattttggaagattcactgtatttattactataacaaaagtccttaaatcatttattgcgcaataaatcccagggctgacgtcatcaggggggcggcgccgacaggcggggcccgcatgtcagtggcgcacgggggccggtctaccgtggaccgggaccacgcgggtggtccaccgccggtccacgggatcgacggcccggatcggcccggggccgatcggacggtgcggcggcggcctggcttggctcggctcggcacaaagccggccggccggccatggcaagggcggcggcgcgcgcgcgtgttgctggcgacggcaaccggcggcgggaggcggcggcgcaaaggcggcggtgcacgaccggggcggctaggagggagagggaggggaatagaggaggagggatgcctcactgagagtggccggcgcggaggagaacgacggcgaacggcgacggcgagccacgggaggacaacggcggcgggcggacgagctccgggaggccctaagagaggaaaagagagagattagggggagggagatggaccacggcgatcagaaaccat

SEQ ID NO: 90897 - DNA, 2180 bp, Oryza sativa
ggaaaaagaaggaaaaaggatttttcctgggattaaaattgcatgtgcttaattttaattggttaaaattatttcaagagctctaaaaattccactaaaaatcttgttagcgtatttcggcatgtaaaactcaagaaaaattccacatgccaattccgattattatttgcattaatttattaaggtttactcttgcttgacacaggtattttcttgagaccatttaaaactccaatttaggcttgggaaagaacttcggggtgtgacattgcctctccaatataaatggcaaaacttcttgttctattcggtcaaaaatctaataacagaaacagagtcagcaactgaagaataaccctcgttctaaccggattctaaacctttgcacacaattctttttcgtaatcggtgtgatctctatcaagattacaagataaactaatctactcctagcttggtgcatggcttgaagatgatcgatcgtgtgacgcaccgcggctcaccgtggtaaactgcaacggcttccaagttccaactaacctcgaaccggaaactgtattttcatattaagagttcttaaaagttatcaactcaaagcccaaccgtcaaagaccgaaaaccaaaaggggagttggttaagcgcgtgccgatttcgagtcgggtccatggggcccacgcaccttcgcgtcgccgactccgtcggcggcggacgcagagcttaattcattttttctcttcaaattcctgggtatgcacttgaacgaatttttcaacaaattttaaatcacatttggaaaacccaacattctactaaaacattaaaaccttggactaaaagtttaaaaagaaacaattctaatatcgaaactttcaactcaaactagaagtttcagcttaaattaaaaaatatatacttaaaaactaaactcaaaatttgaaatttaaatttttcaactgatttttaaaaatctttcatatgttaatttgaaattttcaactcaacttatttatttataattttctagtagaaagttatcaaatgctagaaaggagaaccacacggtgcaggaggggttgcgcgaggaatgaaaaccgttcacggttagcctagggcgttcacgttgcaggatacatagagttatgtggcagcataccatgtagttacatgatgaggttatactataagaacactagctgtaacatcataaaaattaatttaaagcacacaaaaaaaaagaataatttaaacctttttttcccccaaattgcatcatgtatggggatgtttactgtgaagagtgcatatatagcttggaatctatctcggaaaggtcttgtccaggcatcttcgggcaccgcaacatctcgtaaaagggaggtatggaatagtgtgtggaatgccaaagtgaagggcactgtaaagattttcatttggaagctggtctaggacaaattgccaacgtgagagaataaagagagaagaaaaatcgaaaggcaagggatgtacccactctgtggagcaaaagaaaagaatagctaccatgcaacagttgaatgtacaaaagctaaggtgctaagggaggcttttagagcagtctggcaccttcgtgaagaggacaaatttgcatagacaggaccggattggttactgatattgttggatgctgtaaataaagaggaaagagtgcacattatgtatatgctatgacgggcttggtacctacgaaacgagttgattcatggtgatggatgaaggccaatagcagtatcagtgagcttccttgctagctatgaggaggtgctgcttcgcatctgacagcagctggacgacacataaggaaaaaagccaatgtatagcgaagcccagaccgaatctcataaggtggaaaagcaaacaaacaaatgcacggctccacctgaaggctcggctaagatcaatgttgatgctagattcagggcagaaacaagggacgcaagtgtaggagtaataatcagtgattgcagaggtctgatcctacttgatgcatgcaagacgctacaccgatgcagttcagtagcataggcagaagcgctggcgtgcttggaaggcatccgactggcgattgaatgggtgcatatgcctgctattctagaatctgacaacgtggaagttgtggctagcttgacaatgaaaagctcat

SEQ ID NO: 90898 - DNA, 3062 bp, Oryza sativa
tgccggcactatcccggccgtcatctggatcctcatgccgacgaagcagatgacgacgctgagcaccaccgccacggccatggcccgtggcgtcaccagctccctgaattccggcgatggctgcttctcgaacaccgcctccaccgatgtcgctgacatgggatcgccgatcatcgcatccatggcgattaaagctccaggtcaatggaggcaacctcctggagggtttttgggttgtgttgtgatggcacaagtgggtggtctcctgggttggctctcctaggaacaatgcatgggttggtctgaattgggaggtggtgagggaatgtagtgtcgctgtggagcaaaaatagcgtctgtttgttgaaccgatttctctgattctgttccttatttctatattgatgaaacagatgctgctgagggcaacatacctaatgtttacagggtggaaacggttacaatgagtgtccagaaagtagttttaaccatttgctttaagatttgtacgaggtctatcaaaactatgctaggggttaaaatagaatagaaatttgaattagaattagaattgatggatgtgacatgtagaataccaataatttcgcactcttttgcacacacttcaaccattgatcaactcatatatgcttaagaacacatttgttaacgaggtttatagccaaagcataaatcttgacactctaattatggatgctactcctcaatcaatagtacacctaactgctataggcctatgacaatgctgccatcctcctcgtgagtgcctacattgcattttcgtcaccatgcatagttacattgtggtgtcctctatatttaaagagttgatacgttacaagagtcaaaagctaaccctaccctatcacctgtattaatacaacactttgcatagaaaaatatgctgagaaactcctgttgagtaccacaagcttttaagattttgtactgcattatgttagaaaacagtgaacatttgtggaatagtagtataattcatatttcaactacaactttattctgtggcacttaactataacaagcatctcttacatgttgcaaccaaagctggctcacatgtctacttatgtcaattacatgacatatctatatgtaaaatacgatacgtgcatcattatttacaatgatcaataatgattcatagaccacttaatttccaccgagatgtggtaaccaattaaggagtactaacagtcaatcttaatttgatgagtgcatatattaacttgatctcaacatcgatcggtcatgtcttgggtactgttcctcccgagctgttcaggaatgagtccaccacctcaacctcttgtccactgggcaagaacttcatgcacatcggcggtagcaccttgaacatgttgagcaacgccgatggcagcgtgaagagcccctcgccgcagatcaagcccgctgcgacggcggccgacaggatctcggcgctcatggtgtcgatcttcttccagaggagcagcagcaggccgcccaggcacatgtcgagggtgaagtacgacccggcgaagaacggcagcgcgatcaccgtcatgctcgggatgtagaggtggagcctccaccccttgagctgcgagaccagcaccagggcgtcgatggcgatggtcaccaggacggcgatgacgcagagctcgacgcagtactttgggaggcccttcacccctcccatgccgatgatgcagatggcgcggtacagcccggcgtaggggcacgggtagacggagtccttggaccccagcggcgccccgggcttcgccgccttctcgaacgcgcggaagatgcaggggctgaccacggagctgagcgccacgccgaacacctgcccggcgatcatggcgcgcggcgacgtcagcgtcatgtgcgccgacttgaggtcctgcatcgcctgcgacgagacgtgcagcgacgccatggtgatcccgctgacgaggaggctggcgacgatggcgcccggcctggcgatccacgccgcgaagatgaagggggagaacttggcgtaggtgttcgacaccgaccagtcggtgagccccgtcgcgtaggtgttgcagaagccgaccacgggtatggcgaggtagagcacgccgacgtggtagtacttgatctggtcgaacatggccggcatcgcgaccatgctgatggccgtccatgcgacgtaggccgccaccggcacgaacattgggatcttgctggacaagaacatctcgatccttttgcgttcgtcgtagttcatgctagggttcttgctgatgtagctggccagccctgacgtttgctgttgctgttgccttatatggtagaagttaattgcagctgaagtcacgagtatcagaaagtttatcaggccgtcagtgacgatcagtgtcacgctgatgaacacctgccatgtaagtttatatccattggagaaaaaaaaacaagaagtttagaatagttcgtgtcactagtgaaaaactaccaaaattaatatggctttcatccaccgcatgcatatatctggaaattatatcagaaggtttgttcaagttataaattggatacatggatcatgacaaaaattctaatatactaggtattactatacttgataccttcatatgcatttcaattagtactactcccccgtttcataatgtaagtttttctagcattgcgcatattcatatagatatgagcaatgctagaaagacttacattatgaaacggaggaagtagctattaatttgggggacaaaattctttccgtgcattggttagtacgtaccacaaaatgagtgagataaaatcttattagatgatccaacaattgatatgatcttattatttacgtatatatatctttattgtttctctgagttcctcagttttgaggcttggagtttaagaactctcgtaactttcggctatctgtggataaagaggtaggtcggatttttatccattatattaagaaaagaaatgtaccttgtatccattgagtccgtctaagtttgaagggctagggctgcaggaat
